United States Patent 7,745,391 (HUMAN THROMBOSPONDIN POLYPEPTIDE) - sequence listing, part 236

SEQ ID NO: 639155 - DNA, 809 bp, Homo sapiens
tacaatcaatcatgtcagttgtcataagactccgtaaagtccttcagtggggatcgtagcatccaagagaatccttggggtaattcaaataacagattaaaacagtttctaatctggtgtagtaaatgctctgtgtttgattgctaagaaagcattgataggtaaccgcatatgtccgagagatagtctagtagcgtagcgagattagttcattattatataagatgacggagtggttaatataagcaagcgagtgtagttacaaataatgaaagtctgtcatggttataataggtggtttaaaaataacattgggaatacaaggacttgtgccaatgggtaattttcatagttgtttggtgttgatttgaaactggaaatacagtaaaattgtgactgtttaaaaatgttgggcaaaaaaaatcaggattgtaattttttattagtacttgaagaaagtaatcataaatgttaattctcagcatcttgtgaagctgtggaaagaagagtcgttgggtatttggaaacgttagcaagattttcctgccagtgtcagaaaattcgtattaatgaatcctgtcggattcctgggtatttgaaaaaataccaatagtaccatacatgagttattctaagtaggaaaaaaaaaaaaaaaaaaaaatttttggggggcctgagaaaagtttttaaaacatttgttggggggggcagtggtagtgaatggaacgggtcacaggactgggaaaagggtggttccaaaaaaagggggggggggtgaaaaacaaggggtgggaggataagggcggcga

SEQ ID NO: 639156 - DNA, 136 bp, Homo sapiens
cctttgcctctcgcgcctccttgggctcagcgccctttccagtctgatgaagaatctgggcggttttcttcaagccttctctgacaattaccatcactgtgcctcaccctcttctttttcttctaggaatgtagga

SEQ ID NO: 639157 - DNA, 109 bp, Homo sapiens
tttttttttaaataaaatttttcattctaatttcatcatagttacacgtattatattgtacgcgtcgctttgacaaaaatcaaaacacactaacgacgaaataagttag

SEQ ID NO: 639158 - DNA, 190 bp, Homo sapiens
taccgactcttagaaacgatatgggggtaagctggagattttcggatataatctacctcactttccctgtggctatttctgggtttccaatcacgcgccgagttgtttgaggacgatttcatacagcgcatgatggagctgtggccaccttagaagcttctagagattgaggaattctaagagacggcta

SEQ ID NO: 639159 - DNA, 408 bp, Homo sapiens
cttccctcacgattgcctcatgtgtatcatccgcgtatcagcagttgtcagatagtgtcccgtcatctcgttatgtgctgcgcactgtaatccatttctgagcgttaagccctggggttagccccaggatctcgctgttctcaacagtcttggcatagtgtctgatgtgctcctgtactttgtcaactgttcgaataagcgctgcatcgacatgcaaggctttatgcattcgcactctccactttgtcgacttgatggcatagaatcttcatgagaataatattaatagatggggtgagaagtagtagggacaggatttatgaaataccttcagcgagatctcagcatctgcctctggagttgtctcctcaggatgcggtcgtagagtatagggaagacagggaaaag

SEQ ID NO: 639160 - DNA, 281 bp, Homo sapiens
attactcgtgcctctaggaaagcggaaatccacagatgagaaagctgtggaactggtcacattcaatctgactctatcatcaatctgctcagttgtcagtattcctaacggtggcggagcaggacaggaaggcccctcacagtagtgacactgccctgccaaaagaccaacctttcctcagcacgactgacccatcgcgtgaacagtgggttaggaccgtggcctttctgactaacgaacagtggagacaagtcaggtttacttagaaacagacaatacca

SEQ ID NO: 639161 - DNA, 299 bp, Homo sapiens
tgtcagagatgtctgatatctaaacaacacgagaattcacattatcatattcttatgtgtgcataagagagaagcatttctaataaaaagagagaataaatataactctaaataaaataaataccagcagactcaagaagatatcaatcaatatactgttaaatctcttacacatgctataaatacatgtagctgctagtggttgttgaacccaatagtgtgatcaccacagtaaaattatttctgaatagggcacaattaaattatggtcagcacagctgtagtggtaggatggttaa

SEQ ID NO: 639162 - DNA, 450 bp, Homo sapiens
gagcaggtgagccggctcatgtccacatgctgggccgctgtgctggagctcactaccagttaggcgcagtccacaagcacaggagctatgatgcaggccccccaggacacccaaggctgcactgcaagcaggcacagccaggttggggccccaggagaggccagatggactggccccatctgatcgtcaagactgctctgtaggcttgaggtctgacagttcccttagggataaagtctcctatgggagcaagtcagcaagttaagcctagagggatggctgcccctggccgtattccactacagatgctcacacaccaaaccctttgggctctgcattggctagaatacggcccctaacacttctctaagcagccctctgtgccaactcaagtgtccatagtggtcgaggaatctcctgccaggattccagaggcccgtggcagtagct

SEQ ID NO: 639163 - DNA, 308 bp, Homo sapiens
gtgatggaacctcactactgcccccccgccgacgcactgggcacacacacacacacacacacacacacacacacacacagagagagagaaggagggacattctaagtaaattaaagtgtttagtctcacagttttcactcctagtgaaagtgccaactaacccagtacaaaaatcaatctagcaggtgtttgaatgttctctacctcaaaaagcaatcgtgctccagtgaggagcggtccttgcattggttgtgtttagtgaggtctatctatataagtagatttttttctaactaaaacaatgaatt

SEQ ID NO: 639164 - DNA, 856 bp, Homo sapiens
cacaggctctggaatgggcactctccttatcagcgaagatccgagaagaataccctgatcgcatcatgaataccttgcagtgtggtgctcttcagccccaaagtgtctgacaccggggtcgagccctacaatgccaccctctccgtccatcagttggtagagaatactgatgagtacctattgcatggacaacagagggcccatcgtatgtatatctgcgttcctgcgactcctgaagcatgacctactactcgaaagccgtacggggatctgaaccaccttgtctcagccaccatgagtggtgtcaccactgctccgtttcccatggtcagctcaatgctgacctccgtcgaagttggcagtcacaacatggtcccctttcccgaacgtctccatttcatttatgcctggttttgaccctctcaccagtcgtggaagccagcagtatcgagctctcacagtgccggaagctcagccagcaggtcttcgatgccaagaacatgatggctgctgtgagccccgccaggcgatacctcaccgtggctggtgtcttccgtggtcggatgtccatgaatggaggtcgatgagcagatgctataagtggtagaacaagaacagtagctacttgtgtgtgagtggctcccctaggaatgtcacgacaggcgtctgtgatgattcccacctcgtggctcaggatgggagtcaacttcattgggcagtaggacagcatcccggggctcttcaggcgccatctcggagcagttcactggcatgttcgcggaagggcttcctcccctgtacaccggcccggctggcgcgcggggtcacgggggggagcacttggactcggttgcgt

SEQ ID NO: 639165 - DNA, 302 bp, Homo sapiens
gaggggagacctataccctttgatagcgagaaagtttaagagagcagtggacgtgtgagtttgagagtcttttagagaggggctgcaaagaagaaggtcgtccacatattgaagatgactgggagacaggtttaaggaagtgaggtttcgggctagagcttgtccaaagaaatgagggctatccctgaagccctgagggaggacagtccatgtgagttgttgtgactggagggtgtcagggtcagtccaggtgaaagcaaataggttttgggaatcagggtgtagggaaatggtaaagaagg

SEQ ID NO: 639166 - DNA, 220 bp, Homo sapiens
tatgttctcgagtcgttacaaggccataggcgtccatattaatatgcacgaatgcgtataattagtcgatttagtggaagaaataagaagtaaatctgctccaagacagtctcccttgaattttgtcaagagttagaatggatggtgttaacgattgctgagtcctgcctatgctcgacttgcgtttcccaagcaatgggcttggtacgcttatgccagg

SEQ ID NO: 639167 - DNA, 181 bp, Homo sapiens
  misc_feature (17)..(17): n is a, c, g, or t
  misc_feature (26)..(26): n is a, c, g, or t
  misc_feature (58)..(58): n is a, c, g, or t
  misc_feature (91)..(91): n is a, c, g, or t
  misc_feature (116)..(116): n is a, c, g, or t
  misc_feature (150)..(150): n is a, c, g, or t
acctcgtgaccaccccnagggctgancctggtcccacgagggtgccgtgtaccctganagggccagtgcagtttggtgtgtcctccgcttnccaggagaagaacctgaagaactanttttcgttattggttttccaatcatttgactaanagtctccatttaaataaagtttttaaaagga

SEQ ID NO: 639168 - DNA, 771 bp, Homo sapiens
  misc_feature (112)..(112): n is a, c, g, or t
  misc_feature (117)..(117): n is a, c, g, or t
  misc_feature (122)..(122): n is a, c, g, or t
  misc_feature (130)..(130): n is a, c, g, or t
  misc_feature (133)..(133): n is a, c, g, or t
  misc_feature (140)..(140): n is a, c, g, or t
  misc_feature (155)..(155): n is a, c, g, or t
  misc_feature (158)..(158): n is a, c, g, or t
  misc_feature (161)..(161): n is a, c, g, or t
  misc_feature (170)..(171): n is a, c, g, or t
  misc_feature (182)..(182): n is a, c, g, or t
  misc_feature (188)..(188): n is a, c, g, or t
  misc_feature (190)..(190): n is a, c, g, or t
acatgtacatcttgcctagatgtcgatgactgcaagtaataatacagtttataatgaactatctacaattcttgttagcacatctgttatccgtaaacacctgtaactagcnttttnaattnattatttngantttaggntagcgatcactaatnttnagntgctgaggnnggcattttagngatatnangcacttctgtcagtctttgacaaaaagaacgtattttatggtgcttgcgaagatctctgaagaacttcctttcataatagaactgggcactgtactatgtaacacgtattcatgtcaaatgacatctgtgctgtagaaaaacattaacccttgctccaccaccacgaaactggactaaacttggcctttctaagtggtaccggaatgacctgtcactataatatacctggtatgttctcaatcttcatttacaactttacatcctctaaattgtataacggggtggataacccctatcacccagaacaaaaaccaggtgacttggcgcaaggaaagcgtacgacaaacctacctgtcaaccagcggaccaccacatagcggccagaaccaaacatagaaaccatgaagcggacactaacgcccaagcagaatccactactaattaggtcgaactggtccacacacggggaacccactgcacccagataggaccacgtaaccccggagcacatcaacacaaaacgcaatctaccacactgaacaccccacaacagcaagcacagacactacaccataaacca

SEQ ID NO: 639169 - DNA, 330 bp, Homo sapiens
gcacgagctgggatttgctttaaaatgttccaggctgggcacagtggctcatgcctgtaatcctaacacgttgggaggcccaggtgggaggatcgcttgagcccaggagtttgaaaccagcctggcaacatagcaagaccctatttttccaaaaaaaaaaaaaaaaaaaaaaaccctaaaaagttacccaggcagttagcttcgtacctgaggtcccagcttcttgggaagctgagctgggaggatcagttgggcatgggagttcgaggctgcagtgagccatgatcatgcctgcactccagcctgggtgacagagtgagaccctatcta

SEQ ID NO: 639170 - DNA, 326 bp, Homo sapiens
ccccaccccacagcgcttggagcatccctttggacgggctgctgtagacatccaacctgtctggacgttgcatggagggtggcgcagagcctctccaatccctggcgtacagggtttcctgcccgagggaagctgctccaggagcctgcgcggtcgcctgtgaaactgtgccaggacgactgtctcgtgggtgcccagcccatatcgtggtccaatcgttatatttctataactcaagtcctcgtgttacgttatcgggaatacaaataaatagaagagaatagataaaataaaggggggaggagctgcatctggaatatccccgg

SEQ ID NO: 639171 - DNA, 998 bp, Homo sapiens
gatgccaaattactgttgagcttaagggctcagtatggaaaacaggagaaagaaagcgtgtgtgtgtgtgtgtgtgtgtgtgtgtgtgtgcgcgcgctatgttcttctagaaggatgagagacaggagagagagtgtgtgtgtgttctactagtctccctagaaggatgagagccaggcctttccacacccaggtgggaacattagaaaagtgttatctagggaatctgcctcctagaagagagactaagataccaagtgtagaggaatcatctaagatatccgtgggctctcttctctagtgtgaaggccttggtcaacaaggccctatgtgtgtgcgtgaaaagcaagccttcgtgtcccccccttacttggttacaatagatacctaatagttgtaatatacttatgggggtacgtgtgatattgtgatacagcgcatacaagtgtagtgactcacgatcaggttatagagaatatctcatcatctcaaatcatttatcatctctgtgtgtcagaaatatttccaaatcttctaggctattgggaaacgttgcgataaatccgttgtaactctagttctatcagacagtggaactttacttcttatatctaagtgtatgtgggtaccttattaacccaagtctctgcatacacttaccccggtaccttttcagctgtggtaaccaccaatagtagaaataactccaaattatgagtataaccgtgagatatagggacatggagaccgggtaatacaccgtaaaataaggcgcccaaagccaacccactgtgtggttccaaacaggaaggggcttcaaattttttacgagagggggaataacccccgggtcgtcatttttcccagaatagtgttaagaaatactttgttaaagaggcactatgaggtacctccaaatatgatgaaggggagaaactgcggcaaaatacgacgaaggagatatgttacaactggatagcccagtggggggtgtacaa

SEQ ID NO: 639172 - DNA, 225 bp, Homo sapiens
ctttgctttgggacggcggggggtgtgggtggtgggcggtaaagggtctcagtctgacaccaaggctgcagtgcagttggcacaatctcgactcactgtaacctccagctcccgggttaaagtgattctcccacctcagccttccaagtagctgggactacagatgtgtgctgccatgcctggctaatttttgtactttttggtagagacgccgtcccaagcaca

SEQ ID NO: 639173 - DNA, 116 bp, Homo sapiens
tggagtatggttggtgctaagcatggtgttagatttaaaaaattaggggattgactccacttggtggtgtggtttcccattggttgaacatataatatatacactttggttattcg

SEQ ID NO: 639174 - DNA, 907 bp, Homo sapiens
  misc_feature (27)..(27): n is a, c, g, or t
  misc_feature (78)..(78): n is a, c, g, or t
  misc_feature (113)..(113): n is a, c, g, or t
  misc_feature (122)..(122): n is a, c, g, or t
  misc_feature (125)..(125): n is a, c, g, or t
  misc_feature (133)..(133): n is a, c, g, or t
  misc_feature (144)..(146): n is a, c, g, or t
  misc_feature (156)..(157): n is a, c, g, or t
  misc_feature (190)..(190): n is a, c, g, or t
  misc_feature (232)..(232): n is a, c, g, or t
  misc_feature (238)..(239): n is a, c, g, or t
  misc_feature (242)..(242): n is a, c, g, or t
  misc_feature (255)..(255): n is a, c, g, or t
  misc_feature (257)..(257): n is a, c, g, or t
  misc_feature (259)..(262): n is a, c, g, or t
  misc_feature (264)..(264): n is a, c, g, or t
  misc_feature (268)..(268): n is a, c, g, or t
  misc_feature (272)..(272): n is a, c, g, or t
  misc_feature (277)..(278): n is a, c, g, or t
  misc_feature (286)..(286): n is a, c, g, or t
  misc_feature (302)..(302): n is a, c, g, or t
  misc_feature (320)..(320): n is a, c, g, or t
  misc_feature (324)..(324): n is a, c, g, or t
  misc_feature (326)..(326): n is a, c, g, or t
  misc_feature (330)..(330): n is a, c, g, or t
  misc_feature (334)..(334): n is a, c, g, or t
  misc_feature (345)..(345): n is a, c, g, or t
  misc_feature (375)..(375): n is a, c, g, or t
  misc_feature (378)..(380): n is a, c, g, or t
  misc_feature (386)..(387): n is a, c, g, or t
  misc_feature (389)..(389): n is a, c, g, or t
  misc_feature (394)..(394): n is a, c, g, or t
  misc_feature (401)..(402): n is a, c, g, or t
  misc_feature (409)..(410): n is a, c, g, or t
  misc_feature (413)..(418): n is a, c, g, or t
  misc_feature (422)..(422): n is a, c, g, or t
  misc_feature (436)..(436): n is a, c, g, or t
  misc_feature (443)..(443): n is a, c, g, or t
  misc_feature (466)..(466): n is a, c, g, or t
  misc_feature (484)..(485): n is a, c, g, or t
  misc_feature (491)..(492): n is a, c, g, or t
  misc_feature (495)..(495): n is a, c, g, or t
  misc_feature (502)..(502): n is a, c, g, or t
  misc_feature (512)..(512): n is a, c, g, or t
  misc_feature (539)..(539): n is a, c, g, or t
  misc_feature (549)..(549): n is a, c, g, or t
  misc_feature (576)..(576): n is a, c, g, or t
  misc_feature (616)..(616): n is a, c, g, or t
  misc_feature (618)..(618): n is a, c, g, or t
  misc_feature (643)..(643): n is a, c, g, or t
  misc_feature (689)..(689): n is a, c, g, or t
  misc_feature (847)..(847): n is a, c, g, or t
  misc_feature (859)..(859): n is a, c, g, or t
ctagctgtgaataaatttatacaacanttcggtctgtataatatgatgaaataaatctacatcttttcttattttggngctttgaattatacatacaaacaacaattacaggnccttgttcncanagcatgtnggcctagaaannngctctctgannccctcaatggcaactggtgaacggtaacactgnttgcccagaactggtatttcctttgcaggggccaacagcttngaacanntgnttcgcctacaacncncnnnngngggntgcntttcnntttgttcnggtgttttttctttcntttaatgcatcattcacntggngngggngggnggggggggggngggggggtgggcggtgggggatcggagcgngtnnnggcttnntngcganacgagtnntgcgagnngcnnnnnngttnttgggatccttgangccttanagctatccagatgcaataaagtnattgtacagtatttcttnntatatnngtnatatgcnttgttctgcntttttttttttcactgttctagagacnctgttaaatnggggttttgtgttagtttggttttttnacagatggggtccagattcagtggttggtacacagacacnanagtgagctcctttgctaagtggcanacataattttgctttctgccttcaaaaacatatatccatcgcgttnaggcttcatgatactgctcctgcaaaaatgcaagtcgaaagggactgcagggactctcgctgggggccctgtgagcatcgagcagggctctaacccatggcggtgaccatgctggaggggtggtgtggtcaaaggacaggctggatggcgggtgcatnggcgtgggcgtngtcagcatgtggctggagtggctgaagggcgagatgtggctcagggag

SEQ ID NO: 639175 - DNA, 150 bp, Homo sapiens
ctcagggtcttccattaaagtagtagcagtaggaacgataggcattggtccttctgggcaggctgattcggggattaggcagctctgtctgggactcctggccttggctcagagacaggaacatcagggaggagatcagccatgaagaac

SEQ ID NO: 639176 - DNA, 177 bp, Homo sapiens
agggaaaccaaagtcagcccaggagtgtgggtggacggcgggtgctcccagccaggggagctggggctacatcttcacaaacctctggtctccgcagtcagaatggctctcttgcggagcaactgacatagtgcgggtgggtggcctggggcgtgatggtctatgaagttgttctct

SEQ ID NO: 639177 - DNA, 96 bp, Homo sapiens
cccgaggacacggctgtttattactgtgtgcgatataacagcacctggttcccggggggggggagatacgactggttcgacccctggggccaggga

SEQ ID NO: 639178 - DNA, 294 bp, Homo sapiens
cggtgtacatgtatccatccgtataatatatacaaggactttgaaatataggtttagtttgtatgtcagagggaggaaggaataaattatatgagaattaactttcttccttttacaatgtattacttccatggccagaaaaaaaagaaatacttctttgttttgtttttgttttgagacagtgtctcgctctgttgcccaggctgtaactcggtggtacaatcacagctcaatgcagcctccatctcctgggctcaagccatcctcccgcctcagcctcccaagcagctggga

SEQ ID NO: 639179 - DNA, 122 bp, Homo sapiens
tcatatgtggcagtattcggaggtttaaagctgatgccctggtgcttgtgagcaagaatacacatttagccaggcgggggagctcaggcctataatcccagcacttagggaggtcaaagcag

SEQ ID NO: 639180 - DNA, 125 bp, Homo sapiens
ccagaaaacgagccgggtttgacaccaacagtggtgcgaccatattggggattggctccccgaacgagcgcgcacatgagaaactaagtctcagacagcgccctcatatatagagagtgtgcgcg

SEQ ID NO: 639181 - DNA, 163 bp, Homo sapiens
gcacattctgaccaattaatctcatgagtaactaatctcaagatggtgattctttttcttttttctttttaatagccacatacggaagttcctgggctaggggttgaatcagagctgcagctgcaggcctgtgctacagcctcagaaatagaccgctctaccg

SEQ ID NO: 639182 - DNA, 1647 bp, Homo sapiens
tggcggtggccaacggtttattcagggccctgaacggggggggcgtggacatgcaacaccactgcggggcccacagcaggcgtgtgacgcggccgctcccaagcccgcggggcgcaacaaccacagccaggagacagccctgtggccaccacgtgggccacgcgtccagggccccaacgaggacacagcgcgaagggtgcccgcgggaccgaggcccagactggggtctcagggtgtatacaccactatagccgtggggcatatagaggtagaggacggcggcgacacgccacagatactccgtggtgtatacccacaagtgtgtgccacaggaaggcccacaagaggggggcacatgtgaggccatcacaaatcgtggcacgcgtcgggacacagcacacgcagtgtgcacactaaggccatatctacacaagactatgtgtgcagtagtacaagccacggtgcttcgtgcgtggagtgtgtagcaccacgagtgtatgaggcgagcggacacagtgagatgtggactcccaccctattaccacaaaagaggggcgcgaatcacacgtgcggagacctaaaatcagagcccagattctctacaacgaaacacagtacgatacaacacagaaccacagcgcagggaaacagaaacgaggccacccaccgagagaagtcacctgggagaacagacacagcgactcccccctcacaagacggaggggggaacacccgacgcggagaggcgacattcaccaaagagggggacaaaaccgcacaagagacaatcaacaccgcacatccaacacacaggccccatacaagtggagggactaggagaagaacagagcccgcaagggtaaccgaacaggagaaaccaggggcagtcgccaagaaacgcgccacccaaccaaggcagagccacaaacacaggatagcggcccactaagcgagaaggacgaccacgccgacagcaaacgtcggcagtcgcccacaagtctggaggagagacacgcctacggccaacacagcagcaattatcaggaaactgatcgaacgtgggcagcagcacgactcgacccgacttggcacgaccccgagcgcaaaacaccgaagcacaagacgaatctcagcgagcaaacaacagtgaggcgcacacccagcaacaaagaacaaccaagcaggaaaacgtctacgatgaaacacacacaaactacccacggcgggaggtgaacacacgacacacaccagtcggcgccaagaagacagcacacctgcacagaacaacagtcgaggccgggaacccaccaaaacaatcgagtagaagacaggcgacgagcaggacaccaaaccagcgaccaccgaggagaggacacacaccatacaaacgaccgacggtcgagaagcaccaaaatgagcaatggaagaagaacgcgcgaccaaccaaacacacaacccacgccagcgaaccacgccaacgagcgcgacataatcacaacacgaggacgatcccaagcattcccacaacaacaaaacaaccggacgagaccacgaggacccatgagacccagaagagaccacacaaaaaatggtgaccaggcaacgaaacagaacgagccacgacactaccgactacacataacagca

SEQ ID NO: 639183 - DNA, 368 bp, Homo sapiens
  misc_feature (196)..(196): n is a, c, g, or t
tgctgagtcagtgaacatctggatgtagatctgatatcacttcatcttatctctctctactctagattctagtatgtatgtcttcactttgaaaggcatttcaggctgggcatggtggcttattcctgtaatcccaccactttgggaggccgaggtgggctgatcacttgaggtcaggagttcgagacagtctggncaacatggtgaaacccgtctctagtacaaatacaaaaattagccgactgtggtggtgcatgcctgtggtcccagctactcgagaagctgaggcaggagaattgcttgaacctggtggaagttacagtgagccgagatagtgtcactgtcctccagtctgggcaacagagcaa

SEQ ID NO: 639184 - DNA, 180 bp, Homo sapiens
ataactaacccgactcaaccgcaacatctcgaaaacaaagggctgggaagaccaaaaccccctgcccatgccccaaccgattccccacaacattaacaggttctccttggcatctgttattctgggggtctggatgtttgctctctaaagaccttttaataaaattttgtcacaagcaca

SEQ ID NO: 639185 - DNA, 339 bp, Homo sapiens
  misc_feature (29)..(29): n is a, c, g, or t
  misc_feature (48)..(49): n is a, c, g, or t
  misc_feature (71)..(71): n is a, c, g, or t
  misc_feature (106)..(106): n is a, c, g, or t
  misc_feature (127)..(127): n is a, c, g, or t
  misc_feature (139)..(139): n is a, c, g, or t
  misc_feature (207)..(207): n is a, c, g, or t
  misc_feature (334)..(334): n is a, c, g, or t
ccggggccttcttcttgggagcggagagnggctacagctggtacaagnnggcagcccaagacgtgctttanagtgtggttcccggacccacatgagcggcaccgtngacgcaggacaggtgtttcangtgcctgggaanaggggcacctgagccctttacctgccggaaggtcatcgtgtgcaacctctgtggcaaaagaggacacncctttgcccagtgtcccaaagcagttcacaattccgtgacagctcagctcaccagcgtggcggggcactgaaggcgcgactgcctgccagggtgaatacactgccagctttacccctcccttaagtngtaaa

SEQ ID NO: 639186 - DNA, 205 bp, Homo sapiens
tgtccggttatgcaagctggcagtggtgacacacacctgtaagtgtgggactccgacagcggcgttgcgtctacaccatccctgctcatcagaacttagatgagctggtgtcaagtatgagcctatcacatgggaacttacttgacttactaggtgcctcatgataacacatgccaagatctgagacgcacccagagctggtccc

SEQ ID NO: 639187 - DNA, 316 bp, Homo sapiens
  misc_feature (158)..(158): n is a, c, g, or t
  misc_feature (225)..(225): n is a, c, g, or t
tctaaaccttttatgtgagaaaaaaacaccggaggggggtgtgcctggatctccttttcaagaaaagaccgcttttcatacagaatggaggctatggagcgcccaccttccactctgggcgtgaggacggttctttttctcaaactatatagctcccncagagtactatcataggcttcggaccttgggtcaacgctcttggcaccaatgtctctggcatgagtntgttggatgctcagcaatcaaggtaaagggacaaaattttgtgagattgacctctttgtccttgcacaagcaccagacacttccctgggcc

SEQ ID NO: 639188 - DNA, 135 bp, Homo sapiens
gctcagcgatgtttgtaacatgcaaaaactgggaaactaaccctggtacagcatgggaaatcattacaacaaagccacagatccatgacaacagtcagcgttatcactgtcgccagatcactttgttctctatta

SEQ ID NO: 639189 - DNA, 116 bp, Homo sapiens
taatcgatggagccgtagtcactcgcaaagctattcaggcctagacgcaaggcaagtactgcgatgtttgaatcgtattaggaggagaccttgagattcagcgcgcgtatgccttt

SEQ ID NO: 639190 - DNA, 112 bp, Homo sapiens
gtgcgcgtacctacgcctaatctactccactcaatcacactactccccatatctaacaacgtagaaataaaatgacagtttgaacattacaaaactcaccccatttctgcta

SEQ ID NO: 639191 - DNA, 125 bp, Homo sapiens
  misc_feature (14)..(14): n is a, c, g, or t
  misc_feature (55)..(55): n is a, c, g, or t
gcatcctttaccgnagaatgcagacaacatgtactacttctcacagcttgctctnactctcaatgcttggcacagtggcactgccccacagacagccggttcacgacctggaccagagactgatg

SEQ ID NO: 639192 - DNA, 128 bp, Homo sapiens
cacgagggcggcccaggatgatttctaccgcatcgggggggtcctgaacatgaacgaactcaacctgctgcacaccatctggaagggggagttcggagacgtgatgctaggcgataaccgagggaaca

SEQ ID NO: 639193 - DNA, 180 bp, Homo sapiens
gtgaccacaggagttcgtcagagctctggcagccttcctcaaagtccggagctgaaagtccccaaatggtgggataccgtaaagctggccaagcacaaggggcttctcctacgtgagactggttctacacgggactgttccacagcgggaccttacctccgggtgggcctggggttgggc

SEQ ID NO: 639194 - DNA, 304 bp, Homo sapiens
tgtcacccaggctggagtgtggtggcataatcatagctcactgcagcctcaagtgatcctccggcctcagcctcccaagtagtttggactacaggcacctgccaccacgcctggctaatttatttcttcatttttttaaaaaggatggggtcttgctatgttgcccgggctggtctcaaactcctggactcaaatgatccttcctctttggcctcctaaagtgctgggattacagatgtgagccactgtgcacggctcttcttcatggagggctggggcgagggtgcacacttcgacctctaca

SEQ ID NO: 639195 - DNA, 627 bp, Homo sapiens
aagatccctagctgtcgcagttacactcttgagactccagagaaaacagcgcaacacgtggcaaaacaaaatcctggtgctgcccaagttcttctcccaaagtattgttttactcccatagggcaaatttctgtcgcggactcagctgcctttaggagagtaaggatttgaaggggtacagagaatgcttgtcagtgtctaaggaggaaaccctgccttcacttatttcaaatcttgactctggtttcctaagcaaatttatcttaggatacaaagcacacataagagcttccttcttgccttaatgcaattaaatttgcagccattctgcagaagaactgaagctctcaggtgaaaagaagccttaaatcatgccatgatatatgtcgggggagggaacatttgggtataggtatttccctgaaggaagagaaagggttgaatgtattggcagctgagctgtcccttcaaggggatattgtgaaacaagctcaataaaaacctctccctctgaagcatgaaatgttcccagaggggacaggaggatacctttggtgctatgatgcaacctcaggtcatgtgctcgcacatgctggagcattttcctgagtaacctgaggaaaatgt

SEQ ID NO: 639196 - DNA, 613 bp, Homo sapiens
ggatttcggggaggctgagttgcgaggatcccttgaggccaggaattttagaccagcctgggcacaatgtagtgagaccctgtctctacaaaaagtttaaaaaacaaaattagctgggcatggtgcctgtagtcctagctactgggatggctgaggcagaaggagtttgaggttacactgagttatgcccttccccactgtactccagtctgggtgccagagtgagaccctgatcctcgcacaaacacaacaaaaaacaaaaaaaacacaaaaccagcggggcggccgcaccacgggcaccccgaaaaaagacgccaaaaacccaccgcgcgagggggcggccgggggacccacaatggggacaacggaccacaaacggagaaaacaaacgaggagaaacacaaagcatgaaaacaaagggggaacggaaaacagagcacaagaacacaaacaacaaaaaaaacacaggaagccggagcgcaacgcaagaagggacgcgcaaaagacaaaggcaaggaggagacaagcgaaagaggacagacacacgagcaaagacaaaaaaagggaaccaaacagagagcgaccgagagcaacaaataaagcacacacgtga

SEQ ID NO: 639197 - DNA, 200 bp, Homo sapiens
cataggcgatagcatgagatgatagataggaggaagaggaggatgataaagaagaggagaagaagaggacaggcaggctgaagtcctgaagggtcatctaggcacgtctgcatgggcatagatagacaatcctgttggctcaggggtctggtaagtgtgcccgtgggagctgcccacccccgtctgagattaggtccgag

SEQ ID NO: 639198 - DNA, 293 bp, Homo sapiens
acagatcactggttttccatcagaggttttgtcccccagggacatttggtcaggcttggagacatttttgtttgtcacaactgggggataggagggctactggaatttagtggtagaggccagggatgttggtaaacatcctacagggcacagggcccccacaccccaaagaattatccagcctaaaatgtcaacagggctatcattgaaaaaccctgaaataggatttatttatttatttatttatttatttatttatttatttatttgagacagagtgagcccttgtttca

SEQ ID NO: 639199 - DNA, 956 bp, Homo sapiens
tcgatgtgatctgctttggcacaaaaagtgcaaaaagggtctcgcgcatctcgtttgtccaaccccgtatattttaaccctccttcgtcttagaggctctttcaccttctttatgaccccgtcctgacactgggtggttatctccgccaccataggcctctgatatatgggcccgtgagcccagcccacgacaactaatacacagtggggccggtttattcccggagcgctacaacttcttggggcccactactaaacccgcctgggttccacagaggcccttctcattacgggggggtatactcttctctttttttcccaccaagaggtgttttttttcacagagggtgttttgaataggcgccgttattactccaccccggccgcttggccctcttccgccgccccttttttttgggggggtggtctgcgtcccacaatctggggtgatccccccctcagattttttccctcatggggctccccctctctctagaaaaacactgctgcgttgttgtctcgcgctaccggcgggtggtacataatccccctgtgggccactaaccacttgttatgatttaggaacacaccggcggccccttatttctagccgcctcttttttcaccaatttcttggggttttgattttccccccctgctgacacgccgctagggggtttgttggtggtccccttctccccttttctcgccggtgattttctggcgtcccaaaacttttggtttatccacccaccgactgttccccggggcttttacctgccattttttgggcgatcatgttcctctcccctatttttggttctactcccccgccgcgatttttttctctctaacaccaaaaaccctttgtggtttaaacacccccccctaaattggcctttttttaaattggtttttattttttttattttccctttttttaagaggggttttta

SEQ ID NO: 639200 - DNA, 258 bp, Homo sapiens
taaaaatattgcatgtgcatcattttctcagtcagtagtggtcagatattataacgagatccttggcatctgtggacagtaacaagtttcgcaagttctctagggacccctctggtccatgacaggtaatggtttgttgtatatgctgagacaaaagttaactgctctcatggaatgatattatgacaatttgaaaacacacacatacacttctttgtgaaaagtggccaccgcgcccggccagcttttggctggacc

SEQ ID NO: 639201 - DNA, 647 bp, Homo sapiens
gcttaacatttctccgtgttggggcagggaaaacaaagcccaactcttgagcaggggttccccctggggatctgtcaaagctccatggaggcctctcaagtccaagtgcctctggaagcctctccaattacatccccccaccctgtcccccagaaaggccccccatcagcccagtcccaggcgcccgtcaagcaggcctctgagagtgctacccttctcttgtaaccttgcagccaacacccctgcccggcccctgaggtgcctcctccagcccatgtttttacaggccctgcacagagtagcactcattaatttttggttaaggaatgaatcaacgaatgaatggctatgcatggacctctgggcagggaaacctgggttttctctggctaaaaggggaaggctaaggcatggttgaaattcaagcccccattccaggcctttttgcccaaaaaagaaacttttgtcacccttgccctttcctgtattttgagtccctggccaatagcacagccttccatgccccgaccccccccccaagcctttccattaggcctttgccaggatttaagcccatgagcacagggactggctatcccaagacctggcaaatgtgggtgctcaataaacccttgttgacccctcca

SEQ ID NO: 639202 - DNA, 118 bp, Homo sapiens
aaggttttttttttttaaaattttggggccgggggccttttaaacccctttaaaaatttaagggttttcccaaaggcccttaagggttttttaaaaagggtttttttttaatttccca

SEQ ID NO: 639203 - DNA, 236 bp, Homo sapiens
ttttttccccaaaagcccccgggcttttagagagggggcctccgggtccccctgaaaagcccccagggggttgcaattttggaaaatattttgactagctggttggggggatggccaaagaaataggcattattttattgcgggaatattggatgaaactttaactggccaaaaatgttgtcccttccgggaaatggactatggttttattaaccataaaccctccttacccatga

SEQ ID NO: 639204 - DNA, 379 bp, Homo sapiens
ctccctcttatggcacgctccttctggccacgcagtagatacacctgctggagcgcgtgctacggatgggtgttgccatcgtgaccagtgaactgagataaggcggagctttacctagcatggacttgtagcatgcaggtgcatcctttttccattgatcatccttaagatgtttctacaaattgattggagtccacctgtggtaaattcaattgactggatatgatttggaaaggcacacaagtgtctatatataaggtcccacagttgacagtgcatgtcagagcataaatcaagccatgaggtcgaaggaattgtctgtagagctctgagacatgattgtgtcaaggaaaagatctggggaagggtaccaaaacat

SEQ ID NO: 639205 - DNA, 271 bp, Homo sapiens
atctagaaattttatttttttaaacccggggcaaggaccccagctaacccccttcatcctcctggggcccccccctcccgccccccgttttaggttagggccttgggcaggggtttgccccctgttacccccccccccccggggtagcagggtttccccccctccccgggggagctgggtggggacttggggccccgggaagtaggggtccccttttttttttttttttttgggggttttttttccctgaataaaagtgggtttccgggga

SEQ ID NO: 639206 - DNA, 242 bp, Homo sapiens
tgtgtcgtggtgctagtgtcgtggtgcactgtgtcgtggtgcctgtgtcgtggtggtgtgtgaatgtgtccctgagatgcttgcatgctaaattaggtttgatttgtttctaggggagccaatgtgtcttgtctctaggagctcccataacactgtgatgaattcttgtagccctacacagcatacaaatccaggtccatgctctgacacgcaactgttgacagattttaccactgcagcag

SEQ ID NO: 639207 - DNA, 479 bp, Homo sapiens
cctagcgtgaccggggagtagcaggacgggaagtagaggcttggacctccatcagtggtggcatgatgtctgtgagcggtaacttgctgagaacccagtccccagagggttcaagtttataaagccgaaccctgccccctggtttgggaggggaaaatctgacacagaccactaaaagaggttgccaaaagattgaaaacatgcactatcccaggcctcatcgtgcatgcgggagtccctttacaccgtgttaaccacgatgatacaatgagtattagatggatcaggagtcctccttgtgccagatgccatagtaaggcacttctctaagacctcgtctcactctgtcctcaggggtactcctgtggggtatgggactgctatcaataatacccccaactttaaagtgatggaaaaaaattcactcagggacgttcgaggaccaaggttcccaaaacttgagctgggaccagaccagg

SEQ ID NO: 639208 - DNA, 444 bp, Homo sapiens
tcgacgatctggatggcgccaggttgcagctgcccctcctgaaaacgatggttgggtggccggcggatgtgcgctgggagattcgtcaggagcgcttcgacggacgcctgttgttcaagatgggcgatgacgacttgccccggcgccgggttctggtcacgactgcacacggctatccagatcgcccgttttcttgagaaaaccaccgtccagcgcgtgattgactcgaatctcacgcctgctttcgccggcctcttcaatcaattccaagggcagacgccgcacaaggctcaagcgccctttcagtacgtcgtccgtctgtcccaggatttcacgcaagaccccgtccggtaaatcggcaaagccttgcctgaggctcatcggcaagccgacattggtcacgcagcacaaacggtagaggcgctggaacaccgtggggcgctg

SEQ ID NO: 639209 - DNA, 261 bp, Homo sapiens
tgcgattgggctactcattacaaactactagactattattcttacatgtgggttcatagctccccaacggagtcgtttagcgttgcctcttgcacaagtaaataattccctctctagcacaacttttccgttacgaaattttgcagtgttcggaaaagattctctaaccaaaatcacaacacgaacaacacttaaatctatcccaagggttgccctagtgtttgcattacatcctacccccatcatagcacacgcattcat

SEQ ID NO: 639210 - DNA, 683 bp, Homo sapiens
gccaaaactacagttcccgaaaactcatccccatcttctccatcctcctaatcccccccttgcttgagtacctccacctccccccgctcccccaatcacaccgtctcattctttaacggaacttattttcgtcacccccccccgttcgtctctcaagataccgtgggttaatcctgtgccaactaagtcagcatatataaaggaccgtttcaaccctcctacccgagtcatgggaaccattcgagacctcgccctaccttgtccagttggctttctctgctgcaccacagagcaccgacgtccccctggcatgcaccgccacgattagagacattcccccctagctttctggcggccagctaattgcacagggtgctacgtcttgcaaccccgcgggagtttttcactgcaccccgacccttctggccgctcacaacgggtcgcaaatacttctttggtcttcttgttgcaaatcacgcaaatgtgcccaccgcctggcttgatgcagacgcggtgtcggtctcccgactcttgagcgcgggtgctgcagtggagaggccacctcgccagctgacgcttggtggttcctctcgagccgcccatgatcgttctatggtatgtggcgcacgacggccctcgcccccatggcgagtcgggggccggagccccgccccacatgacac

SEQ ID NO: 639211 - DNA, 915 bp, Homo sapiens
gcttgagaggctctggctcttgcttcttaggcggtccgagggacgccatggccgagtgcccgagactcggggaggcagtcacgccgagcacgccggatcgccgtgtgggcctgggagaagttcagtgtatttggacgagaagcagtacgcctggttgcccttaaccatcgagataacaggataggttacagttacgggtgctcttgcgtcgggaagacgtctgtcctggggaggccgtatgactcccatccagataggtccaagcctgctgcctatcgatgtggcatgctctacgcctgatggacgatacgcgatgccgtcagactcgcagttgtctgtgctgcttagtgtaccatatcagagattgacggcgtggaggacatgcttctcgagctgctgccagatgactgatgtcttggcagactagccgtgtcatcctttcaacccaggggccgtgagtcgctggccaagactatcaatggggatgtcgtgtttctgtatcaccttcagttgtactagtgcctgtgtcttctcgcatcagcgctgggagtctggggaggaagtggacacgacagaggatgagctcgtacccagggccttggaggatcctgctgtatgcccatatcgtgctcgcctataggactaacaatccgtgccaagggaaggaatccaatttggcagagcttcttccaggtgcccagatatacctgtgccctcggcttgactcaggtggatgatggtcttcagactcgtttctagtaccttcgtgtcacctcacagcacttagtatctccattgtggcgtaacccgagtcgagtaccgtgaactttgtgaagaacaacgaggcgattcactctgagcaaggacctctgagaccctggaccagtgggctcaaatggtgctaagccggcaggt

SEQ ID NO: 639212 - DNA, 413 bp, Homo sapiens
ccgcagtctggggcttggccctattgtgcttatgacagagggaatgtggcgccctgagtgtgacaggctgtggagtacgtgtggggtataggctcagagtggctggtttgcatatcaaaggcctgctgtgtaagtgaggagtcctttaccatctccaggaattctggtgaagagagtgcctctgacgtcaacaaggtcccagactgtagaatcgagaccatcaaaatactaccaaacctagttccttatttccgatggggcatgctgagacttttcagctccttctctgggttttagggctgtaaggctggaatcactgtgatgtcctgattttgtttcctctgggctcctttgggctgagagcctatgactatcgctctttctctgccatgttggagagtccctcgcctagc

SEQ ID NO: 639213 - DNA, 212 bp, Homo sapiens
tttatacctggagtggctggataattgcatctggttcccaagataagactgtttgattttgggatcttctagtaccaagttgagttcatgttgttggcacaacatttcatggaactggcagtgcaacggcatctgtcgctgctgatcccattggtcgtctgttagccacaagtacctaacatcatacatgcatgttgaacctgatgcaaaca

SEQ ID NO: 639214 - DNA, 267 bp, Homo sapiens
catagatctcttgcacttgtatttattgtattcacagtttgcatggtttctaactaaaggattcaaacataagtttgtaggatgaaatggcctgggacattccaagggcttctctgagagcgcgggattggctgcagtgtagatttgcctctgtctgaggctgccccagacgtggccctcctcatgccccctccatgcacctctgtcccctctctggctcctgtgcatccctgcgagaacgtaggggtcttgtacctaagtttagat

SEQ ID NO: 639215 - DNA, 403 bp, Homo sapiens
aggtgactctgaggatctcccccggtatcccaccctggggccaatgcttttcacaagtaccaagtcataaatagatgccctcataattgaagatgcaaaaaacaaaacagaaagagtgagagcatgtgcatgattgattcctatatattgtttattagtttaataccttagtacattaaccaaacacaagacttcaggacaggtcgtctgtggagtaatatcttcatagaagctattctcccatagatatatcctttcatttgaaagcgtgcaactggccagtgggctcttcgtgcctgctggccagatacagccgatatatcaatttagaggaattgcagtggagaaagagttcaattcaagcagagccagctgaatgggaggctggagtattattactcaa

SEQ ID NO: 639216 - DNA, 927 bp, Homo sapiens
cgtctctatcctataactagctgtaaatttatgttacgtgaatagattctcctccgattaagcttgtgttacatgataatgctgaactgacatttgtgagtccatttatctacacttcaaatcaataagatggtcattattaccctcgatctgtgtagacctacaacacagtgccatgatctattaacgggtataaaagtgtttatgtaacctgttcagggtattgcagtgtccctctctacctcctcgagcagtattagcatgcatatcactttcacctctattcattggcccagtatattggaatggctcactgcacatcgcactcatgtggcaactatctactagtctctaggacggcctgagagttgaccccttaacccagtggccaattagggtatcgtttcatattccatctctgttaccttcacatcttacgagcgactctggggttggtgaactcggactcgcgacagatgaggtctctaatgtctgtcgtcgtccacgtgtttctccaacctcgtaaattaagggacgtaagtcaagctccgaatgagagctgagtgcgattgacgtctaagctaaggactgaagaatgagcctttaattgtgaagctttttggaattgttttttaaactgctaaacgtgttgacctgaaccaataatcccaaactgaggtggtcttaaaaaacttaaccaatatctctagacattcaaccagttttcccggttgggggcgacgcgtcggggaggccgattatatctaaccttcgagaaaggagggtaccattgtcctacaggattttcgtccgaggctcaatatgcaggacatttattatactgtcaatttgattcctaataagcattttgaccctcgggagacatagcttcccttagatggaattaacacaggggccaatcctgtg

SEQ ID NO: 639217 - DNA, 1090 bp, Homo sapiens
  misc_feature (1090)..(1090): n is a, c, g, or t
gagagttgggttccagctttctgtagctgtaagcattggtggcacaccactccttacaaaggcaactagaacctgcggcatacattggcagagatttcttttaattttctggacatgaagtaaatttagagtgctttctaatttcaggtcagccgcacatgtccaccttctgattatccttcggagaacatttccgacttttctctcatctctctctccccacgccctaagatcgtcgcacaaacaagcgtaccttgccctacctggacacactaacttccacttgggatctcggactcagaacctggactccactcccgggcttccgctggtgctgacaggctcccgacggttcatcaacacctttcccttcctggcagcaatggccttatttcgacacaccaccattgatctctagcttggcctgcatgctcaaactgcgcttaggtaatcaggtggcattctcgccacatatctcaacaactgttacagacgcagtcgcggcacctgggtgaacacgatcccgccatccgactgtacgataacgtacccaagctgggtcgccagggcctccacgctcaattggaaaccaatggggaccccagtggaacaccgatccattctccaagtccaacattgtgggaacacggattcttggacacaggcaggattcagcgggcttgcgttcttaagctaacttgggcagcggacagccgtaacatttcacgacaaattttacactttctaaccttcgtgcaggcgaacgttggcaacgcgcactggtggcgcagcacttgccatgggcccttggagggtgctctccaaaaaagaaggctttattaacccaagggtacattggtggacctcccttacggacgtcgctaggcaagtaccacccacatcggggatccaccgattaaggtcgttatcggcgaggcgccaacacagtcttagccataacttgcgaaccagtttgggcaaaaaaccacttaaatacaaggggttgcattccggcaaagtcgacatgtcaaactgggggcccacacgcaaaacctccacagctctgcacggtccctacagacagcacacn

SEQ ID NO: 639218 - DNA, 464 bp, Homo sapiens
  misc_feature (442)..(442): n is a, c, g, or t
cttgtactgcgcttctgtttacaaacgattcactgaacagacttaacttgatgatggaaatgatgaaaaacaggcctaatgtaggtgtaaaagtgtattcaaactctagacacggctaatcagattttaattcaatcatacacacataatcctttgtaatcatttttcttttaagtgaggatatctactgtctgcttcatagggtgctttgaataaaatgaaaacgtatttatactgtttttactaaggtaacaaaagcatgataatccttttttttgcaagtgtaaacgacagtctggactcttaacttcttagtgcctcagttttcctttggggtatacttcacaaggtatcagaagtactttcagtctacaggtctctatgtccacataactaaggaatgcctaactaatggaaacttaagttccttctagccattaanacagagagaagatcaatttaga

SEQ ID NO: 639219 - DNA, 160 bp, Homo sapiens
cccaggcccccagccagctgcctccagcctgcccagtccactccagcccagctggtcgggtccttcctgcaccttcatcaatgccccagaccgccctggctgtgagatgtgtagcacccagaggccacaaaatgaaaccattaaagacccttaagagcca

SEQ ID NO: 639220 - DNA, 285 bp, Homo sapiens
  misc_feature (36)..(36): n is a, c, g, or t
  misc_feature (98)..(98): n is a, c, g, or t
  misc_feature (107)..(107): n is a, c, g, or t
  misc_feature (172)..(172): n is a, c, g, or t
  misc_feature (174)..(174): n is a, c, g, or t
  misc_feature (218)..(218): n is a, c, g, or t
  misc_feature (255)..(255): n is a, c, g, or t
ccaacatggccttttccccattcagcatcgccagcntccttacccaggtcctgctcggggctggggagaacaccaaaacaaacctggagagcatcctnttttacccnaaggacttcacctgtttccaccaggccctgaagggcttcaggaccaaaggtgtcacctcattttntnagatcttccacagcccagacctggccataagggacacctttttnaatgcttctgggaccctgtacagcagcagccccagantcctaagcaacaacagtgacggcaacttgg

SEQ ID NO: 639221 - DNA, 124 bp, Homo sapiens
  misc_feature (18)..(18): n is a, c, g, or t
ggtgtatgaaatagacantcacagatgcgagtgttgttcgctgcctgtggcatccaaagctgaaccagatcaatggttggaactggaaatgggattggcttaaagttctattacgaccccaaca

SEQ ID NO: 639222 - DNA, 1302 bp, Homo sapiens
cggacgcgttggcgtcgaaccaggcgtccgcccacgcgtccgattgtaccatctcacttctaggaatactagtatatcgctcacacctcatatcctccctactatgcctagaaggaataatactatcgctggtgtcattatagcgtactctcgataacccgtcgaaggagccactccctcttaggccagagtattgtgccgtagttgccatacgtagtcttatgcgcgcctgcgaagcagcggtgggcctagtcccgtactagatctcaagtcgtccaagcgacataatgggcctagagcgtacgttacgaataaccgtagaagccgtaactccaagtggcctaagaagcgtaattcggtcccgaaacgaatggagtacttgagcgtaacgcacacgtggagcgagtgaaccatatgtcccagagagagagaccagccagttacacgttctggcaaagtcgaaggcaagcgaaagagcagcgcgcaaacaaagcccgataaagtgtgaatagtaaggcgcagttccaattcccgcgcaccgttaagccgttaagttcgtgtgatagggacgaacagaaggtggccccagaagtacgaaagcgtgtccaaaagaggcggcacgaacggccgaaacagaaggccgccaggttacaagtttcgtcggctacaaagggcccacgttgaggggagtagttagccgcacagccagcgcggatagacgaggccgcgaccccagacgttaggcgaagtcggtcgcacacgccgattgcccacctcgggcgaaacagagaccacgaccaggcccacccaggtttaaatcgacgagccgcgaaagcaacgagtaggagggccagcgccagcatgtgaccagcgagccggtgaggcccaggccccggttatgcagaacgcggggtgtacaaggccgcgttaacagggaggcccgcgcttgaaggcacacgcccgggtttggggggacacaccccagcagagtggcggcacgcagatgatgaaaagtgagcacagcctagccgcaccacgtggtatcgacgccacacagggcgagacaagcagcaacacgaggaggtagcacacaaaacagatgtgacggtcagggagaccacaccacaaaacgacgcgggacgacgcagacccacggaagagagacgaacgcgggtggaccaccgccggcgacagagcgccaacgtctggagtacacacaggattgggccacagccaaaagaggaagctaggggtggacaagcaagaacacgcgcccgcaacaaaagcgcgcgcagtgttcaa

SEQ ID NO: 639223 - DNA, 103 bp, Homo sapiens
gtcccctatagcctacaaaagtggtcatccaagggaagggagggtggcgggcagctgcagaaagcataaaatgacaattaaaagaagttacattagtctttta

SEQ ID NO: 639224 - DNA, 624 bp, Homo sapiens
ataggccggttctaatttacaagaacaccgcggcctgaggccggagagtcccttcaacccgggaggcggcggctgcagggagccgagacggcgccattgccctccagcctgggcaaaaagagcgaaactccgtctcaaaaaaaaaaaaaacatgtggccgaaaccaggaagctgtgcgcgagtggcgccagggccccttctttctccgggccgtggtgtccggaaggtttccctccgaggcgcccgggctcccgcaaggcgggagggaaaggggcggggacggtgccgggggccggagagcttcagaagggccctgggggccggcctctgtgctcatcccggccattcggcaaggggacgggcagctatgacctgtgagtggccttccccggcaaaagagggctcccccagaagtggcgtgtggtgtgcgtggcgggcgtggcgcctggtgaagaaaaccgggcgaggacagagaagcggcgtgtgcgctgcgcgcaaagggagaccgcggttcacaaccccccggtatgagggggaagaggactttcacatcagagaggggacagggtgattctcacacagtgccccaaaagggcccacaggtttccataaggggggtggaag

SEQ ID NO: 639225 - DNA, 139 bp, Homo sapiens
tcagattcaccttagaggtctaagaaaaaagtatcatctggtcagtttcctcaaataagactctcgtctcccatcaaaagaagaacgcccaactcacaatacacactcaatagctagggtggaagacagggtttcaccc

SEQ ID NO: 639226 - DNA, 245 bp, Homo sapiens
  misc_feature (17)..(17): n is a, c, g, or t
  misc_feature (44)..(44): n is a, c, g, or t
  misc_feature (130)..(130): n is a, c, g, or t
  misc_feature (159)..(159): n is a, c, g, or t
  misc_feature (242)..(242): n is a, c, g, or t
ggtgtccgcactaattncggcatcaatatggtgacctcccgggnagcgggggaccaccaggttgccttaaggaggggtgaaccggcccaggttcggaaacggagccaggtccaaaacttcccgtggctgnttcagttagtggggattcgcgccctgtgnaattagcccactggcaacttcccagccttgagccaaaccattagccggaagaaccccccgttcttcttaacttaaagattccnttt

SEQ ID NO: 639227 - DNA, 195 bp, Homo sapiens
tgagcatacatctttattaaacacctgaagttactggggaggaggccatgatgctgggacacacggtcaaagtcaatcttctccagcaaggttctgtgggtttaatggctctccttctgtggctacagatggaagatctgccccagactcgtctggcactccgagccgttatggctcaggcgcggggttaccgag

SEQ ID NO: 639228 - DNA, 724 bp, Homo sapiens
  misc_feature (35)..(35): n is a, c, g, or t
  misc_feature (65)..(65): n is a, c, g, or t
  misc_feature (73)..(73): n is a, c, g, or t
  misc_feature (77)..(77): n is a, c, g, or t
  misc_feature (82)..(82): n is a, c, g, or t
  misc_feature (108)..(108): n is a, c, g, or t
  misc_feature (123)..(123): n is a, c, g, or t
  misc_feature (127)..(127): n is a, c, g, or t
  misc_feature (135)..(135): n is a, c, g, or t
  misc_feature (141)..(141): n is a, c, g, or t
  misc_feature (152)..(152): n is a, c, g, or t
  misc_feature (163)..(163): n is a, c, g, or t
  misc_feature (180)..(180): n is a, c, g, or t
  misc_feature (188)..(188): n is a, c, g, or t
  misc_feature (201)..(201): n is a, c, g, or t
  misc_feature (208)..(208): n is a, c, g, or t
  misc_feature (497)..(497): n is a, c, g, or t
  misc_feature (724)..(724): n is a, c, g, or t
ctcacgtaacctgtaacataagcatttcccaagtngctattatctgttaataacagtggtttgantaattggnttgnctgtntggatgtggggggggggggggttggngtgagggggggctgnggcncagagggngcagtnggtcatttggnaccatattgtntgtggctttttggtttnggtgcttnaggtcttaggttnttgtttntggaagataccttctcttttggaactgcagcatctccctgtcctccccaaggggaatttaggccaggaaataccagatcttccctctctgattttcttctcaaatcccaatgcaagacaatggagactaaatacggttctggtcatcaggctcttccagagcatccgggtgcatgagaagtgaataggtgattgtgttctcagccccaactttgtcagcctcatcaggattagtgggattggctgaaatccgctttttcctgcagtagatcaaggccactacagcagcnacaatggccgctacagcaatcccagtgaccacagccacaatgatccccatcggtgaagagctgggagcttggacagtgatggtcacaggcttggatgagtacagcgtgtagcctatgtttcctgtgcagtggtaatcaccactgtgactgtggtttgcttgtgggatggagaagttgggatccgaacgggaaaatttcttggattttccattctggaagaatgtgan

SEQ ID NO: 639229 - DNA, 488 bp, Homo sapiens
gcggccgcctactactactactaaattcgcggccgcgtcgacgtgtgtctgtgctgtgctgtgctatctgtgctgtgctaagctgtgctgtgctgtgctgtctgttctgtgcagtgctgtgctgtctttgctgtgctgtgctgttctgtgctgtgctgtgctgtgctgtctctgctgtctgtgctgttctgtgctgtctgtgctgtgctgtgctgtgctgtgctgtgttgtctgtgctgtgctgtctgtgctgtgctgtgctgtgctgtctgtgctgtgctgtctgtgctgtgctgtctttgctgtgctgtgctgtctgtgctgtgctgtgctttctgtgctgtctgtgctgtgctgtgctgtgctgtctgtgctgtgctgtgctgtctgtgctgtgctgtgctgtgctgtctgtgctgtgctgtgctgtctgtgctgtgctgtctgtgctgtctatgctttgctgtctgtgctgtgctgtctctgct

SEQ ID NO: 639230 - DNA, 356 bp, Homo sapiens
  misc_feature (352)..(352): n is a, c, g, or t
  misc_feature (356)..(356): n is a, c, g, or t
gctctcgctgtagtaaatactcagatacagagtccacaggtcagatatcagcaacaactgtgacacctcagagcactgggatatttgaaccgtgaagcaaacttgcaagctctaatagcaacaggaggtgatatcaatgcagctattgaaagggtactgggcttccagccattatatgcagcatttctgtatcttggatgtgatttatttttgataaccggtcttaaactttcccaatatgaggcattttaaggtggagtacagtaagaagtgtgggtttttctggatttttcttttctggaacacagggaattaaggctactggatgcataacttctgcatttatatggtntttn

SEQ ID NO: 639231 - DNA, 129 bp, Homo sapiens
tcgcctatccacggcaccggggttggtgtaaaataggcgctatgtagaagtagaggttaaggatggtgatggtggctatgatggtggggatgatgcaggcttattgtttcttgtgatattcttcgatat

SEQ ID NO: 639232 - DNA, 824 bp, Homo sapiens
agcgtaggggaagggtgcgggagactgatccggcagtggcttgcttgagagggtgctaggtgtacccgcctggtctcggtctggctccagctgccctgcaggtgcccctgggctcaggtagttagttgttcagtcagctaatgccgttttatcccccatatgggcgctgagctgtggctgttccatggtacactgatgctgtccccgtcctgagcaactatgcaccccggcccacagctagagttacaagggcacaaagcagctctgaccgaattctaggacagggcgctggagggacacgctgacctgggaccctgggtccagccgcatccccatgacccagtgctttcgcgatcaacctggcaggtcacattcttgcccaccacaactgaccaggccctgtctctcctccccgttgacgcccgtaagctgtcgagctcagactttgcactatagcaggtgcttcccaaacggggttctagacttgggctgcttagatattgacagagttacgcattttactttcactattgtatctggcgacaacaagaatgcgttggaaccacgatgactttgcatcagactatttcgcttacggtcgagactacttcctcagcaacggagtgactttcactgcatgtcaggttgaccaacgcggttggtgagcatgtcggatggctgtgatctggacgagggctgccagcgggccaccgagtttagcagatgctgtacgtcccagtcaataaccttgcctttgctaagaaccccctccgacgggccttcggtgggccttgcacttcgagggaccttggacctgtccccaa

SEQ ID NO: 639233 - DNA, 379 bp, Homo sapiens
tatagagtcctgatctttagccattagtgctagattagggcactgctctactgccgtgtcagttttcatgcactttgcagacctatgtgatgatcagatactcatgcttatacctactcaggattttctataactgctatatctggttcgagctgctaaagcgtatctatatttgcatgacctctatttttaaagagagctggcagaatgctgatcagtgaatgagcctaccccctaacgattattatgtcataccgtgaacttaataaagatcgatgtacagaggtaattatgaatgcacacaggactctgcctccagagacagagatccatattcaggagcattatactttcttcagctgagcgactgcgctttttc

SEQ ID NO: 639234 - DNA, 612 bp, Homo sapiens
  misc_feature (306)..(306): n is a, c, g, or t
  misc_feature (495)..(495): n is a, c, g, or t
aagaagctatgcttgtagtgtgttgggaagacttaatctgagcaaaacccatgattcttcaagacatatactctataacacacatggaaaaagtttgacacaaaactcagctccaagcataacttatttaataaagaatcctaataagtttcatggttatcaagaaccatattttcttaaacatcaaatagctcataccatagaaaaaaactgtgtgtataatgaatgtggcaaagcttttcattataagtcacaactcattatacatctcataattcatacaggatatagaccttatcaatgcantaaatgtcaaataaccttcactaccaactcaaaccttaatgctcatcagatacttcatacaggataaaaaccctactcatgtactgagtgcgagaaggtcttctctttcaagtcacagctcattggccatcaagaaattcacacaggatggaaaccctatagctactataaatgtcgtaaaacctacanttagaaatcacagcttcttttacaccatagaagtcacactagaatgccttgtcaatacagccaatgttcccctttaattttaagtctccattccttatacaccagatctcatactag

SEQ ID NO: 639235 - DNA, 447 bp, Homo sapiens
  misc_feature (8)..(8): n is a, c, g, or t
  misc_feature (16)..(16): n is a, c, g, or t
  misc_feature (49)..(49): n is a, c, g, or t
  misc_feature (72)..(72): n is a, c, g, or t
  misc_feature (109)..(109): n is a, c, g, or t
ccaaaaanttgggggncttgaacggaataccattggccattttatcccnaccccaatggaaatgctataccngccttaaaaaaatcatgccagaactgtggtttcaaanttatttctagtaaaaggacacctccactttttcataatcagtctttctagaatccccagtgtacagaactgtttagaagtagagctctcccactttgggaggctgaggcaggcggatcacttgaggttgggagttccggaccagcctggccaacatggtgaaacccggtctctactaaaaatgcaaaaacaagctgggtgtggtggcaggcacctgtggtcccgctgctctggaggctgaggcataagagtagcttgaacccaagaggcggaggttgcagagagcagggattgcagcactgcactacagcctggtgacagagcaagactgtgtctcaa

SEQ ID NO: 639236 - DNA, 98 bp, Homo sapiens
tcaagcttctaacgatgtacggggacatgaaagtgcatcctttccctccaaaaaaaaagttgttcagcaccagcaaatccatcatgataatgtagacc

SEQ ID NO: 639237 - DNA, 221 bp, Homo sapiens
gagcccaggagttcaagaccagcatagtgaaaatgacaaaacccctgtctctacaaaaaatttaaaaaattcgccaggcatggtggtgcatgcctgtagtcccagctacttgggactgatatgggaggatcacctcagcctggacctccaggcacagtgatcctcctccctaaccctcccgggtaactgggactaaaggaatgcaccataatgcctgacta

SEQ ID NO: 639238 - DNA, 163 bp, Homo sapiens
  misc_feature (34)..(34): n is a, c, g, or t
  misc_feature (90)..(90): n is a, c, g, or t
  misc_feature (159)..(159): n is a, c, g, or t
cgggtagccactgctatgctcaatcgatcacgancctgtcacgcggacccccttagagttataaacccttaaaggggacaggcattgctnactcagggagctcggtttttggagacgtgagtccactgatgctcccagctgtgccctttccttccacgntcgg

SEQ ID NO: 639239 - DNA, 533 bp, Homo sapiens
ctccagatatgggacagcgggggaagtgggatccagcctttcatttatcctttcagcatttttgtcctctttactctgtgtacaaaaaagagaggattatactatcatagactgtgtttctaaacagaaactcaggctgggcacagtggaatacgcctgtaatcccagcactttgggaggcagaggcgggcggatgacttgaggtcaggagttctcaaccagcctggccattaatggtgaaaccccatctctactaaaaacacaaaaattaaccaggcgtggtggtgggcacctgtaatcctagctgcttgggaggctgaggcaggagaatgaatcgcttgaacccaggaggtggaggttgcagtgagccgagaccacaccattgcactctagcctgggcaacaagagcaaaactccgtctcaaaataaatacatacatacatacatgcatacatacatacagggattaaaatagtctagtactgacacctgaacagacagattgaaccggatagcttgccgggtaccgagct

SEQ ID NO: 639240 - DNA, 822 bp, Homo sapiens
  misc_feature (371)..(371): n is a, c, g, or t
agcgggccgctccgggggtggagtcacgggtcgcgactggcctaaggtcgccgcgagaacgtgccacgtggggatgagattcgctgggcgtggatagctggcggctgctgcggcgtaggtcccgacccacgtgaagcacagcctaactagtagctctcagacgtgcacaacctatggatctcgggaacaacgaccgagtgcggactctaggatacctgactgagggaccgtgcttgacccagagttgtgaacagtgcgtagcttcattccctcctgtactcctgagcgtactctgggctactttggaaggatgccagatgcaagtcagagagagctcggacacatgtgtgcataccaagctcgcttgaaanttcgctgaaagaaccaagggaccgctggaaatccacagccataggaaagctagacgcaagtccgcacgcctagcgcagtcacgccagatgaagcacttccacgacatcatcgggctaggccatctggaaaccagctagtatggtcgttagggggcggacgagagaggtgcccagcccgatgcgaggacacgaagctgcctgtgtcctgagcgcaaacactctgacctggtcacagccagagacacttggacaatcgctccatactccccggcgatggtcatgtcgatggctggcaggcagggacctagagctacttcatctcacggaatggcttgggcaggggggacatgatttctacttgatgacctccactgcatttgatataagtgacattgaaatggcagaagctaaatcccactgggggctgctccaggaaggctgttgctgccca

SEQ ID NO: 639241 - DNA, 140 bp, Homo sapiens
ggtttgtatagtctatcatatgtttctatatataccattcgtgttacctcatagaattcaagtatttatatatcaagatctggtatatctacacagtggttggacatctcgtttcacacatgagacatttcttcagaggt

SEQ ID NO: 639242 - DNA, 1028 bp, Homo sapiens
attggaaaagatctgggactatctgaaactagtgagaattaacaccaaacccaaaggccaggttaccagattacacatccccagctggtgcttccttactccaggaccacagctggaggatttctgcatgaagattcacaagaaatcttatcaacagaatttaaatatgctctggtgcctggggtctactctgctgaaacacaatacctcagaaagtagggtacagagaccactagcgttggaggatgaggatgtcaattcaaatctgtgcacagaagtgaatacctttcccttttcccatctgccggacgaaccacaacagcgttcccctatgatcaagcaccctaccccaggttctattctggtctcttggcacgtcactggagtcaggatccaggggacgggagatggagggcacccaaactgggaactatcatttgtcttaccttggtgtcagccttgtatgtcgagactgcatacaagagatctggctagggctgagtcgagactatcgatgcgaagacaagacaagacaagagaagacacacacataaaccaccatgataggacaagtccacagaccaagaaccagaagcaaacaaccatagagcccatagacaaagaagaaaaaacacagacatgataaagattcaaggatcaacgaggcaatacaaacccagaagatatttgaacggcggcggataccatacacagggcaaggcgattaaggcaagagccacaactcgaccccacaccgacacgaccctctcgtacacgattctcaggatgaaaaaaacccagagcaaagactagcacaacacaaagaggaaaaggataaaggaaaaaaaggatagaagggaacacccatacacagaggacccaaaaagaagaaatagcaacgcagaaccgaagacagcacatcacaaaaccacacaagagaagagacaagagatagacacgtgagcggagaaccccagaaaacgaatggagagagagacaacaaagaacacgcagacacatccacatag

SEQ ID NO: 639243 - DNA, 325 bp, Homo sapiens
tgaattactagtatcccctccccatgaaaaatggcttcctggccgggcgtggtggctcctgcctgtaatcccagcactttgggaggccgaggtgggcggatcacctgaggtcgggagtttgagaccagcctgaccaacatggagaaacccagtctctactgaaaatacagaaaagttagccaggcgtggtggcacatgcctgtaatcccagctgctcaggaggctgaggcaggagaattgcttgaacccaaaaggcggaggttgtggtgagccgagattgcacctttgtactccagcctgggcaacgagcaaaaaactctgtctc

SEQ ID NO: 639244 - DNA, 1153 bp, Homo sapiens
  misc_feature (390)..(390): n is a, c, g, or t
  misc_feature (492)..(492): n is a, c, g, or t
  misc_feature (528)..(528): n is a, c, g, or t
  misc_feature (592)..(592): n is a, c, g, or t
cctttgagaacctcataagcaacatgactttcatgctgcctttccagttcttcaaccctctgcctcctgcactgatagggtcattgcccgaacaatatatgttggagcagggtcatgaccaaagtcaggaccccaaacaggaagtccatgggcccttccctgacagcagcttcttaacttccagttccacaccatttcaggttgaaaaagatcagtgtttaaactgtccggatgctattactaaaaaagaagacagcacccatttaagtgactccagctcatacaacattgtcactaagtttgaaaggacacagttatcccctgaggccaaagtgaagcctgagaggaatagccttggtacaaagaagggccgggtgttctgcactgcangtgagaagaccttctatgacaaaggcaccctcaaaatccactacaatgccgtccacttgaagatcaagcataagtgcaccatcgaagggtgtaacatggtgntcagctccctaaggagccggaatcgccatagcgccnaccccaaccctcggctgcacatgccatgaacagaaataaccgggacaaagacctcaggaacagnctgaacctggccagctctgagaactacaagtgcccaggttcacagtgacgtccccagactgtaggcctcctcccagctaccctggttcaggagaggattccaaaggccaaccagccttcccaaacattgggcaaaatggtgtgctttttcccaacctaaagacagtccagccagtccttcctttctaccgcagtccagccacgccctgcccgaggtagcaaacacgcctgggatactcccttccctcccgctgttgtcctcttcaatcccagaacagctcatttcaaacgaaatgccatttgatgcccttcccaagaagaaatccaggaagtccagtatgcctatcaaaatagagaaagaagctgtggaaatagctaatgagaaaagacacaacctcagctcagatgaagacatgcccctacaggtggtcagtgaagatgagcaggaggcctgcagtcctcagtcacacagagtatctgaggagcagcatgtacagtcaggaggcttagggaagcctttccctgaaggggagaggccctgccatcgtgaatcagtaattga

SEQ ID NO: 639245 - DNA, 933 bp, Homo sapiens
  misc_feature (335)..(335): n is a, c, g, or t
  misc_feature (343)..(343): n is a, c, g, or t
  misc_feature (353)..(353): n is a, c, g, or t
  misc_feature (358)..(358): n is a, c, g, or t
  misc_feature (383)..(383): n is a, c, g, or t
  misc_feature (386)..(386): n is a, c, g, or t
  misc_feature (415)..(415): n is a, c, g, or t
  misc_feature (431)..(431): n is a, c, g, or t
  misc_feature (451)..(451): n is a, c, g, or t
caggtgataagtggtgttcaggtggaaaaggagggagctactctaaggctgagtggagcgacagtgcccaggggtctgagtctcacagcttgtaaagcctgagacagctgcctcgtgtgcgactgagatgcacagctgccttgtgtgcgctcctggaccgcggtggacacggcggctcagatctccgagcaaaagtcaatgatgcctctgaggcggagcaccagagagcctacctggaagacacacttgcgtggagtggctcccacaaatacctggagaaggggaaggagacgctgcttcacctggagcccccaaagacacacgtgactcaccancccatctntgaccatgangccancctgaggtgctgggccctgggcttntancctgcggagatcacactgacctggcagcnggatggagggccatanccaggcacgagctcgtgganaccaggcctgcaggggatgtgcaccttccagaagtgggctagactgtggtggtgccttctggagaggagcatagatacacgtgccaagtgcagccatgaggggctacccgatgcccggtcgaacctgaagatggaaagccggtccgttacccaggcgcatggcatcacccatcgtgggcatcattgtgtggacctggttctccttggaatctgtggtctctggaagctgtggttcgctgctgtgatatggacggaagaaagaactcatcgcggaccccggaggcatgccactctaacggctcgactggagcgacagtgcccacgggggtctagacatctcaccagcgttggtaaaagccttgagacaggctgccttgtgtgccgacttggagatgcccaggctgcccttgtgttgccaatttgaatgcgggatttccctcacgcttccctatgtgtttaggggacccggcgccctcttcgcc

SEQ ID NO: 639246 - DNA, 597 bp, Homo sapiens
ctttttactgggcagcatagagatgctaccctgtattcttcttgcaatgaaatagcagtaaataaaagattttatttctctttttgaactcaaaacatcagtaaattaaagatgaaaatcatgtttattgattcatagtggtggcaaaagagttggtgagcattgttcagcttttgaattaaatattatttttttaattcacagacaatagttgaacttgcagagacaggaagtctggacctcagtatattctgcagtacctgtttggtagtattttcttctttgttcttaccctcccttctcttcctcctgacagtggcatagcatagcgggtatggggtgtggggaaaaggaataattattttcaatgaacacattccctgcttcttgggctataaagaaggaaagcatgggttaacaggactgttctgcttcccaaggcgcttattcctcgatggtaggccttgactgtacttttgattcggaggtgccgtttatttgtattcattctctttctcttttctcgcttaaaatgttaataaattaaaaactaagtaataaagtatttcagatcaaaagatttataaatgattcccc

SEQ ID NO: 639247 - DNA, 190 bp, Homo sapiens
cgtccgaagtgcggtacgttgaggttgataactgttacgttgactccttcggcttaatgatctcatgaaggccaggcgtggtgactcatgcctgtaatcccagcattttgggaggccgaggcgggcggatcacctgaggtcaggagttcttctcccctaatttgcttaccccaacggtgaccggcgactt

SEQ ID NO: 639248 - DNA, 1416 bp, Homo sapiens
gtgtgagtatgcgtgtgtgtgatcgtatgcaatgtgctgtgatcatatgcgctgtggtgtgatcactatgtgcatatgcatgtgagcaggcaagtgtgtgacgctggacgttgctgagcagcgtgctgtcagcactgtgtgagcacagcatcatagctatatgcagctgtgtgctgcagcgatgctgctgcaggcagcaggcgataatgcgacgagtgcagacgggctgctgctgccagtgctgctgcagccaaggcctgctggtacaatggcattgcaagcaagcggtgctgcagccagagctgatgctgcgcatgctggagccactagcgagtcgcagcagctgctagctgtgcagacgctgctactggcacttatgccatatcctgcacggctgcggcagccagctgctagatggcaggcgctggctggtctgccagccggctagcttgcttgatcgcgagcctaggcagtcttgcctatcactcgccagcctgcggcacagcgttgctgccgctttgccgccaacaccacacgcatgcctgccaagccgcaacgctgctgcgcccgctcgtcacgcaccacggtagaccattcactgccccgttcactgcacgcttcgctaccgtaggcaagaccacctgtgaacacacaggccacggggcggacagccaccaccagcacgacccaggacagggtacgaaccggccacggggggccatgcgcacgacacgaaaccacacaccagaacacatggcacagaacagcgaccacacacgccacacgcccgtccgcccaaagaccaacgaccgagcccgaaccacacacccctcagacaagacgcacacacgcgcagcggccggacggccccgcccaagcgacgaccacgcccgagctcacccacagaaaacaaccgccagcgcgggacgcgggccacgcggccgcgcccgccgcacccttgcatcatcccgccagcacgaccgaccagccggcggcccccacgcacagagagaacgaccacaaggagcggccggcagatcagataaccccgagcagccaccgtcgagcacacacccaacgctcgaacgcagaagccacacccagccaccctgtccacaaatctacagaaccagaaccgaccacagcccgacgcaccgctacacgccgggctgacaggccgacggtttctagcctgcagccaccctgcggcggcaaccgcgcggccgtcctaccgcgcggcgctccaccaccagtgagcgccgggcacacgcacacgagcagacaagcggacgtggtgcactgacggcacggacacaggccagtacaaaagggatgcgccgcgagacaacagtgacgagcgcgggcgagtgggcaggccggagaggagccatgcgaggggggcgacgaggagcaggc

SEQ ID NO: 639249 - DNA, 199 bp, Homo sapiens
ccctccccagttacgacgtaccagtagactaagcaaaatttagactggagaagcacattttaaaaaattgaataacttaaaagtctccagttattaatttttatttattgctaactcaattggaagtaagactatgaaatatttcagtgatgttaccaaattccacaggatctactaggatacattcgatctactagga

SEQ ID NO: 639250 - DNA, 358 bp, Homo sapiens
atttgtcctaatgctctccttccccttggccccctgtcaggtcctggtgtgtgtgttgtttggccccccccgtgtccatgtgttcctattgttcatctcccatttatgagtgagaatatgtggtgtttggctttctcttcctgtgttagtttgctgaggatgatggtttccagcttcatccatgtccctgcagaggacatgatctcatccttttcatggctgcatagtattccgtgttgtgtatataccacattttctttatccagtctttcattggtggacatttgggttggtttcatgtctttgctattgtaaatagtgctgcaataaacattatgtgtgcatgtgaaaaaaaaaa

SEQ ID NO: 639251 - DNA, 793 bp, Homo sapiens
  misc_feature (33)..(33): n is a, c, g, or t
  misc_feature (68)..(68): n is a, c, g, or t
  misc_feature (77)..(77): n is a, c, g, or t
  misc_feature (96)..(96): n is a, c, g, or t
  misc_feature (110)..(110): n is a, c, g, or t
  misc_feature (122)..(122): n is a, c, g, or t
  misc_feature (138)..(138): n is a, c, g, or t
  misc_feature (140)..(140): n is a, c, g, or t
  misc_feature (186)..(186): n is a, c, g, or t
  misc_feature (205)..(205): n is a, c, g, or t
  misc_feature (242)..(242): n is a, c, g, or t
  misc_feature (257)..(257): n is a, c, g, or t
  misc_feature (280)..(280): n is a, c, g, or t
  misc_feature (287)..(287): n is a, c, g, or t
  misc_feature (290)..(290): n is a, c, g, or t
  misc_feature (305)..(305): n is a, c, g, or t
  misc_feature (308)..(308): n is a, c, g, or t
  misc_feature (310)..(310): n is a, c, g, or t
  misc_feature (312)..(312): n is a, c, g, or t
  misc_feature (334)..(334): n is a, c, g, or t
  misc_feature (356)..(356): n is a, c, g, or t
  misc_feature (363)..(363): n is a, c, g, or t
  misc_feature (381)..(381): n is a, c, g, or t
  misc_feature (408)..(408): n is a, c, g, or t
  misc_feature (419)..(419): n is a, c, g, or t
  misc_feature (422)..(422): n is a, c, g, or t
  misc_feature (429)..(429): n is a, c, g, or t
  misc_feature (569)..(569): n is a, c, g, or t
  misc_feature (629)..(629): n is a, c, g, or t
  misc_feature (683)..(683): n is a, c, g, or t
  misc_feature (688)..(688): n is a, c, g, or t
  misc_feature (717)..(717): n is a, c, g, or t
  misc_feature (727)..(727): n is a, c, g, or t
  misc_feature (784)..(784): n is a, c, g, or t
tcagaaacacacagctttatattattacaaaanagaaaaacacctcaccttgtctttgtttcgcagcncagacaganatcattttaagacagaggntcacataggcagtngtacacccagcngacaaacactttgggncngggtttcctcccccaaccacattacatcagctttgacacatctgtnaaacatcttctctgcgganagtcagaccctaaaggtcaaacccaggggggcacccnctccccaggccagcnactctaactcataaccctctgangacactnggnaaaggcaacacagcnggngngngcggtgctgcctcagcagtggngggctctggccccgccaaggcnggggggnctagggccgggcttctgngaagccatccagataggcaaggggganggggggggggngcngtggggntaaaagaacctgatgaaatgggagaaagcattaccttgggggttaccattttgaattattatataatcagactctagcctggcatcacggagactccaagagccacgggcaatgggaaagaagtgtacttcttgaatgcnattcaaagttatctgaacttttttcactgtttctagattccactttgcttgggaaactanaagaacttctttaatcagccatggccttccaaaaagtagagtgatgtggcaggnaaganagggacaagcaggcccacctggtaaaggntggctctganattagaacctgttggctgccctctccactgccagggaaggaagctggccatgcaggngaagaaagg

SEQ ID NO: 639252 - DNA, 1390 bp, Homo sapiens
  misc_feature (566)..(566): n is a, c, g, or t
ggtcgggcggcggctccagacgtgtgccgctatgggagttccggcgtttttccgatggctcagacggcaagtaccacgtcctatcatagtcaacatgcgttggaacgagaagctgacatagaattgcaaatggtgtaagacgagttccgacgattgcaatgcgcaggtaaaacacttaactgcgaagactgcaatggtggcacggttctgagtacaattctgatattatgcgaatactgtacaatggacactcgagtacacaatcctcgcgtcgataccttcattgctcatcgcaatgtggacacacccgacgtctaccccagaaatacaagttggagaaggaatcggataagtagcagtcgaggtattggcaactatatgttcgtacggtaaactagtatgagctaggactctgtttcaagataatttgttaatgaacactgagacagcacaatgcacctgtcagtctatcacaaatggcggcgacacgtcacggcaaattggcgaaagcgtagagcttgactcacacgcggatcgcggtcacacaccaagtggcacacacgcangccacagcccggttcctcacaccgcgccacgcggtctccatcggggaccagtcgcaccacaagagcacacggggaaagtggcacagcacgagaccaagcgttcgaacggagaagcccatggcagacagttttcccgggtgccatacgcgacgacactcaatttcggacgagagaccaggggttggaggccattcttggctttgcaacgtcgccgagggaagacgctatggacttaaacaaagcggagacagaggcactcctcttgcactccaaagcaaactccctgggtaacattgaaccaatccacaaccgggcacacatccttcggcatcagtgtccaatggggggagcctagacatcggtatggacatccaatactcgtggcgttttgcgtcgtgaatcttcaccacttagcgccttcgaattcccggtctacaagagattgcgcatggacccccttggggggcttgcggcacaacgccattctttgagccagggtaattaattcggaatgcctttgaattggccttacggtcggcattccgctaggctcgccaacgggaacgagctgacttcgaacatctcactgggcactttaccagtctcaggcagcgcgcaacactggcaggccgcatcgcccttgaggccagtgaaccccaaagaggtagcgtcaaatccatttgccttccatcgtcgcggagccacagaatgtgcctggagatcctgtcaatgcagtgtccttggacactggtccctcaccacgcgtaacacccgagaaattttacgcccatcgaagtcacgacacgaaggtacatacatagagc

SEQ ID NO: 639253 - DNA, 482 bp, Homo sapiens
  misc_feature (446)..(446): n is a, c, g, or t
cggagctggtggcttacacctgtatcccagcgctttgggaggccgaggcaggtggatcacctgaggtcaggagttcaagaccagagtggccaacatggtgaaaccctacctctactaaaagtacaaaaattagccgagtatgatgacgcgcgcctgttatcatagctactggtaaggctgaggcaagagaattgcttgaacccaggtggagtttgcagtgagctgagattgtgctattgcactctagcctgggagacaagagcaaaattacatctcaaaaatgaattgcaaaggggtatggatagtagaaaaatggttctcaaagtaatgggacatggaatccaagtttggaccgggtaggaagtgagggaagggtggaaggagagaaaataggtttgaattggctagaacacatcatctctatgatgaaatcagaaatctaaatnataaattggaagcctgagtaaatcttaactggaaac

SEQ ID NO: 639254 - DNA, 442 bp, Homo sapiens
  misc_feature (366)..(366): n is a, c, g, or t
  misc_feature (380)..(380): n is a, c, g, or t
aataatcttgtttacctctccttcagacgctccaggggccctctgtagcatccaaaagttaggggtcaggaaagacaaccttgaaactcaagtttgattttgggaagactgttaaatatgttagaggttcaaagcacttgatattgtgaagtagaattccagattactgtaagtcattttatttagtcaaaatgatgactcaataattttttaaaagacaaaaaccattcattattgtttactatttttcttaaagagcaaagtcagtgccttaattaaaaccttgttgtgcttttatttcaatgctcaatttatggaaaatccatatgatacctttttgagggttagttcaatatgttcacacancagagttttctttnttgcaagatttccaccttttttaaaaccttcacattatcttttttttttttttttttttttt

SEQ ID NO: 639255 - DNA, 162 bp, Homo sapiens
tgctgttgcgtgcgttgtactggtcggctgtggaaggtggtggatacttcactgacgcctgagcttgtcgtgctggcaggtgagagtgttgtggctggtgatctaggggctactgtggaacagtggtcgatttctcactgacggcctggcagatgtggtact

SEQ ID NO: 639256 - DNA, 192 bp, Homo sapiens
atactcgctcgtgtccggggggatggtccaggaccccgcaggtacaaaattgtggatgctgataggccttgtagtataaatggcgtagtattgcatatacctgtgcacatcctcctatacaatttaaatcatttctagattacatatcataccttataccatgtagatgctattgaaacttctaaaactagg

SEQ ID NO: 639257 - DNA, 891 bp, Homo sapiens
gcccatgtccctcagctcaaagttgagggatactgattgcctggctttaggtcaagtcatagtgcttccacttgctggatagatcgtatcatgattactgccatacttgaacttggtcccgtgtagagatgtcaggctgtcacagcagatttgctaggctgatccagctccctccttgtcaggagctggttctgatgtgtagccatgggggtagagaaggagctgggagtagcttttgatgcagatgaaggcctggatgttcccgtggctcgtcacaaagtccacgatggacttgacctccacttcagagttgggaaacttgccacggtaagtttctgagcaggggttgctactagctccgggcatcccaaaggcagcatcccagttcctgttgggtccaccccgacgcagagggagccctcggtgtgtgatcgagttttgcgccacatgcgattcgttttgtgggtgtagacaaaaccatcagggttagttacaatctccaggaagatgtccatgttgtcaagaatggccgtgagggtgggttcctggccatagtccttcgtgatcttttttgcaaaccagaccccactggcctgagtgacccactccctggaatggatgccagtgtcaatccagattgctgggcgattggtccctccagtgctgaacttcagcacattgatgggacgaccttcaaaggtgctgccgatctggatcttgcttacaagctgtgggtgctctgtaaccagcaggtccatgaattcatagatctcatccagagtatggtaggtggcataattgaaagcatcggtggacagagccctggctggaaggcggacatctgctgcttctcctcgtcgagcagagactgcacatcttcgatcatgatct

SEQ ID NO: 639258 - DNA, 973 bp, Homo sapiens
cggtagaagcccaggcaacatggagcttctgaacccttcagcgcaggaacatgtactattgctgtccctacaagtatataaggtgacttctggccatgctgccctgtccattgaggctctgtgtgtcactaggctagggagagcagggctgctgtctgtccactatgctcccctgcccaaaactttcgtggcagagagtgccaaagttgtgtgttggccacggacacggggtcacgtcctgaagggcacaagacacggattcaagggcagtggctccgaaccttgtggtgctcaccatggttggggtccattcaatacctggcaaccctgtgagccctgtctgccggaagccttgaatggatccactcaatcaatgtcttcgtccccgacatactaagactggcgccatgttctgctgtggtgtggtcccattgcaacttcaggaatggtcacaatcagtggggtatacccctcaataaggcactcctttgtcctatacctcctttctcaaaggccatgttaagtcgcccatctcctaccgtgtccctgtgccacacaaagagggttatcctgctcttggccaattctggatggatggtgggccggccccagagtcttgaaggcacactggcgcagaggcacctcgttgaagtggcacgttgtttgccaccctggtgcagtgaagggcctgagggcctctaccatcagaatttattctccctttccgttcactcaatggggccattttccactagtccttatttccccaaataccatcacggttaattaggccccaccaggtgctaatttgtttgcgcccgccaggtgtggggtcctcaccacgccaaaggttgtgctacaacacaagggccactgatgtcgcccccagatggggcatttcgtcgccgccagtaggcatacgccgcgagcagtgtttttccccccaacgtggcgttagggccaccaaacctcc

SEQ ID NO: 639259 - DNA, 344 bp, Homo sapiens
ctagaagagatggtccgtttgactaacgcgtaagtgtttcatgttcacatacaaagcttgagagtaaactaggaaaataaaagtatgaatagtacaatctttcgaatgcgtagttcagaagaatggaatagaggccgggcgcggtggctcaagcctgtcatcccggcactttgggaggccgaggcgggcggatcacaaggtcaggagatcgagaccatcctggccaacatagtgaaaccccgtctctaccagaaatacgaggatattagcggggcgtggtggtgggcgcctatagtcccagctactcgggaggctgaggcaggagaatagcgtgaacccaggag

SEQ ID NO: 639260 - DNA, 546 bp, Homo sapiens
gtgaccacagagcatctcatagagcaagacgcctcatttgccactagtcttactgcatggcccgtacagctatttccatgagatggatctcgtggagctatatagtctggcgtgccacatcaatgtgcccgtcgtgacttggaagacaatcccctccttgcacattccgaagtctgccagtttacagtgaccctcgtggtcccaacaggacattgtccagtttccgatctctatagatgattcctttatcatggaggaacatgagagccgaaatgatttctgcagcatagaagcgagctcgtgcttcatcaaaacggacgagacttctgaatgtggaacatcaaggtcacccccattcacaaactccatcacaaaaaacagacgatcgggggtctgaaagcagcaaaacaactgagtgaggaaggggtgattgcgggccagagacaggatccttttctcggtcatggtgcattccacatcatcatcctgcagaatcacgtccttcttcagcaccttcacagcatagaggtctcctgtttcttttac

SEQ ID NO: 639261 - DNA, 120 bp, Homo sapiens
atcactcaactagatgcaaggttcagtgagccaagattgcaccattgcactccagccgtgagcaataagaggaaaactctgtctcagacaaaacagaacataaaaaccccttatggtgac

SEQ ID NO: 639262 - DNA, 674 bp, Homo sapiens
  misc_feature (17)..(17): n is a, c, g, or t
  misc_feature (24)..(25): n is a, c, g, or t
  misc_feature (28)..(28): n is a, c, g, or t
  misc_feature (76)..(76): n is a, c, g, or t
  misc_feature (122)..(122): n is a, c, g, or t
  misc_feature (136)..(136): n is a, c, g, or t
  misc_feature (177)..(177): n is a, c, g, or t
  misc_feature (186)..(186): n is a, c, g, or t
  misc_feature (346)..(346): n is a, c, g, or t
  misc_feature (396)..(396): n is a, c, g, or t
  misc_feature (401)..(401): n is a, c, g, or t
  misc_feature (493)..(493): n is a, c, g, or t
  misc_feature (503)..(503): n is a, c, g, or t
  misc_feature (505)..(505): n is a, c, g, or t
  misc_feature (512)..(512): n is a, c, g, or t
  misc_feature (537)..(537): n is a, c, g, or t
  misc_feature (590)..(590): n is a, c, g, or t
  misc_feature (592)..(592): n is a, c, g, or t
  misc_feature (656)..(656): n is a, c, g, or t
gcagcttcagcagaggnaagcaanngancagcgagaagccacagagacaattcatgagtacaacttgcaggtggcngaagaagagagatgaagaaagcacagtaattaaatcccagcagaanaggaagatcaatcncctggcatgatatacttaacaatctgagatcaaaatatgcnaagcaaatnaagcagtttcagcgaggagaaccagtctctaagcctccggcacctacacaacagtcttagtgcatgctaattcaaggacgctacagaaagcgcgatgaggcattttgctcattatctcgcatgatgagaagatgtatacgcggagagtgtatgagctgangaatgaagaggaggcgaaggcacctaatagccagagcctttgcatgtggncaggntcatccacacccatcatctggggcttccctgggcagcacctgatttctggttcctgaacaatgttgggcctatttctcagtatcccaaaaantccgccaaananatagtanaagaaatgcttatgcgctcagacanaggaggaggcagaagaggccgccgcggaaccagagtcctagcgtggatttggngnagcaaatttctgaaaaaacataccaagatgatcactgtatgctcctgtgatgtacgagatcggnggttcctcgatagagagc

SEQ ID NO: 639263 - DNA, 109 bp, Homo sapiens
gctctctctctctctctctctctctctctctctctctgtctctctcggctctctctctctccatccgttttgccccccccggtagtacccccaagttgattttccccca

SEQ ID NO: 639264 - DNA, 301 bp, Homo sapiens
tatgtcagtgtaaacagggtcagcagccctctctatgtcagtgtaaacagggtcagcagccctctctatgtcagtgtaaacagggtcagcagccctctctatgtcagtgtaaacagggtcagccgccctctctatgtcagtgtaaacagggtcagcagccctctctatgtcagtgtaaacaggatcagcagccctctctatgtcagtgtaaacagggtcagcagccctctctatgtcagtgtaaacagggtcagcatgctgaagagggaaactacagtctcatcaaataggaggtcgacgc

SEQ ID NO: 639265 - DNA, 110 bp, Homo sapiens
ttactaggagttagcaaaaggaactgtggccttccagccgtagcctacgtaatacctgtcttatttggaatggggattgtccagcaaagcggagcatacatgtaattagc

SEQ ID NO: 639266 - DNA, 287 bp, Homo sapiens
tactaaattcgcggccgcgtcgacccgggcagcacaggaggagggacacacagcatgcattctgggtttcaaatgggcaaatgagttgcagaggatgaccaagaggaagagggaaataatgtgaggtgctggtaagagaggaattgaattaactactaaagaggagaaggaaagaaaagggaagaaaaaagtcagaagccgggtgaagactggaagaactgaaatgggtcccaggatgaaaggctgaagagcaggttttgcaagaatgaggagattttggagacaga

SEQ ID NO: 639267 - DNA, 260 bp, Homo sapiens
tcctggctacgtgtgaactcatgaaggctgaggcgagagaacacttgaacccaggaaatttgaggttatagtgagctatgatcgtgcctttgctttccaacctgggcaacagagcatgaccctggctcaaaaaacaacaacaacaacaaagacttgttgctttctaaaaccaatgaaatttgatctctagtgatagaaaagaatgtataacaactctgaaattatcacaagtgggtgagttaagttgcccgccaatcgaa

SEQ ID NO: 639268 - DNA, 200 bp, Homo sapiens
tcaagcttctaacgatgtacggggacatggtgaaaactcatctctactaaaaaaacaaaaattatgtgggttggtggtgtgcgcctgtaatcccagctacttgggaggctgaggcaggagaatcacttaaacctgggaggcagaggctgcaacgagccgaaattgcccactgcactccagcctgactccgtcccaaaaaa

SEQ ID NO: 639269 - DNA, 540 bp, Homo sapiens
ggaagagaaaagaaaaaaaagagcccatcgcatagcagaagcaaaaagagagggagttagagaaaccggcagaaagaaaaaggggggaaataggaaaaagagaagaaaaaaaggaaaagaaggggagaaaaagaaagggaaaaggagagaaagagagagaagaagaaaaaagagagaaaaggaaaaaaagaaagaaagagaagaggaaggaaaaaaaaaaaagaagaaaagagagaaaaagagaaaaaaaaaaaagaagaaagagaaggaggaaaagaaagaaaggaaaaaaagaaaggaagaaagaagagaaagaagaagaaaagaaagaaaaaagaaggaaaaaagagaaaagagaagagaaaaagaaagaagaagaagaaggaaagtagaggaagagaagaaaaagaaaagagagaaagaagaagaagaaaaagaaaaagggaaaggagaaaagaaaagaaaaagagaagaagagagaaaaaaagagaaaaaaaagaaagaaaggggaaaatagagaggaggaaaggggggcggggg

SEQ ID NO: 639270 - DNA, 552 bp, Homo sapiens
gggggggtttttttctctccgcctcctgtctgccccctctctctgtggtttgtctcttctctcgcgcgcgcgcgcgcgcgcgctcgcgctcgaccacactcacccccccccccctccctcacacaagacgcgctctctctctctgtcagacacgcactcactctcaccccacaccccacacacgcggtgtgcgccacccacagcgcgagacacacaccccgctcggccgtcctctctctcttttgtttcaccccaccgctgtcgtgcccctctctctggggccctcccccgtcggggctctgtttttcccccgcgttgttttttgtcgcccccccccccagcaagagtatttccttttcctccccccgcgcgggctcaccatgtggggctcccttcgcccacctctcttttgagagagccctcttttctgtgccctcccccccccccccccccgctcttttttttgtttgttcccccggccgctgccgacgaggaggggccccccccctttttttttttcccggggaaaaaaaccccccaggaggggcacga

SEQ ID NO: 639271 - DNA, 439 bp, Homo sapiens
ttgcccatttctttgttattttcccaaaaaggaatgaaagatcgtgttttaattttttactccccaagctgtagacaggtcctttcgagtgggacatattttcttggcctttataatcttttaccaggtgtcttacagagaaaagacataagccaaagcctatgaggaatatttgcaagccatagaatagtgttggaaaatgtgcaatatgtgatgtggcaaatctctattaggaaatattctgtaatcctcagccctagaataatactagtcttataataggtttgtgcctttcctaaaccaattttattacgggcaaaacttcaaaacttcatttaaaatatttttatgggcaataaaagggatttgtttgtattttgggttcaggccaattataagcggtttttaaatatgtgaaataaaagtagaataaccccca

SEQ ID NO: 639272 - DNA, 314 bp, Homo sapiens
gaccgcaatggtctgtcggttgtagggaagggctagaactcccggggcctaccctgaataacctttttcttagacagggtcttgctctgtcgccgcaggctggagtgaagagctgcaatcatagctcactgcagccttgacctcccgggatcaaacgatccccccagctcggcctcccaagtcgcctggctaattttattcatttattcatttgtttgagacggagtctcgctctatcgcccaggctgaagtgcagtggcgccatctcggttcactgcaacctcggcctccggtgtacaagcgatctccctgac

SEQ ID NO: 639273 - DNA, 186 bp, Homo sapiens
ggggggtccccccccccctctttgggtccttggggccccccccttccgtttgtttcccccctcccggggggtaaatcggccttttggggggccaccctgggttcgccctatgccttttttccccccccggtttccgtcccccgccggtttcacccgtttttttttttcaagttttttggttgtccc

SEQ ID NO: 639274 - DNA, 334 bp, Homo sapiens
  misc_feature (304)..(304): n is a, c, g, or t
  misc_feature (325)..(325): n is a, c, g, or t
cataggtgggagttgaacaatgagatcacttggacacaaggaggggaacatcacacaccggggcctggcaggggtggaaggctgggggagggatagcattaggagaaatacctaatgtaaatgatgagttgataggtgcagcaaacaaacatggcacatatatacctatgtaacaaacctgcacattgtgcacatgtaccatggaacttaaagtataataataataaataaattaaaaaaaataacattaatctccttctacatctctaccagaactcttgtgtgaccatgcatgctttgtcgntaaacagtaacattttgaagngattttttt

SEQ ID NO: 639275 - DNA, 724 bp, Homo sapiens
tgtcctaattgagatctctgcctaaggcagaatatcagtacgactagggctacttagttggtcattacctacttgccactacgtacttgctcataactattggtacttacgtttaactgtctacgtttgataaattctcataactctggctacgttcttgctatgtacttttataactgtttatcatgtgcagtaaagttgtaaacctcagtatctatggaaattgataaatgttgactctggtgtagtatactttttatcgcactttctcttatgacttagcacacactgtctgcatgattacattgttactcttcctttggtaacttgtagcatgttcagaatacgtgtattgctatatagggtcgccaagattcgaatcatgaagaagcccgagtgttgtgtagtattactagtcttctacagcaaatcgtgtcgccggtggatagcatgccagtaagaactcggggctgtgatactaaacgtcctgtagcactgtcacagattgttgtaccagacgaatgttctgtaactgttataaatgtgtatcatgaaacatgtagaatacttttaagaatgtgacataaaatgacgtgtatttgttttaccttgtgtgtgatgagtctagtcatatgcacgtaaatataattgattatgtattctgtagtataatcatacattgatgactacatttaactggtaagtcaaatccgttggatgttaa

SEQ ID NO: 639276 - DNA, 819 bp, Homo sapiens
  misc_feature (3)..(4): n is a, c, g, or t
canncctccatgatatgtgaataataacaccaaagcaagaaccattaatatctcctacgtcccggatctaactccctttgctacttgtgttcaatttttaaggcttttgcgttaaatttccctgctataaatcaatccgggtggcctccgtactttcctaaaaagctcacaaccgaatttccttgacacaaagtcttagaaagaaaaaggggccatctggcatcccctcccccccttggtttgtaacaacgccgcaatacctgcgtctgagagcaaaaccaattcttgcccgccaaaagtcccctcgctgactcttacaaaacgggggatccacataagggaccaccccccgtttcgcccccccaaccaatgtgtatttattacatcccccgtagtaggttatttacacttcacaaccattaatacccttctttagtaccccttccataatcctgcccatgtttcacccgctgtaccccccttcacaataggtacttcggcattccggtatatagcaccaataagtctctttcccgggagtgacccaacccatcttggattctgctccccttgtgggacaatgccgcacttccactactctgctgatcctccatatgagaaccagcatgtagtttgttcaagcccaggcacctgatttattaagcactgcgggattccccgccccctctttcaagaatgtgttaaatgggtattaattttagacaaaaagccccctatttctgagaaacataaaattatggggaacaaagaatttccttcattggacaaaaaaaagaacccctttcaaaccacaaaaca

SEQ ID NO: 639277 - DNA, 1821 bp, Homo sapiens
  misc_feature (20)..(20): n is a, c, g, or t
tttggtgcttgcggcgattntcgtccaagtcccacgtgtctcggtcctgtattctttctataattaatggggcgtttctcccctcaccacgtcgtcttcgtcttgagagcggaatatatgtctgtctcctacatgtagtggttgttctccacccatccactccacgtgcgtgtgctccccccccctcctgtgcgtggtcttcttcgttattcttctctcctgtgggttgtgttgggccccccctctcctccttcgttttgttgtctccacgcggtgttcgtacacccgcccccggtgggggttggtgttgtctccccccccaggtggtctgtgtgtgggtcacaataatttgtttttgttcacccacgcgctggtgtttttgtttccgccaccgtcgggggggtgccctctcggttgcgtagttttatattagttgtatgcgccgtgcgtgttgttgccccgccaccacctctgggcgggggtgtcccccatatattttctccctcccccccgccccatctgtcggggtagtatgtgcttcctctcctccactcgaaccccccgggcgtcgttctagttttattagcacgcctcgttttgtttgttctcgcccccccccccccgtgcgggggtgtagttgtccctctctccctcctccgcttttctgtttgcttccactccctagctgtggtagtaacctttctgctggtgctggtgtttgtttgcttttctcctcctgctctcttcgtctccacgaaagagacaaccagcatgtgtttttgtttcttgcgtggggggtcgcacccgcatattgtgatgatgtcttctcttttggggggtgtgctcctccccccccccccgcgcgagtataggatcaaccccacatctgctgtgggtgtggtagtaccacgccgctgattcttcttctctccccccgcggcgttgttcttctctgtggtagtagtggagtccccccacccctcctctctcttcttgtgttgttgctctctgcgttggctacttcctcattatttggtcgccccctacctctctgttgttctccctccccgccgcccctcctgtgtgtgttgctcctcctctcgctgtcgcgtcttcacacacctactctcttctacatcacactcctcctggtggtgtgttgtgtttgcggcgtctctctctcccgcacagcatcagtgtcgttcaccccatcttatggtgacgtcgcgcgcgcgcgcctcttcactcactcaccactcacgtctctccccgccggcgttttttttgtgattctcttccccccccctgtgtgtcttctcctctcacacgagagagagagtgtggtacacccccctactacagagttgtgcgcgcgcgtcacacacacccgacactattatttttggcgcgacactatatttgtgcgcgcgccctctcataatatatattttgtgtgtgcgcgcgcgccgccctctctttatccccccttctttttttgtgtgtgatgaatatatttcaccctgcggggcgcgccttctccactggtggtgtttctcccacacagagcgcgccctcgccggttgtgtgtgagtgtggtaccaccacacacagagaggtggtcgttctctcttcttctgtgtgtgtgtgttgtgtgagcaccactccccctctctctcgtttatattcttctctcctctctcttcgggggtttctccccaccctccccccccccccctctccgcccccacaaagcaaacaacccacacatattttttttttttctttttttaaaaaaataataaatctctctctctcccccta

SEQ ID NO: 639278 - DNA, 112 bp, Homo sapiens
  misc_feature (19)..(19): n is a, c, g, or t
  misc_feature (97)..(97): n is a, c, g, or t
  misc_feature (110)..(110): n is a, c, g, or t
gagagctacctgattctcngaattcgtgggtcctagagtcatagctagtaacctagtagtgaaattagttatcttttctcacaattccacagggggncacccgagccagnga

SEQ ID NO: 639279 - DNA, 654 bp, Homo sapiens
  misc_feature (237)..(237): n is a, c, g, or t
cagtggtgtttcgccctttacgtcaattgttagttgtcttgcttcagaaagccggactgacgtgttaggcgccatgtctcccatgggtgcccgttgagttttagtccattgtgtttgtgaacccagcgcgtttgtgtacagagggttgcccatgttgttagtacgcaagaaggttgctcagtttgggatgttgtggacttctcccgcccagttttgtagttgtcctgcagggtatanacagacgtcggagatactcttttattagaaaggggttcgcttaatattcttggttcctttctcgtggagagccctttctagagtttctcctgtagatgaagtggtgagtagaatatgtatcgacactagtggtacctttattgtagagaacagtgcttcccctgtcacttcgtagatgatgcttctcggactcgtctcttctgtgcctggaaatctagttgttttggtatctactgagcaccacttgccctcgactaggacagtagcaatcattagtacccgggccacccttttaagcaacaagggccaaaatgtttaacagtgccacgagaagaatacactccttttttttcccccttcgttttttttttctataaatggggtaagaccaaaaagaaaaatgcaaaatcaaaaaaa

SEQ ID NO: 639280 - DNA, 136 bp, Homo sapiens
aagaaggctcgggctcagcagacagtgaagtccgtggagaggtgggcccttccccagagagaacatggaaggtttagcactgcagagatgtctgctgtcacccagaatgacacgggaacttaaccaactcatatca

SEQ ID NO: 639281 - DNA, 553 bp, Homo sapiens
gtatatgctgtctcatgtataacttcaatttggctactctgtatacacggtggtttctttctatggttcacagccttgtatttgattataatttaataaatgttgtaataaatacataattaatcaaaatgtagaacatctaaaacagtcttaaaaaatgtttccagaacctaatttagtctatacgtcatctgattactgaaaaatattaatgttttctcagcagcaggaacaatctatctctcatatttgactcaactatactcactgaaaaaccttttctggatgtctggatctttaaaaatgggaagtatcattcctagtaatgactttggtacttcaatgatgatgcatttaaaagtgcagatggtattaccaggcagcaaagagttactgtatatttactttttattattatgaaatagaatataccacaaatagcaatgcttccttagtgtaagatgtgttcttatgatgtacagttgccaaacagttaataattataaattaactaattaaatggtgaaaatttgcatccaatgtgaatatataa

SEQ ID NO: 639282 - DNA, 818 bp, Homo sapiens
cgttcacggcaggatactgcttagcgaggaacagctacagcgtgctgggctctggatttagagagctgagcgcttaagagtgaatttagagattagtcataaatcggccttataagctattggtagaaaaagaaaacggtaactggcccataaatagcaaaggaaggagcattgctgcacttatctggctgctggagaaagatgaacgacgcgtctgtgatccagtgatggagcacgattatccgggaagactacctcgtggaggccatggagatcctggagctgtactgtgaccatgctgctggcttcggtttggccttatccagtctatgaaggagctagattctggtctggctgaatctgtgtctatattgatcttgtggctgctcctcgtatctccagtccaggaacgtgtgcttggggtttggcaacaatcagtagctgatcagctctgtgccaagtatcatgcacaggacatcattggcatagctatggttaggaccaaagcaagattgagaacttgttgaattgacaggcttaaatgcacagagctgatgtagtgtggaatggcccatccaaaaaatcactgggtgggtaatgcagatcccccttgcaatctgcactagttcgcaaacggaaattttactaaacgttaaccgcttaatagaaatcgctttgagcttactagatgtgtccagtaggggaggaaatgccatccttctctggggggtttaggagaaccagggagtcttaatatgccggctcaggattgcaaccagaaatgatcgtggaaggcaaaccgggaactggaacccccg

SEQ ID NO: 639283 - DNA, 90 bp, Homo sapiens
gggttccatgttttccttgttccctcccaagacctaactgggattgcagagttaagtttatattatggaaataaaaactaaataacaata

SEQ ID NO: 639284 - DNA, 129 bp, Homo sapiens
ggcggatgctgcggtggggcttccaggaattctacattcaaggaggggactgggggtcccggatcggcactaatatggcccagctggtgcccagccacgtgaaaggcctgcacttgaacatggctttgg

SEQ ID NO: 639285 - DNA, 723 bp, Homo sapiens
  misc_feature (709)..(709): n is a, c, g, or t
cgtgtgatgcacccttgtggcgagttccctggtccgtagctctgggcgaggatctgcaggctgggagggggcagccaagaagccggagctggcagcatattcagagatccggggccccccctccctctaatcacgagtgcagctggagcttgctcccccccgttcggaacctggacgttcgcttggtgtctggtgcctctgctctgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggccggtgaagggtcagagagacggacacaaggagccggcaggagggcggagcgaggatgtcctttcccgggagacaagtcgggaaagcctggctggactgcctcagccccgcgcgcctcctggactcagggttccctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagccnagtgtgcggccgct

SEQ ID NO: 639286 - DNA, 201 bp, Homo sapiens
  misc_feature (98)..(98): n is a, c, g, or t
  misc_feature (118)..(118): n is a, c, g, or t
  misc_feature (131)..(131): n is a, c, g, or t
  misc_feature (135)..(135): n is a, c, g, or t
  misc_feature (198)..(198): n is a, c, g, or t
tgggccccacgtcaaaggtcaagttaaacgtaggtcaagtcctacgtcggggcccaaacatcctggggtcctggtttgtcaaacaggctgccctaaanccccccccagtccggggggnctgggagcagttncaanacccccccccccccttttgtaaatcttgttcattgtaaatcaaaaacagcgtctttttccctntga

SEQ ID NO: 639287 - DNA, 478 bp, Homo sapiens
  misc_feature (19)..(19): n is a, c, g, or t
  misc_feature (61)..(61): n is a, c, g, or t
  misc_feature (464)..(464): n is a, c, g, or t
cctccaattttcagtgacnccatacccatgcgccagtggctggtggtgctccagatatctntgcctgtcatcctgtggatgaggcctcaagtacctgtcccggaaccacatgcacgaagaaatgagccagaagtgagcgctgggaacagggtggagtctccgggcccgggccggtgaagggtcagagagacggacacaaggagccggcaggagggcggagcgaggatgtcctttcccgggagacaagtcgggaaagcctggctggactgcctcagccccgcgcgcctcctggactcagggttccctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagccnagtgtgcggccgct

SEQ ID NO: 639288 - DNA, 1035 bp, Homo sapiens
  misc_feature (731)..(731): n is a, c, g, or t
  misc_feature (1035)..(1035): n is a, c, g, or t
atcgggactcagagttctagcttaggtttctggtcctgaagctgggacaagctgacatttctgtggcttgtgtgggaatcattgatccacctagaactggtgtgaaggaagctgttacaacactcattgcctcaggagtatcaataaacatgattactggagattcacaggagagtgcagttgcaatcgccaggtcgtctgggatagtattccaataacttcccagtcagtctccggagaaggagatgagatgcacatggctgttcatgccagcttgcacaaataggtaccaaaggttggaggtattttacagagctagcccaagggcacaagcatgaaagaattcattgaagtcgctacagaagaacggtgtcagtggtagccatgacaggagatggcgtagatgatgacagcgtgctctgaaaggctgcagaccctcggagttgctatgggcccagacggtacaggatgtttgccaagaggccgctagacgatgattccataggtgattgattgactttttcaagaccataaattgtctcgcgatcgaagagggtccccgggattttataatcaccatttaaaaaattttcgttagaaaccaggctgagcacggagttatagccagcattaacttgaatctccattgggttacatttattggaacttttccctaaatccatcctccaatggccattggcagaatcttggggggctcaacattacatatntggtgggacccccccagttcagaagccgttgggaggtaacaacccagggggaattagatgtcatttcgtaaaaccttccttcgaatggcaaagaaacgccatttcggccttacaactgggtactcaaacaatcctggttcaccaccaaacactggtggggcgctggtggtctcggcggtgacccagaaaatgtgattcctgcggacaaaagacctccactgtcgggtgaaattccaagacagtcatcacaccccgttgagcctccacagttgtgcggcgacacacgagcatatattattgcgan

SEQ ID NO: 639289 - DNA, 700 bp, Homo sapiens
  misc_feature (686)..(686): n is a, c, g, or t
cgtgtgatgcacccttgtggcgagttccctggtccgtagctctgggcgaggatctgcaggctgggagggggcagccaagaagccggagctggcagcatattcagagatccggggccccccctccctctaatcacgagtgcagctggagcttgctcccccccgttcggaacctggacgttcgcttggtgtctggtgcctctgctctgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggccggtgaagggtcagagagacggacacaaggagccggcaggagggcggagcgaggatgtcctttcccgggagacaagtcgggaaagcctggctggactgcctcagccccgcgcgcctcctggactcagggtcgtcctgagctcgggagatgttcagagtcacactgccgcccggtctgccacgcagaggtccaacttgccacccgcgtccctggtacctgagaccaccgacatcctcaggttcctgaccgtggcgcccttctacccagccnagtgtgcggccgct

SEQ ID NO: 639290 - DNA, 320 bp, Homo sapiens
gacccagagtctgaatggtggcgtattgcttgagctcgggaagtcaaggctgcagtgagctgtgatcacgccactgcactctagcctgaatgacagaccctgtcttccaaaaaaaaaaaaagggaggcttagggctaagggaggcctctgccacttactaccttttggagggaataggccacgatttctaaaggtaagaatctttatctctaactatgggaggtagaaaagggtcttaaaaaacattctaggactctatcctttccttttttccaactgggaattttctggctttctacctcagccttatctactattta

SEQ ID NO: 639291 - DNA, 262 bp, Homo sapiens
acgtgctcctcctccataggactcccaaagtgctgggattacaggatgtgagccaccgcacccactcaaaatttacttttaaatgtatatcatacaataggattacacaattatctagagaatataattatcaacatatttttcaagattgtaatacagttatttatatgcttcttaattaatgatttaaatgaaagacttagcaactagtcaaactgcttcagccccttgacatctgtttccatctgtggaccacaggtaa

SEQ ID NO: 639292 - DNA, 149 bp, Homo sapiens
cgctcttctgtggcttcatcatgctgctgatctgtttcatcctcatcttcttcgcactctgtggacccagatgcttgtcttcctgagagtgattggaggctctccttgccttggctgctgtgttccagatcatctccctggtaacctac

SEQ ID NO: 639293 - DNA, 298 bp, Homo sapiens
tctcacgtgagccaacagtatagattctgaaggcgtttatggcaggagaaacaaaatacgcagggaaagataatctcagtgttaaagacagatgtatgcctggaggccaagacagaaaatgagctgcagagagaacgcagtagcctgctagccagccagtaaagaagtgaggctagttcagcggactcgcgcggcctcgctctttggactcgtcaccctcccctccccctcccgccgccgtcacccaggaaaccggccgcaaacgcgggcggacctgaagctggtttcatggcagcct

SEQ ID NO: 639294 - DNA, 2088 bp, Homo sapiens
tcgagcggccacccgggcaggtctctgggtgaatagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacaccactaaggagaaagaagttgattccttcattcacttcgccattcattcatacttccgtccagaagttgattccttcattcacttcgccattcattcatacttccgtccatccattcagaaaggcatttattaagaatttactcaggcatgatggcccatacttgtaatcccagctattgggaaggatgagatgggaggatggcttgagccagaggtttgagaccgaccagccagggcaacacagtgagaccccttctc

SEQ ID NO: 639295 - DNA, 623 bp, Homo sapiens
cgcggtggctcacgcctgtaatcccagctctcagggaggctaagaggcgggaggatagcttgagcccaggagttcgagacctgcctgggcaatatagcgagaccccgttctccacaaaaaaaaaaaaaaaaaaaaaaaaaaaaaagtgtggggggcgggccggggcccccggaaaagctttctaaaacacaacgggggggggccgggggccccaggggagaaggaagaacgtgggcgcgcaaagcgcgggtccccaaaggagagaacccggggccagagagacaaaggggcggggagattctcccccaataaaaaaagcgcgccgggggggaacccgagagcggtttcttgagaaaatattctcccaagagggcgaggtctaggagagggccattaagggggcgctcttattacaacgaggagaggctcacaaggagagaggcccgagatatatctacaatatatatagcgcccccgggaccggggggggggggaccaaccgagaagttcagagtggagtgtgagagaacacaagagcccaacaaaacgaagacaacaacacgaagcgtagagcaaaaactagcagaccagcatacaacaacaaacacggcaacacagcaagg

SEQ ID NO: 639296 - DNA, 1978 bp, Homo sapiens
tcgagcggccacccgggcaggtctctgggtgaatagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatgttaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacagaagttgattccttcattcacttcgccattcattcatacttccgtccatccattcagaaaggcatttattaagaatttactcaggcatgatggcccatacttgtaatcccagctattgggaaggatgagatgggaggatggcttgagccagaggtttgagaccgaccagccagggcaacacagtgagaccccttctc

SEQ ID NO: 639297 - DNA, 531 bp, Homo sapiens
ctcagggtgctcaggtctggcattcgggggccccgagtgaccctcatactgccctgctgggatggcatgtctaccggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacagaagttgattccttcattcacttcgccattcattcatacttccgtccatccattcagaaaggcatttattaagaatttactcaggcatgatggcccatacttgtaatcccagctattgggaaggatgagatgggaggatggcttgagccagaggtttgagaccgaccagccagggcaacacagtgagaccccttctc

SEQ ID NO: 639298 - DNA, 1388 bp, Homo sapiens
  misc_feature (279)..(280): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (306)..(306): n is a, c, g, or t
  misc_feature (316)..(316): n is a, c, g, or t
  misc_feature (328)..(328): n is a, c, g, or t
  misc_feature (345)..(345): n is a, c, g, or t
  misc_feature (357)..(357): n is a, c, g, or t
  misc_feature (373)..(373): n is a, c, g, or t
  misc_feature (408)..(408): n is a, c, g, or t
  misc_feature (419)..(419): n is a, c, g, or t
  misc_feature (426)..(426): n is a, c, g, or t
  misc_feature (441)..(441): n is a, c, g, or t
  misc_feature (449)..(449): n is a, c, g, or t
  misc_feature (478)..(478): n is a, c, g, or t
gtttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacatttggnngtaaatcnggnaanttggatagactngactgtgttngtgaaaactgancattaaaggtttggatngatcctttcttnccatttaatctctganacgtaaatatgtgaggtgtgctgctgtgcggggtnaacagcttccntcccttnctgtgtagcagtctngaaatgtnctgttaaatcagtaggcttaatgtgttcngggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacaaaaaaaccgagattgataatgattaagaagagtttgctaatacaatgccagtacgg

SEQ ID NO: 639299 - DNA, 786 bp, Homo sapiens
cgcggggttagcgcggggtcagcggaggtcagcgggggtcagcagtcagtggctccgagggcgcggcggacgcagggcaggatgtacacgctgctgtcgggcttgtacaatgtacatgtttcagaaggacgagtactgcatcctgatcctgggccgggacaatgctgggaagacgagcttcctgggagcagtcgaaaacccgattgaacaagaactacaaggggatgagtctactccaagaagtcaccaccaccgtgggcctagagacatcggcactgtggcatgtgggcaaaggctcggctcagtgttctgggacttaggagggcaggaagagctgcagctctattgctgggcacaaggtacttatgcggagtgtcaccggcggtcactctacgctcattgacgtccaccgacgaggcagaggctggcatgagctccaaggcaggcgctcttgacaggctgggtgagccagcgacggcgcatgatgcggctggtccccggtctctggatgcgtggccatacagagcaggactgtggagaccgtgccctctcaagtcccgtgacatcaagcacggccttcagacgactgcgaccagccaagatcggcatggcgagattgccatgagccatggcctgcgtcggcccgtcacaggcaaaggggtgcgcgagggcatcgagtggatggtgaacgtgtgtcgttgcggcaatgtgcaccggccggccgcggcacagggcacatcacggtaggcgcacgcgggctgtctgtccgggacggctggacatcgg

SEQ ID NO: 639300 - DNA, 195 bp, Homo sapiens
tctctatgaaggtatccccgtacgctctctctgcgctgttctccatctgcctctgtgcatctaggtcctttaatgttttaccgggtattctgagcctcacagtgactgttccgggtccagggacgtagagagtgctcgtgttccctgtgcgcggtgtacttcgtcttcccccaaaggattgctcctgcttcccca

SEQ ID NO: 639301 - DNA, 2627 bp, Homo sapiens
  misc_feature (279)..(280): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (306)..(306): n is a, c, g, or t
  misc_feature (316)..(316): n is a, c, g, or t
  misc_feature (328)..(328): n is a, c, g, or t
  misc_feature (345)..(345): n is a, c, g, or t
  misc_feature (357)..(357): n is a, c, g, or t
  misc_feature (373)..(373): n is a, c, g, or t
  misc_feature (408)..(408): n is a, c, g, or t
  misc_feature (419)..(419): n is a, c, g, or t
  misc_feature (426)..(426): n is a, c, g, or t
  misc_feature (441)..(441): n is a, c, g, or t
  misc_feature (449)..(449): n is a, c, g, or t
  misc_feature (478)..(478): n is a, c, g, or t
gtttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacatttggnngtaaatcnggnaanttggatagactngactgtgttngtgaaaactgancattaaaggtttggatngatcctttcttnccatttaatctctganacgtaaatatgtgaggtgtgctgctgtgcggggtnaacagcttccntcccttnctgtgtagcagtctngaaatgtnctgttaaatcagtaggcttaatgtgttcngggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatttcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagtaaaaaaaaaaaaagaaaacaaaaaaaaa

SEQ ID NO: 639302 - DNA, 339 bp, Homo sapiens
agcataccaatctgtactagctaaccagggtaactgggaggtggtggatatgtgaattaccttgcactgtggtaatcattccacagctgcattcacatatcaaatcatcacattgtacaccctaaatatatacaatttttgtcagtcatacctcaaacaagctggggggtagggacgaaaaatcaagtgaatctgttctaaagtttaacaaaaccggccaggtgtggtggctcacacctataaccctaacactttggcaggccaaagcaggcggatcacctgaggtcaggagttcgagatcagcctgacccacatagtgaaaccccatctgtactaaaa

SEQ ID NO: 639303 - DNA, 290 bp, Homo sapiens
ctcacatatatagatgtatagtgattatgtcgtggactcgagtgtagtagtgatgttagagcacgtcttgcatcgacccgcgcgtgtttctggacgacggtttacaaccgactgattgggctttgctcactttttaatgcgatgatggttttttttcactggtgagttgtttattttcagtattagtcttctgttggatgaatagtttgcaaatattttctctcactcaagaggttgtctcttcactctgttgttttctttgcttgctgggcttttttatttttagttta

SEQ ID NO: 639304 - DNA, 89 bp, Homo sapiens
ggcccccctccccccgggggccttgggggaaatttttttttttcccccccccgcccgggggcgttttaccaagggccccccttttttta

SEQ ID NO: 639305 - DNA, 2893 bp, Homo sapiens
  misc_feature (279)..(280): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (306)..(306): n is a, c, g, or t
  misc_feature (316)..(316): n is a, c, g, or t
  misc_feature (328)..(328): n is a, c, g, or t
  misc_feature (345)..(345): n is a, c, g, or t
  misc_feature (357)..(357): n is a, c, g, or t
  misc_feature (373)..(373): n is a, c, g, or t
  misc_feature (408)..(408): n is a, c, g, or t
  misc_feature (419)..(419): n is a, c, g, or t
  misc_feature (426)..(426): n is a, c, g, or t
  misc_feature (441)..(441): n is a, c, g, or t
  misc_feature (449)..(449): n is a, c, g, or t
  misc_feature (478)..(478): n is a, c, g, or t
  misc_feature (2893)..(2893): n is a, c, g, or t
gtttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacatttggnngtaaatcnggnaanttggatagactngactgtgttngtgaaaactgancattaaaggtttggatngatcctttcttnccatttaatctctganacgtaaatatgtgaggtgtgctgctgtgcggggtnaacagcttccntcccttnctgtgtagcagtctngaaatgtnctgttaaatcagtaggcttaatgtgttcngggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatttcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagacacctttgtcttggcgtatgtttggagaagtaaactctcctgaatttactgagtctaaagctctgctcctttgttgttaccatctttaagcatgtgtaagaacagctgttttacctccctgaacaactcactgtggcgttccgttatcagctgtatagaatccctgtgggaatgtgagcaactcagcgcttacagttggtgctggccccgagcatcctggtacatagcagtcgactcgcagccgcgggttcgacaggttctatagtaaaaaaccatggtggtagtacccgaccn

SEQ ID NO: 639306 - DNA, 159 bp, Homo sapiens
cgtgctctgggtataacatcactattgtaaacctaagttcagcgcttgagatattttgcagaccctgcacttgttagatcagctgacaccgcccagaccagtaatctggctcaactagttctgccttccaccccaggagttggaggacagcaggagaac

SEQ ID NO: 639307 - DNA, 2587 bp, Homo sapiens
  misc_feature (279)..(280): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (306)..(306): n is a, c, g, or t
  misc_feature (316)..(316): n is a, c, g, or t
  misc_feature (328)..(328): n is a, c, g, or t
  misc_feature (345)..(345): n is a, c, g, or t
  misc_feature (357)..(357): n is a, c, g, or t
  misc_feature (373)..(373): n is a, c, g, or t
  misc_feature (408)..(408): n is a, c, g, or t
  misc_feature (419)..(419): n is a, c, g, or t
  misc_feature (426)..(426): n is a, c, g, or t
  misc_feature (441)..(441): n is a, c, g, or t
  misc_feature (449)..(449): n is a, c, g, or t
  misc_feature (478)..(478): n is a, c, g, or t
gtttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacatttggnngtaaatcnggnaanttggatagactngactgtgttngtgaaaactgancattaaaggtttggatngatcctttcttnccatttaatctctganacgtaaatatgtgaggtgtgctgctgtgcggggtnaacagcttccntcccttnctgtgtagcagtctngaaatgtnctgttaaatcagtaggcttaatgtgttcngggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccacagttttttctcccagaaatgtaattgccaaacactattcatccccatcttaagttttacaaggtgatgtaatcagcttgttgtagtgatgctggccaaatggtgctcagcaggtgagaacaaaaaaaccccagatttcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagtaaaaaaaaaaaaagaaaacaaaaaaaaa

SEQ ID NO: 639308 - DNA, 751 bp, Homo sapiens
  misc_feature (12)..(14): n is a, c, g, or t
  misc_feature (21)..(22): n is a, c, g, or t
tactactaaatnnncggccgnncgacctttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatttcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagtaaaaaaaaaaaaagaaaacaaaaaaaaa

SEQ ID NO: 639309 - DNA, 2916 bp, Homo sapiens
  misc_feature (279)..(280): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (306)..(306): n is a, c, g, or t
  misc_feature (316)..(316): n is a, c, g, or t
  misc_feature (328)..(328): n is a, c, g, or t
  misc_feature (345)..(345): n is a, c, g, or t
  misc_feature (357)..(357): n is a, c, g, or t
  misc_feature (373)..(373): n is a, c, g, or t
  misc_feature (408)..(408): n is a, c, g, or t
  misc_feature (419)..(419): n is a, c, g, or t
  misc_feature (426)..(426): n is a, c, g, or t
  misc_feature (441)..(441): n is a, c, g, or t
  misc_feature (449)..(449): n is a, c, g, or t
  misc_feature (478)..(478): n is a, c, g, or t
  misc_feature (2916)..(2916): n is a, c, g, or t
gtttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacatttggnngtaaatcnggnaanttggatagactngactgtgttngtgaaaactgancattaaaggtttggatngatcctttcttnccatttaatctctganacgtaaatatgtgaggtgtgctgctgtgcggggtnaacagcttccntcccttnctgtgtagcagtctngaaatgtnctgttaaatcagtaggcttaatgtgttcngggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatttcagtgaactaatacacagcttgagcgtttccatggttgctcacatgggtttaggcaacaaccatattaacctttcaacacaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagacacctttgtcttggcgtatgtttggagaagtaaactctcctgaatttactgagtctaaagctctgctcctttgttgttaccatctttaagcatgtgtaagaacagctgttttacctccctgaacaactcactgtggcgttccgttatcagctgtatagaatccctgtgggaatgtgagcaactcagcgcttacagttggtgctggccccgagcatcctggtacatagcagtcgactcgcagccgcgggttcgacaggttctatagtaaaaaaccatggtggtagtacccgaccn

SEQ ID NO: 639310 - DNA, 321 bp, Homo sapiens
  misc_feature (319)..(319): n is a, c, g, or t
ggcaatccctaaacatgtcttattcatacaagaaatgggtctatatttttccatctagcctaaaaaatgctttagtttgtcacctattaaattaatagtaagtgctatctactggttatcccacccctatataatttttaggtaaagacaattactttatctagtggtattctacttgtattcagaatactgtattaaaattttactatttcatttttgtattctgtgcttattttttttgctcacgcatgtatgcttagtataaatgtgtcacttctaaaaatttgtcacagacttttagaaataaatttcaaaaatntt

SEQ ID NO: 639311 - DNA, 229 bp, Homo sapiens
tctagatgcatgctcgcagcggcgctattgtgcatggcatatctgccagcaattcggcttgcattgtgtgtttgcagctggtgtgggtggctgcgatcggtgggccctgctgctgcacgctgggtgcatcatggccctctgctgatgctggtcttgccgctgtttggggcatatctggtactgctctatatgtcttggcttgattcgctggccattgggcgtacatagg

SEQ ID NO: 639312 - DNA, 2626 bp, Homo sapiens
  misc_feature (279)..(280): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (306)..(306): n is a, c, g, or t
  misc_feature (316)..(316): n is a, c, g, or t
  misc_feature (328)..(328): n is a, c, g, or t
  misc_feature (345)..(345): n is a, c, g, or t
  misc_feature (357)..(357): n is a, c, g, or t
  misc_feature (373)..(373): n is a, c, g, or t
  misc_feature (408)..(408): n is a, c, g, or t
  misc_feature (419)..(419): n is a, c, g, or t
  misc_feature (426)..(426): n is a, c, g, or t
  misc_feature (441)..(441): n is a, c, g, or t
  misc_feature (449)..(449): n is a, c, g, or t
  misc_feature (478)..(478): n is a, c, g, or t
  misc_feature (2626)..(2626): n is a, c, g, or t
gtttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacatttggnngtaaatcnggnaanttggatagactngactgtgttngtgaaaactgancattaaaggtttggatngatcctttcttnccatttaatctctganacgtaaatatgtgaggtgtgctgctgtgcggggtnaacagcttccntcccttnctgtgtagcagtctngaaatgtnctgttaaatcagtaggcttaatgtgttcngggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatttcagtgaactaatacacagcttgagcgtttccatgtgctaatgttgcacacttactaaaaaactttggaaatggaaaataatgtattagtgcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagacacctttgtcttggcgtatgtttggagaagtaaactctcctgaatttactgagtctaaagctctgctcctttgttgttaccatctttaagcatgtgtaagaacagctgttttacctccctgaacaactcactgtggcgttccgttatcagctgtatagaatccctgtgggaatgtgagcaactcagcgcttacagttggtgctggccccgagcatcctggtacatagcagtcgactcgcagccgcgggttcgacaggttctatagtaaaaaaccatggtggtagtacccgaccn

SEQ ID NO: 639313 - DNA, 222 bp, Homo sapiens
cgagctaaagatccccagcagtatacagactcagatgtaactaagtatgtatcatatatgcattgagtatgtaaggacagagtaagatgagcctctgaagacatctcatatactctgggctcccaccgatatcaggttcttaatagtgtctcacgaatttcccagctaattcttacggtctgcatttacacatatttcaccagcataaatggttttactgtt

SEQ ID NO: 639314 - DNA, 442 bp, Homo sapiens
ccctagttgtgtcattacacacactccctactacactacgactactatattaggtcagcccgaaggtctgctggtagacaacactgcaaatcactcagtgatacactacatttgctattctctcatttatacgaggaaaagaaacaagtttccagtttgttttcaacaaaaacaacaaagaaccaaagggatggacaaaaaggcatttatactaatctagggtgaggaatactaagaaacttgcttataataataaaaaaagattacagagattaatgaacaaaaactggttacagttaagaacattatttaacaacagatgaccataccctttgaggaaagctccaacaacctattttaaagaaggtacacttggaataaaaaacaataaaagacttttatgaagtttaaattaaaccctctccttacaaaacaaataatt

SEQ ID NO: 639315 - DNA, 158 bp, Homo sapiens
gatattaaaaatacattctataagccaaaatagaaatttattttgcaaaatgaatggtacaacgtaaaaaatgcagttttattattgcttgtgcctcaactgtttaagtgaatattaaagggcttggagtaaaaaaaaaaaaagaaaacaaaaaaaaa

SEQ ID NO: 639316 - DNA, 390 bp, Homo sapiens
tttcccagtgcatataaaagttatgtttacactatactgtagtctgttaagtgtgtagtagcattatgtctaacaaaaagtacacaccttaaaatactgctgaaaagtgctaatgattatttgaacctttggctagtcaatctttttgctggagtgggtcttgccctgatgttggtgactgctgacttatcagggtggtggttgctgaagatttagtgtattattattattattattattattatttttctagaagcatttcttacttacatagataatttctttaagacaatgggctgggcacagtggctcatgcctgtaatcccagaactttgcgaggccgtgggaggattgcttgagctcaggagttcaagactggcctgggcaact

SEQ ID NO: 639317 - DNA, 271 bp, Homo sapiens
tgtgttgtgggaaatatggagagggagtataccgctgtgactagaatgttttttcctgtaagtaagagagtgatatttgatcaggccaacttggggactagctcatagagttctcccagtaggttaatattggggggtaaggccaggttagcgaggcttgcttcatgtcatcaaaaagctatcattgggatttcagtgtgaagtccttgaaagaggattatgatgcaactgttagtgctttttaactttgagtttgctaggcctactattc

SEQ ID NO: 639318 - DNA, 568 bp, Homo sapiens
  misc_feature (324)..(324): n is a, c, g, or t
ccgattttttctagtccttcatatattgaaaacttgccacatgacattgtatcgtcttcattttccagaagatgcgttggtgtgccataggtttctaacttccttgaaaatagttttttaagtcaattgtaaatatacgtattattgttaaaagtaactttaaactgcaacacatagcttcaaaacaatatagagattttgtaataccttataagtggagttggctaaaataccttatccatataaaacttattctattctttgcatgcttattttgtgtgttggttgctagcttaaagtttgatttgttgttactctttgtgngccaaattcactaggcaagcggatttttcctcagacttcaaaaaataattcttttaagaaaaaatgtaaaaatgtttattctaaaaagctgcattaaagggacaacctataaaaagttttgctagctcatctttagaaggaagaaagaatattagcttgggtgatgtttaatttgggtggcgatagtttctgtaggctaaactttatgagaaaagtgtacctactctataaaggtaataaatgt

SEQ ID NO: 639319 - DNA, 398 bp, Homo sapiens
  misc_feature (102)..(102): n is a, c, g, or t
tctggagtgcagtgacgcgatctcagcttactgcaacctccacctcctgggtttaagccattctgcctcggcctcccgagtagctgggattacgggcgcctnccaccacatctggctaatttttgtatttttagtagagacgggttcgccatgttggccgggctggtctcgaactcctgacctcagaatgtccgcccgcctcggcctgctaaggtgttgggatgacagggtttagccaccacggtgggccactactcagtcatttttaatagttgaatgtttttccccccatcttgtgtttccatgtataaaatagacattttgagtcaaaactgaaggccctgtatatataaacctttgactccctttttgctccccataaccccgctgatatttct

SEQ ID NO: 639320 - DNA, 285 bp, Homo sapiens
  misc_feature (118)..(118): n is a, c, g, or t
tggggccaaaagttgggccaacccctccacccaaagttgccaccaggggagtgcttgggcagaaaaggttcgagtccagggtcccaagtctttggtcccaaaagggacccatggctgnctcacaccaaggcctatggggaaaaattgggagctccccaacttggaccccccccttgtggctttgcaccccaaggagccccctcccagacagaaaggaaaaaaggcaggtgaccagggcttgttagattgtggctccttaataaatgttttttgttatgaagtcta

SEQ ID NO: 639321 - DNA, 464 bp, Homo sapiens
taaccttttcactcaccgtttgccacaccaagaaagaaatggagtgcattctcttgatatttggggtctgccttcccggggccatttctagggtaagagacattccggcggtgacttcagtcttgaagagcacctccttcacccccagctacttagtgaggtctccagtccatttcctaatcttataaggactgggaagcatgggccttgcatctgctgtctgcagctcctagctgtgtgacttcaggtaagtctcttcatctctctgagcctcagtaacttcactatgaaatgcgtattatcttgtagcttttgtgtgagtgctaattggtggaatgtggataagtcttcatccaggagctgacaaagccagccctcactctgttatagctgttatccagcagtggtcagaacagtactgcccatgccatgaattaagcacatagcataatacggagtttgaa

SEQ ID NO: 639322 - DNA, 267 bp, Homo sapiens
catatggacggcagatcgagcagcagtcggaaactggatctgcactgccaaacttttaaaggtgccatttcagtggtgctctctacaagatgcttgctgagttctttcaactgtccctccaggtcggggtgcagatctcttaattttccaaagaggaacccctgaacctcatcaataggatcatttcaccaatcactgtggtgtttacctcagttcctttcacctgagtatcatccttggccttgccataggcaagggtaccgagct

SEQ ID NO: 639323 - DNA, 215 bp, Homo sapiens
tcggccacaccctggtgaggagcatgtcttcccatagaacccacgtggccacaccttgggtgaggagcacgtcttcccacagatctcaacagaactccacatcgtctggttttgtggagactttcatatgtcctgtcaagttgcctcatgcacctgcagactgttcttgggaagcaaacctggactgcaaaataaacctcccggcctcctcctga

SEQ ID NO: 639324 - DNA, 357 bp, Homo sapiens
  misc_feature (30)..(30): n is a, c, g, or t
  misc_feature (32)..(32): n is a, c, g, or t
  misc_feature (119)..(119): n is a, c, g, or t
  misc_feature (328)..(329): n is a, c, g, or t
atggaaatactaaagaatgaaagacacagnanaagaaatcaaaataaaaagccgagatttttatgaaaaagaaaaactccttaggggagaggcgagggaggagctcctgcctccaccanttcaaactcaaattaaaggccatgcctctgctccatactttggaaaggaagaaccctcagtggctcccagcagcactggtaaaacctttcagccaggatcctggatgccacgagatggcaagagggggggggaatgaatgcgatatggtcaaatcttatcatgtatatggatgtgactattttaacaaataaaagaagtgaaaagttannaaaaaaaaagagaaagagagaaaaaagg

SEQ ID NO: 639325 - DNA, 804 bp, Homo sapiens
ggttacctgatgtggcggggacctgtttcatagctagcagaagccgtttaagaaacataacttccccccactggcccagaattgttggcgtacttttgtatgctggaaggtgacccctctatcatgggtattggtccgtgcccgctatcagtgggccactgaagaaacgcaggactgagttcttaaggcacatgggatttggtagaggtgaatgtaagcttttgctccccagtacttggctgttgagaggatttggatctttgacataagtaaacccatgtgaatggaggagcccttgctttgggtcaccccctgggaggatctggatccagaattactgcacacctgggtcacgagattacaggcctcgaggtggaaaatatgcccttggatcagcttgcaatggaggtggcccaggtattgctgtcatccttcagagcaccgcctgaagagacccgtgagctcactgtgacccatccttactctacttggcccaggcccaccagttaaaccagtgaccttcagagcaagctgccaccaactggccatgccctgcccattgaaacccgtgattaagtttgatccagccctggtgaccacccaaaatgccattgatccatgaataggagccccatgctagaagtaccttctctcagatttgaacccgtgaaatatgatgtatttctgagctaaaactccactatagaagaccttcaagaaatcgtattcttgcccagtaacccccacttctgccttagataatatgattataaggaaatccaataaatgttgcctttacttcca

SEQ ID NO: 639326 - DNA, 263 bp, Homo sapiens
  misc_feature (4)..(4): n is a, c, g, or t
tacngaggggagcagatcagtggctgcccagagcttggaggaggggaatagggagtcactgcttcctgggcaccaggtttcggtttggggtgatgaaatgttctataaccagacagtggtgatggttgcataacattgtaaatatgcttaatgccactggattgcacaatttaaaatggttatgatggtaaattttatgttatgtgtgttttaccacgtacacacataaaacttattttgtgccattaaaaagaaaaagctct

SEQ ID NO: 639327 - DNA, 856 bp, Homo sapiens
aagcagcggtatcaacgcagagtgcccatatacggccggttgtcatcaactaccagaactgtcctacaagaaatgtgaaggggagttcttgccaatgtgaaagaagaggagcatgaaccaataagaaattatctgaaggtacaaaagttattggtaagtattgccttagatattgtacatcaaaggcacagtattataacactgtaacttatggtatgtaaactactcatatctggagtagaaagacagagaaagatgaacctatcaataaataagtaagctaacaaggaactttgttaagatacagacagtatagataagaatataagatagaaagaaaagtttaaagcgtaggggggatgaagttagagtgtagtaatgtatgcatttgctctttgcctattggtgagttggtattggcaattagtgtagtcatcagtttaaaataacggcttttaagatgtgatttggaagccttatggtaatctcaaatcaaaagagctacaatagatacacagaaaagtcacagacattagaacataccagcagagaaaatcaccttcacaaaaaggaagacaggacggaagagaagaccccggaaagaagccagaaaaccaagtaacgaacatggtctgtaatacgtccttacttcatccagtaaccagccattggcaactgtcacactgggggctagacctcggttacagtcaacaacaccacagaagtacgctggaactgggacttctattaaagcacacagaaccccaatgcattcttgtggccctaccgagaaaaaagacagttaagggcaccgttctcggactggccaagtcacacgggctggaacacacgactc

SEQ ID NO: 639328 - DNA, 115 bp, Homo sapiens
gtaatagtacggcgcagtatgatggcattcggctaatagtcgcacaggttggagaggctgcagcatgtgcgatgagacgtgcacctaccgtgaaccccattagggctagacaggc

SEQ ID NO: 639329 - DNA, 214 bp, Homo sapiens
caaaaaaaaaaaaccccccccgggggggggggggggggccccccctcccctttttttttttgggggaaaaaaacccccccggggggtccccctttttttttaagggggggggggggggggttttttttttcccccttattttttggggcccccccctttttttttttttttttgcccccgggccttttttttaaaggggggggccccgggtgta

SEQ ID NO: 639330 - DNA, 910 bp, Homo sapiens
taaaaaggcacaagggtttggttttaataaattttttggctaaaaaagttccaagggggcaggggctgcccggggggggggcgtgcgcagcaaacccagcagccaaagcggtccctttcggctcccgtctgtttgtgccagcctgtgccgccggccagctctggcctccctcaaagccagagggtcctgggctccaggcttccgggccgggatgcgggccagccccgggggagaggacccaggccccctctagtaggggccgcaccaccgctccccccagggacagtgggagcctcacacttgggcgagggtcccctctcccttgtcaccaggagaactcggtgccttgaagcctgggtcccagtgaacgggcccccacccaaggggtgggaaacaggaaggccaggaggcaggaggggccaggccaggagacagtattggcccaatccccgtgcccacaaaagacgatatcggaaagcgcggtcagggcagggttggttcccccgggtgcggggcatgtggcacagacatggcagcagggctgcagtccgaaggcggaagaacaaacatgtcgtgggagccccatcacatgggaggcaggcagaggctagcagctttgggcaccccgagtggggggtccccaggggtcgtgccaccggttgagtgcgccaacggggcgggaaccccaaaaccaagggaaccgcgtgacgtcccccgggccagcccaccggcaacctatgggaatgggcgccgagggcatatgagagccaggtgcccagggcgcgaccccaaagacggggcctcggaccctacggccacagaaggggatggccgtggtgtgagaaagaggaggcgatgacacagccaacatcagcgaacaacacggaagcacagagcccgagtaacagct

SEQ ID NO: 639331 - DNA, 1049 bp, Homo sapiens
ggcgccgtgcggagaagttgtctagtccacgctcggaaccttgccgtccatgggcccgttgccactctgtgcaggtcttcgtgacgcaaaaagacaggcgacagctgtgtgcgcactgcaaacgcggcaattggtctcatcaaggtgaacgggcggcccctggagaatgatatgacgcccgcgccacggctacattgtaacgaaggctgctggagaccggatctcgtgctttctcggccgaaaggtaagccgagttttgcctgtgtgtacgacactccgatgctcccgtggtataaacggttgggtgcgttcaccgtggccccagtagtttgatgcgtatcccgtctacgtccactctcactacaagcccctgtggtgggcctagtataacctaggagatccttacttgtgggagtgaagtgcttacccatatgtaatggaggattgcaaaacgaatcaattctcctcgcttcgcgagtttactgacctcgagaacccctggctggtgttgaagtctggtaaccccttcgttctgccataggccgacggtcccaaaaatagtttttggatgcgctcctagaggtgacccctggaggctcggcatgactcagaaatataccttatccagatgagagtccccaattcgctgcactcaagacaaacttccaacgtttgtattaaattaagagcatgatttctctggtgacgggaatttgtcgacacggtttttcctatagatccttcctgcacagaaaagggcacacctggtttcaagacaggggccttgaataggcaaatgaaaacgtactcttaaagcgacgttttcaccccgtgggggcattaccttgatagacggcagagggattggccaacgaaatgaaccgactttttaaaagaaaccatagcgtgtggatactcttacagtgaatgccgacagccaacaagaaccttacttggacacaggggaggggaaagaacaaaacgcaggggcaccccaactatggtagagcgcagcgaaacatattcagggacacacccgcgggcaccgg

SEQ ID NO: 639332 - DNA, 164 bp, Homo sapiens
gatcgcttctgtgctggcgtgtggttctgtgctggcgtgtggtcttgtgctgtcgtgtggtcttgtgctggcgtgtggttcttgtgctagtgctgacgatgttctgtacaacttaactcactggcgagaatacagcgtgggacccttcagcacaagaaccaacg

SEQ ID NO: 639333 - DNA, 165 bp, Homo sapiens
acctcacgtgctcctatctcaggcagttcagagcctcctgtaactgagaccagtctcttcccatcaaattccttgagcgtgctgcactgcagtactcgtcagatgggctcggtcatatataccacctcgaagccacggtcaagccacaagccacggtcaacccac

SEQ ID NO: 639334 - DNA, 1162 bp, Homo sapiens
ctcagcgcgatacgcgggagggtggtggtgagttgtgatagtcttgtcggtgggggtccactccccacccgtgttgttctacttcgccctgtgtttttgatcgtatcattgtgccccaatggttagaaatgactcctcttgtttcgggcctcttctcttttacaactcgtgtggtatacaccagactgcctggggtgacgccccgctccacacatgggggcacagggaaaccccctcggtgttttgccgccgcataattctgcggccaccgggcgcctgttcccacagtattgacggcccccgcggggtctgccgacttccaaatgggaggggaatgtgccgccataggagagggccccccccagtgtgagaaacaccaggtgaccccccagggcaagaacctatagagaggttaagcccctggcttcccagaaggcccgggtcaaccaggcctatttcgcgtgtgaaaaaaatgagacttggctgccaacttcctccctgagtcagaactttgatgacgagtgatcccaggaacccaggcccccgaagccccccccctacccttgatgtgccatgaaagttttataaaaggacaatatatagatattcacgtttatttaagaaatggaaaaaaaaatccaaaattctttaaaaaacccagccaaccagtccagcttcctgtcctcctaaagtggcccccgttcccatctcccgggccaagacaagctgtccccccgtcctcctccccagcccagcctgctcaagagaaagctggcacggactgggagggcgacaagatgggcccctctgtggcctcctgtcccacgcttcttctgcacgccaagacggaaaaggcggctgcgttgcctgctccatcctcccgagaaaaccccctcgagggagcccccccccactccttctttctaggatgaaggggaaagctggaggccccacactttgagtcctccacttggaagtggccccaatctttccactctagggcaagtcctgaaaggcccaaggccccctccccacgtctggccttggcctccacgcctggagaagggctaaacacatcagctcattgtcaaggccacccccaccccagaacagaaccgtgtctctgataaaggttttgaagtgaataaagttttaaaaacta

SEQ ID NO: 639335 - DNA, 313 bp, Homo sapiens
acccggacacagctatcacggccggcagcatcccactccgcatcgccctagcagcccgacgacatcctatacagtaacagacgaggtcaacgagcccacccctaccatcagatcaacttggccaccagtggtactgaacctacgagtacaccgactacggcggactaatcttcaactcctacatacttcccccattattcgcgagaaccaggcgagctgcgactccttgacgttgacaatcaagtagtactcccgattgaagcccccattcgtatataattacatcacaagacgtcttgtaagcgcgtgctgt

SEQ ID NO: 639336 - DNA, 147 bp, Homo sapiens
gacggtgactgtccttagcgtagctcggagatatctgatgcagtgctagtgttcatcgtctcagactcctggagctgggtctggggtacctggctgacatctacgattctcttacttaactggcttagctactgtgtcttatttggt

SEQ ID NO: 639337 - DNA, 845 bp, Homo sapiens
tctggcagatgttggggccgtttggcgccgtcaccactgtgaaagtgatccgcgattcaacaccaacaagtgcaaagggttggcgtttgtgaccatgacaaactatgaagaagccgcgatggtcatagccagcctgaacggctaccgcctgggggacaaaatcttacagggtttccttcaaagaccaacaagtcccacaaataggctcgcatcatgcgtttctttgttgtagcggaatagataattaaggagtgacacggagttgaaacttttctatgtcagtgtacacactcatttagcgccaattttcacaagtgttggtcttctgtctgaatgacaagtgagaaggtttttatactctgggatgcaaccgacgatgttcagaatgttatgaaatcccacaatgttagagccaatcttaagtttcgtaacgttatttcctttagagatatatattaagaacagaaatctaagtagaactgcattgactaaccagtccctctggatggtggtgaacctgaagcatgctttaacctctaagactgtctaacacgcgtacattcaatgtctccacaggactggtgtagcaacacaaaaatcacctttatagttgaagtttattactctacagatgttagacacgatgctgagtgtgccgtttttctcaaccgcttcaaacatttgtaagcgatgtatgcatttggtggacacggaagtacctttaccacggcaggtcccgttgcaactactggttcagtcagtcccggggtcgcgagtgtactgaaatgcgggggccccgccacgtgggcccactgggcgggccagggcgctgtgggggctcaaag

SEQ ID NO: 639338 - DNA, 203 bp, Homo sapiens
aacagcgattagtcttaattctatcatatgtatacaaaactatccacaactttcactttgtatatacatctttcctccatcccctgcaccattcatccgtacatctctatagctctcacactagtgcgccttttctttagggccagagcacagagaacacactaattttttattttatgggcgactggcataaccctcaggat

SEQ ID NO: 639339 - DNA, 202 bp, Homo sapiens
gcacatcaccagcaccattccaccgtccacagtcacagtgcatctgtgttcccattctctcacctagttggctccctttcatgagcccagcatgctcagccttgcgggttttcgcacagtctgcatgcattcacagttctcgaacatctgctcactggacacaattgtccgcagcttacggggcatcctctcagcagtcgca

SEQ ID NO: 639340 - DNA, 1262 bp, Homo sapiens
  misc_feature (837)..(837): n is a, c, g, or t
tggccagttttttttttatttgtaaagctctgccataaaacttctaggcggtgtgccaatgtggttcccctgtggccattactcgcaccagggtgttgtcctggtgttagcgcagctaatacaggagctcgtggccaatcagtcagactcaggccaggtcaaggtgcacgtgggggtggttctgcctatgcgtgcgtggctacgtgatagacttcttgcttcagatgtcactcataccaagggatctttcgcccctctataagatctcccgagaatcgtgtggagtgcgttggggccttgtgtggctagcacgacgagtccagtgtagcgggtaagagggctgaatgcactaggggctgcttgagtgatgtcccacaccttttagcgtgtgtataaagagggtgttctgtgcccatatcgtgtgatggaatactccccatataagcgagtggtcgcgtggcccgatcctgttggcctctccgagaatagcgccgcagaaggggatctcacaactcgtggggaggagacattcagttccacgcggggtatctccaaaagatagcctgtggtgtgtggccccgaatgtggtgggttggggtccttgacacacggttattgccaaggtataaagccccagagggtttcacatattaccccttttgcaccaacgctttttgtccccaacgccaaccagtggtagagcacgtgactagaatagggggttgggcatgcttgggtggagcgcagaagaataagcgggggagcaccaaaagagaagcgcaccaatttctttgaatgggggggacttcttacagtaccctgggagaaccaggctgnggtcttttttttcgccaccaagacacccacaggggggttaatcccacaatatagagtcgtgagaacgacggggtatatataactcctctcagaagagatttccccagaaacgaaccaaatttcttggccagggtttttggtccaacagaatgaggaaggaaagggggcacaactacttctccaaagggaatctatctcccttatggtaattatgggaggcccccaacaaaaaatttccggcctcttctagtgggtgttgtgttcgcccctcgttgtgattgaaagattcccccaagagataggcgcgccagggggtgttcccaatctcgcagtgggaacgcccctggaaagagggtgcacacaatttgtcgctcactttttgacaggagagatattagccccgagctatttctactatttacatg

SEQ ID NO: 639341 - DNA, 97 bp, Homo sapiens
  misc_feature (36)..(36): n is a, c, g, or t
gcaggtcaaaagaccctttattacttttatgattgncattatgctttcttgccagatgccttggagcaggtgcttctgggctgagcttttgaccttc

SEQ ID NO: 639342 - DNA, 385 bp, Homo sapiens
ggttgggaaggagtagggaggatgaatgaatggaaaatgcaagccaggcatgtattatacgtgtgtgcagtttagagtaagacagtagaagtctactaggagcaggtatgcaagaggccaggcctttccctttggttcttcttcaatgcataggtgaaaaaagacatctggcattcacaaggtcaaggaaccccaggggccaagactggatagctgtgcgagcacacattggtagtggagaaaactatgcctgatggagcattgccagatgttgtctgtaggtcaagtggtagtaagtcggcaaggaatttaagagtataggtaggaggcaaagtttgaaaaatggaattgagtaatggtgatgggagggcataagatgagaaag

SEQ ID NO: 639343 - DNA, 117 bp, Homo sapiens
ggtgtgtacaaaacgggggcttcttcctgcgcatccacccctgacggccgagttgacggtgtccgggacgaatacgcgactcctcacactacacggctaaaccttcaacgcacgaca

SEQ ID NO: 639344 - DNA, 190 bp, Homo sapiens
tgtctataaggcagtacaatggtagggccttgtaggacatggtaaggactggagtaaaatctggaagggtgttaggaacccttggaagggcgtcgagcgaaagggaggtgataaacatttgcaaaaaggttggactgctgggtagtgaacacatcaggggttcgaacagatcataggatacgtagggaga

SEQ ID NO: 639345 - DNA, 316 bp, Homo sapiens
ccggaagcggtggtttgtagcggctctctgggtagcagtgtggtgtgatagcggcagaggggggctcggagaggtgctcgtattctcgtagctgtgccgggtacttacccaccaccatgtcgaacaagagaacaaagcaccaagcacaagaagcgccctcagcgtacaacatccaatgtgtgtgctatgtgtgcacagacacagattcaggagtacagagaggcctacaacatgattgcacagcacagagatggtctcatcgacaagggaggatgtgcatgatatgcttgcttcagtggagaagactccaactgat

SEQ ID NO: 639346 - DNA, 1010 bp, Homo sapiens
catttaccatctcactggctagcgagtactagtatatcgctcacacctcatatcctccctactatgcctacaaggaataatactatcgctgttcattatagctaggtctcataagcctcaagacccactccctcttagccaagattgtgcctattgccatactagtctgtgccggctgcgacgcaacggtgggcctaggtgccctgaactagctctcaatcgtccaacacatatggcctagactgacgtgacataacctaaacctactccaatggctaaaactagatcgtcccaacaattgatatttagcctagccactgggcattgaatttccggaagaggaaacccattgatttggatgtcacggaaccgacccagagcctaatgattagaatcatcgcgcctagctattgtgtatctcgaaagctaaccaacgaccttatctttatgcgttgttcgcccagaaccttctcccttcctgcaccgcacctggaagagacctccacctccgtaatagtaaacatgaagcgtgagtcctaccccatctgacaatacagtggctgggcctggcggtcccgagcattatccaggtgaaaccgagttattcacggaggaacatagtcataccggctcgtatagctagatctgcccatacagatgtgctcctgtgaattataacattcagcagtcctacagaactaatcatatgggatgattcttcttcgaatagcccacttagagcccacatgggtatcatccacccgatgaggcgaccaggcgagaaccgccatgaagaggggggcacataacttgctattctagagcctagtaggatccctttccctatgaggtggacttagttacaagcacaacagcggtaggttcacttaaattctagtggtgcatctcgtggccaaaattatcaaatctgagcacaacgtaaatgaagttacacaaaattgtggaaaaaccattaggggcacagagaaactaaggcagtgaaccatgaa

SEQ ID NO: 639347 - DNA, 285 bp, Homo sapiens
agccagtctagccagccagccaagccagtcaagccacccagccattcagcctagccagccaacccagagagccagcctatccagcctagacaggctagcaagccagccagtcatgccagccaagccagtcaagtcagccagccagccaagccagccaagcctaccacgccagccagcaagccaagccagccaagccagccagccaaccaagccagtcaagcaagccacccagccaagccaggccaacccaaattctttttaataaaaggcacaagccgcagcctc

SEQ ID NO: 639348 - DNA, 147 bp, Homo sapiens
gtgacccttcgtggaagacgaataacaggatctataagaccctggcagagcctcagagaccctcagcattgccaacaccagagtttttaccaacgtgtggaaggggctggcacacattgcgttcaggactgtaaattccaagaggcc

SEQ ID NO: 639349 - DNA, 127 bp, Homo sapiens
gtctcccttaatggtaagcttttaataaattatttccagtactctaattataaggatgaaccaatttaagactaccagctaatcatgagaacatatcttagacaacagtccccttctgtcgtcttct

SEQ ID NO: 639350 - DNA, 252 bp, Homo sapiens
gatgggactcttgaagcctgggattacaggctgtgagccagcactgcccggccgtgtttttttattttctgtagaggcgggttctccctgtgttgcccaggctggtctttttcttgttttcttttggtgtagtctgttcgctttttcgcctgtggttggcgtgctggggcctctgtttccagctttaactacaccctccgccgccccttgcaccgggttccagcgatttctcctgtgcctagcctcccaagt

SEQ ID NO: 639351 - DNA, 248 bp, Homo sapiens
caaaaatttttttttcccccccgggggggggggtttttgggggggggcctttccccccttttcacccccccaaaaaggcctttttttttttccccgggggggggggggggggttcctttttttttggcccccattgggtttttttggggggggccccttttttttttttttaaaaaaaccccttccccccccccctttttggggggcggggtttttttttttcccttttattgggtttttccccccca

SEQ ID NO: 639352 - DNA, 503 bp, Homo sapiens
ataaatccttctaccaaaaacacatatggtcatcacagtgctattcacagtagcaaagacagatcaacgtggctgcccatcaacagtggactggataaagaaaatgtggtacatataaatcatggagtattaggcagccataaaaagaacaaaatcatgtcctttgcagccagccacatggatgcagctggaagccataatctaagcaaattaagaacagaaaaccaagtactgcatgttctaacaaatgggagctaaatattgagtacctcaggatgcaaaggtgggaacaacagacactgcagactggaacactgtgggtgaggagggcagaaggataggttgaaaaactacctattgggtactatgctcactacctgggtgatgggatctgtacctcaaacctcagcatcacacaatatacccttgtaacaaacttgcacatttacccactgtttctaaatgaaaagttgaaatattttttattaaaaaacacaaaagca

SEQ ID NO: 639353 - DNA, 113 bp, Homo sapiens
cttgcgtagagacagacgaggacacacgtgactcggatagctccgcacgtgacttcgtttcagctgtacaagcagttagtctgaatgccctgatagaatgtatcttctcccac

SEQ ID NO: 639354 - DNA, 1149 bp, Homo sapiens
gggaagttgtggaagaggcagaaaatggaagagacgcccctgctaacgggaatgctaatgaggaaaatggggcagccaggcaggctgcaccaatgcaggtcagactgacagcaagcaggcaagcaaggtggggcaggcacagcaggcaggcaggcaagcaagcaaggtgcatggtgcaggcaagcaggcatggcagcatgcaagcatgcaggcaagcgtgcagtcagcttacgggacaagctgggcagctgacagatgatgacggatgaccgatgtcgagtaccaaagaacgcagacagaccgaacgacggatgacatacgacacgcacaacacagcgacaaagttaaaactacaaaaaaaacaaggcacgcacggtgaccatattacaagcctccacattcccagtctcagcaatctaacacgtgagatcacactatcagaataagagaggcccagaccagaccacacgtgagacagtgcacacccagcagatgaccacgacagcatctcacacgcaaccaaacccaaaaaccagtgaagaaactttgcaaacaggggtgagggacaaaccaaggaaccacagaagtatcacacggacccttggataatagatccttataacaagctcgctctaaacaaggaaacattctcgcatgaggagacctgttacatgaacctaaacaattaagacaaacaatgaatagggtaaacactaattgtgataacggggaatcaaagcaccataagacagtaaacaggaaacatcgcggacatgtaacacagaacacccagacactagctagaacagacggctaccgaccgtgcacccatacaatcatcattgcaactaatcaaaccttcgctaattgaaattgatattacaccccactaaatattccatatatcaataaaacaccatccactaaaaagtgagtaaaaactaacacaacaacaaccatgtagcataacaacacaaaaatacagcgaacaaaaaatttacacacacaacacgtacataaacaacacaacatcattatattctcccagcaaaaaattctccatcatacactacatattacacacgacgccactagtcacaccacaaaacaattacaatcaacatacaaacacacgcatacaaatcagtc

SEQ ID NO: 639355 - DNA, 559 bp, Homo sapiens
  misc_feature (88)..(88): n is a, c, g, or t
  misc_feature (119)..(119): n is a, c, g, or t
  misc_feature (130)..(130): n is a, c, g, or t
  misc_feature (181)..(181): n is a, c, g, or t
  misc_feature (191)..(191): n is a, c, g, or t
  misc_feature (213)..(213): n is a, c, g, or t
  misc_feature (221)..(221): n is a, c, g, or t
  misc_feature (227)..(227): n is a, c, g, or t
  misc_feature (256)..(256): n is a, c, g, or t
  misc_feature (263)..(263): n is a, c, g, or t
  misc_feature (265)..(265): n is a, c, g, or t
  misc_feature (268)..(268): n is a, c, g, or t
  misc_feature (282)..(283): n is a, c, g, or t
  misc_feature (285)..(285): n is a, c, g, or t
  misc_feature (293)..(294): n is a, c, g, or t
  misc_feature (297)..(297): n is a, c, g, or t
  misc_feature (305)..(305): n is a, c, g, or t
  misc_feature (315)..(315): n is a, c, g, or t
  misc_feature (326)..(326): n is a, c, g, or t
  misc_feature (328)..(328): n is a, c, g, or t
  misc_feature (340)..(340): n is a, c, g, or t
  misc_feature (362)..(362): n is a, c, g, or t
  misc_feature (385)..(385): n is a, c, g, or t
  misc_feature (391)..(391): n is a, c, g, or t
  misc_feature (403)..(403): n is a, c, g, or t
  misc_feature (411)..(411): n is a, c, g, or t
  misc_feature (413)..(413): n is a, c, g, or t
  misc_feature (427)..(429): n is a, c, g, or t
  misc_feature (434)..(434): n is a, c, g, or t
  misc_feature (444)..(444): n is a, c, g, or t
  misc_feature (446)..(446): n is a, c, g, or t
  misc_feature (454)..(454): n is a, c, g, or t
  misc_feature (555)..(555): n is a, c, g, or t
cacatggtcctgttcgtactccaggatggcggcgtaaagggcccgctgctcccgttcctccggggtcagggcgacttggctgcaaaanctcctggggagaaaggcacgcggtgggtgcnggggccagtgncctccccgcagcggccccaggggcgggcaggagttccacctgttggcggcntcctggagcngcagccaggcgattacctcacnaccttacncaaggnacaaaagtagacaaaataaagagaccgancataggnanagngcgggccatcggtnnanaaccccgnnccncacccggngaggccaggnagtcacagggncntcctctcggtgnggggatataaaaaaaaaaaaanaaaaaaaaaaaaaaaaaaataanaaaaanaataaaaaaatntataaacncnaaaaaaaacaatannntatgnaaaaaaaaanantatatatnatactcccggattgctctaaggccaggagctttgtgactctgccccctgaagcttctggaagatctcgggtggcagaaaaggagagagctttcctccttcntcgg

SEQ ID NO: 639356 - DNA, 844 bp, Homo sapiens
  misc_feature (95)..(95): n is a, c, g, or t
tttctataatgcctgaatatttataatcatataaattttcatgcattatataatttatcacctagtgtacgtttcacattaattaaaaatattangacactctaatttaaccacttctgaagaaatgaatggctgatcacaaaatgtcaaattactatcataagcccaagattttatcataatcatgaatagcatttaatcatgaatatcattatttaacttttagggggcgtacttacagttgtagattaaaatccaatattgagtcaacaatactttactccaaattataatcacatatcgaaaaaaagttttaattcaatatttttattatattccacgtataaaaataattttcataaacggttacctgattgatatcttccaaaaaaaatttcctaccacagggtagtaacttccaattaaacatgcccctaacccacatactctttatgaactccttaataattgcaattttattttaaattcaagttttaaaacgcaataaatttcaaattatccccaaaacagcttgttaataggccatttaaacttattcaaccagcttaatattgtcggcaggcatatttccgtgtactttactaaatctgaatcaaaagggcgtgataacccaagaaaaaaagggaaacaataagaacgcatggcaaaaaaagagtaaacgaaaaaggggtgaagaacaagggaaagtaaaaaaaataaaaaaaacaaacaccaacgggggggggtagcaaaaaggaaacaaattgtgtaacaagtaaaatataaaaataaaaagtaatgacaataaacacaacggaaaacgtaaagaacaacaataggcaag

SEQ ID NO: 639357 - DNA, 148 bp, Homo sapiens
  misc_feature (6)..(6): n is a, c, g, or t
gttatngggcaccctttcctaaccacccaaccagccggcttaatgcgccgttcagaggggcgcctggagggggattttttcttacccaactttgcggggtttacaaccccagaacgaaaacttcgttggctacaatatacaaagaatt

SEQ ID NO: 639358 - DNA, 3341 bp, Homo sapiens
gaggcggaagaggtgctgtgcaggaggcgggcgggcgcggttctttccggaaggattgaatctcctttagccccgcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacaggaaataatttagttactatcaccaggtggatgttacgggttgcctgctacaatgcagaattattcctgtttgacacacatggcagatcgagttaacatttctaaaacataaaagtcatgggatgtgtactaaagtggaagagctgagagtctcatctggtcactgtcaagacattttattgttataatgtcctatctggtttttggaaactcttagaaaccccactttataaacttaaatttcacaagttagtctcttagctctcctgtttacttataacatgtatttttccattttagatacagacagaagctgctcagttgcttacaagtttcagtgagaagaattgagaacttttcagagaagatttatgaaatagctaataaacattgccttttcttttaattctaaacttaatatatgaactataactgttctacggctttttaaatgttgtgaccatttaaccgtgtaaatataaaatattctaggcttcttcacaaataatagggtaaaataaataatcgccataagagtggtagaaataaatctccatggctcaggcaaagagattattttgcatcctggataccagcaatgcaaaatggtatgagatttctaaggattgatcacattgggatgggagatcaagcaaagaaatatttgtagaggaggggaaatggatctataggggatatacagggggatggattttcaaattggattgattctaagttgaaatcttgaagagaaggtgtggtgacagtggttaggatgttgtgggttcctgacataaagtagttaaatgatatatcttggagctaacctgtgtaagtaaagaactaagtaaggagatgactaaaaatggagtagtttccttttttatttttttgagacagagtctcactttgtttcccaggctggtgtgcagtggcacaatctcggcccactgcagcctccgcctcccgggttcaagtgattctcctgccttagcctcctgagtggctgggattacagggttgtaccaccacactcggctaacttttgtatttttggtagagatggggttttgccatgttggctaggctggtctcaaactcctggcctcaagtgatctgcccgccttggcctcccaaattgctgggattacaggcgtgagccaccgcacctggccagtttactttaaatgtggtgtagtctcatggtaaactgaatttgtcatcagatgcaaagttctattccctaatggaatggaaggaacacaaaacttaagagtgaaatggaatactaagatgtttttaaataggcaggactatgctactcacttgaggctggagtgccaccactgcaaaatctttttaagttttgtaaaaaggagcatcttgaatccacttagataaagagagactgtgtgtgtaggtggatttttcccaaaggatttgggaattgtaatgttacaatgaactgtatggatatgtttgtcatgtacattttcaaacaaaaaggaaaactgaaagtagtgatctttgtatacccatctcttagattcagtgattttgctatataggttgtgtatcccttatctgaaatacttgggactagtagaagcatcttggatttgggatgtttttccaaattttggaatacctgcatacacacaataagatatcttggagatgggacccaagtttaaacacaaattcacttgtttcatatataccttatgcacatagcttgaaggtaactttatataacattatttttaataattttgtgcattgagaccaagtttgcataccttgaaccatcagaaagcaaaggtgtcattatctcagccactcatgtgggtaatttgtggttggttgatgtcaccatcattcctgactgaatgtatatgctaccaataagcagttattttcttatacttattcatgcataagtacttaacagtaaaaaatatgacataactcgcacaggaacaaggatggcaaaaaaaaaaatatgacacaccactgatacagtgaaaaaataatgtggtcagggtagctaggcaacagtagcatcaccagaaacctgtatcagctgttaaacggcaacaacaatggcaggctttcagtttcccacttaatgatgctgtattttaaaaggttattgtatactgtaattttatttttgtaggtgaagagaaacagaagcagctgaagggccaggaagtgggtctttctagggatgtggcattctgctggatggctttttaaaatgggttttttcctttagggagaccgaataaactgtgttgtgcacctgcaaaaaaaaaa

SEQ ID NO: 639359 - DNA, 1229 bp, Homo sapiens
cactgcgcagcaccacacttcgctcgtactcgtgcgcctcgccttcgctatttcctccgtcaaccatgtctgacacaaccctgatatggctgaggatcgagaaaatctcgcactacactcgcacacactgaacgcaacgaccccgagcaccgcccagcagacacaacactccacgtgcccctctccaaacgcacacacgcacttgacaccacggagcaacgccacagccacgcgcgacactcgcctcccctgacgcgccgccttgcacacccagcccacaaattactgccccccacacactcacacaccacaacctactgcccaaccccttccacacagcttctaaaaacacacacaaccacaacaccacacacaccctccacccacaacacccccccccccaccccaccctcttccaacacccagcaacccgcgcccaccacacgaaaagagaaactctcctacagcaacacaagtaaaagactcgtttggcagaggggagcggcccccccccatcagaagacagaatgcagcaagccgcgcgacaacagaggcactggagataacaacataaggaaacagcactccccccaaccacacactcacccccccaccacacccgcccacaccacaccaaccaccacacccctcccctacccacacctccccccaccactccactaccacccccaacaccactctactccccacccacccccacaccaccccaccctaccaagctacgccccacaacacaacaaacacaacacctgccaacacactcaaccacacacaacctcacccctttacaaacaacaccaaaatctaacacaacactatacacttcacaatctaaatccctcaccaccccccaccaccactattcaacacacacataccacatatccctcacacccaccccccaaccccacctacctccccataccaacaacacccatccccttacctcacaaacccaccaaacacgactccctaccaccccacacaccacaccacacacacatccacctactctcccccaccccacaaccccaccacataatatcacacaccacccccactccacacccacactcctcactatactacaacacaactcacagaaccactaaaaaactccaacacaaaacacgacaccacataacctcacctcacacctctcacaccacacaaccattcacactcatatcacgctaccctaacacaca

SEQ ID NO: 639360 - DNA, 3047 bp, Homo sapiens
agcggagggaaggagtggggtttgcccccacgcgccccagaagctgcctgctacccgcccttcttgtgcgaaatgtaaaacaggacgggaaagaaccttgaccgctgtgaaattattctccctgtaggcgatgacagatacaacagcgcttgaggctgcccctttcagactttgaaaagtgtggtaatgggaaacccaggaactttcaaaagaggccttttactctcagctttgtcgtatttgggttttgaaacttaccaggttatctctcaggctgctgtggttcatgccacagccaaagtgcggcaatattagaacccaaggaaggaaaaactggcaaagttgtcatatgccaagtggccattgcctcctgaaatgaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattctaaacttaatatatgaactataactgttctacggctttttaaatgttgtgaccatttaaccgtgtaaatataaaatattctaggcttcttcacaaataatagggtaaaataaataatcgccataagagtggtagaaataaatctccatggctcaggcaaagagattattttgcatcctggataccagcaatgcaaaatggtatgagatttctaaggattgatcacattgggatgggagatcaagcaaagaaatatttgtagaggaggggaaatggatctataggggatatacagggggatggattttcaaattggattgattctaagttgaaatcttgaagagaaggtgtggtgacagtggttaggatgttgtgggttcctgacataaagtagttaaatgatatatcttggagctaacctgtgtaagtaaagaactaagtaaggagatgactaaaaatggagtagtttccttttttatttttttgagacagagtctcactttgtttcccaggctggtgtgcagtggcacaatctcggcccactgcagcctccgcctcccgggttcaagtgattctcctgccttagcctcctgagtggctgggattacagggttgtaccaccacactcggctaacttttgtatttttggtagagatggggttttgccatgttggctaggctggtctcaaactcctggcctcaagtgatctgcccgccttggcctcccaaattgctgggattacaggcgtgagccaccgcacctggccagtttactttaaatgtggtgtagtctcatggtaaactgaatttgtcatcagatgcaaagttctattccctaatggaatggaaggaacacaaaacttaagagtgaaatggaatactaagatgtttttaaataggcaggactatgctactcacttgaggctggagtgccaccactgcaaaatctttttaagttttgtaaaaaggagcatcttgaatccacttagataaagagagactgtgtgtgtaggtggatttttcccaaaggatttgggaattgtaatgttacaatgaactgtatggatatgtttgtcatgtacattttcaaacaaaaaggaaaactgaaagtagtgatctttgtatacccatctcttagattcagtgattttgctatataggttgtgtatcccttatctgaaatacttgggactagtagaagcatcttggatttgggatgtttttccaaattttggaatacctgcatacacacaataagatatcttggagatgggacccaagtttaaacacaaattcacttgtttcatatataccttatgcacatagcttgaaggtaactttatataacattatttttaataattttgtgcattgagaccaagtttgcataccttgaaccatcagaaagcaaaggtgtcattatctcagccactcatgtgggtaatttgtggttggttgatgtcaccatcattcctgactgaatgtatatgctaccaataagcagttattttcttatacttattcatgcataagtacttaacagtaaaaaatatgacataactcgcacaggaacaaggatggcaaaaaaaaaaatatgacacaccactgatacagtgaaaaaataatgtggtcagggtagctaggcaacagtagcatcaccagaaacctgtatcagctgttaaacggcaacaacaatggcaggctttcagtttcccacttaatgatgctgtattttaaaaggttattgtatactgtaattttatttttgtaggtgaagagaaacagaagcagctgaagggccaggaagtgggtctttctagggatgtggcattctgctggatggctttttaaaatgggttttttcctttagggagaccgaataaactgtgttgtgcacctgcaaaaaaaaaa

SEQ ID NO: 639361 - DNA, 3133 bp, Homo sapiens
  misc_feature (1)..(1): n is a, c, g, or t
  misc_feature (12)..(12): n is a, c, g, or t
ngttctcgagcntctcggagcatgttggctgtgctgtgcaggaggctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagagtctcgctgtgtcactgagggtagagtgtggaggtgcgatctcagctcactgcaaccactgcctcctgggttcaagtgatcctcccacctcagcctcccaagtagctgggattacaggcatgtgccatgatgcccagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattctaaacttaatatatgaactataactgttctacggctttttaaatgttgtgaccatttaaccgtgtaaatataaaatattctaggcttcttcacaaataatagggtaaaataaataatcgccataagagtggtagaaataaatctccatggctcaggcaaagagattattttgcatcctggataccagcaatgcaaaatggtatgagatttctaaggattgatcacattgggatgggagatcaagcaaagaaatatttgtagaggaggggaaatggatctataggggatatacagggggatggattttcaaattggattgattctaagttgaaatcttgaagagaaggtgtggtgacagtggttaggatgttgtgggttcctgacataaagtagttaaatgatatatcttggagctaacctgtgtaagtaaagaactaagtaaggagatgactaaaaatggagtagtttccttttttatttttttgagacagagtctcactttgtttcccaggctggtgtgcagtggcacaatctcggcccactgcagcctccgcctcccgggttcaagtgattctcctgccttagcctcctgagtggctgggattacagggttgtaccaccacactcggctaacttttgtatttttggtagagatggggttttgccatgttggctaggctggtctcaaactcctggcctcaagtgatctgcccgccttggcctcccaaattgctgggattacaggcgtgagccaccgcacctggccagtttactttaaatgtggtgtagtctcatggtaaactgaatttgtcatcagatgcaaagttctattccctaatggaatggaaggaacacaaaacttaagagtgaaatggaatactaagatgtttttaaataggcaggactatgctactcacttgaggctggagtgccaccactgcaaaatctttttaagttttgtaaaaaggagcatcttgaatccacttagataaagagagactgtgtgtgtaggtggatttttcccaaaggatttgggaattgtaatgttacaatgaactgtatggatatgtttgtcatgtacattttcaaacaaaaaggaaaactgaaagtagtgatctttgtatacccatctcttagattcagtgattttgctatataggttgtgtatcccttatctgaaatacttgggactagtagaagcatcttggatttgggatgtttttccaaattttggaatacctgcatacacacaataagatatcttggagatgggacccaagtttaaacacaaattcacttgtttcatatataccttatgcacatagcttgaaggtaactttatataacattatttttaataattttgtgcattgagaccaagtttgcataccttgaaccatcagaaagcaaaggtgtcattatctcagccactcatgtgggtaatttgtggttggttgatgtcaccatcattcctgactgaatgtatatgctaccaataagcagttattttcttatacttattcatgcataagtacttaacagtaaaaaatatgacataactcgcacaggaacaaggatggcaaaaaaaaaaatatgacacaccactgatacagtgaaaaaataatgtggtcagggtagctaggcaacagtagcatcaccagaaacctgtatcagctgttaaacggcaacaacaatggcaggctttcagtttcccacttaatgatgctgtattttaaaaggttattgtatactgtaattttatttttgtaggtgaagagaaacagaagcagctgaagggccaggaagtgggtctttctagggatgtggcattctgctggatggctttttaaaatgggttttttcctttagggagaccgaataaactgtgttgtgcacctgcaaaaaaaaaa

SEQ ID NO: 639362 - DNA, 1134 bp, Homo sapiens
gaggcggaagaggtgctgtgcaggaggcgggcgggcgcggttctttccggaaggattgaatctcctttagccccgcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattcta

SEQ ID NO: 639363 - DNA, 2880 bp, Homo sapiens
  misc_feature (2841)..(2841): n is a, c, g, or t
gaggcggaagaggtgctgtgcaggaggcgggcgggcgcggttctttccggaaggattgaatctcctttagccccgcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacaggagcctgattccccacgtgtcacattggtccgtgacgtttccccactaagggtgagacccattactgagaacaaaccccaggaatcccttacattctccttcccgtgcagcccccacctgattgttcttgtgtggattccagagctgactgctggattgagatgcttatttccccacgtacatgtatatcaaaggttctgtgtagcctcacctagtgcatcgtaatttcttacttgagggagaccagcaccctgaaaacgaactggaaagctgccttcttcagtcaaatctgctaaatcatacctacaatgaatgatattcaataacttctgtcatggcaaaatttatacagcagtggtaccatttgtaattctaatacttaactcttttatggtatacgcagtcctttttgaaggccagtttccctctatcacataacctgtcacatacattagaattttttttttaattctttaggcttgaaaattaccagagtgttcataataaggatttggaaaaggagtctattcaaccaagcagatctctgcctttctttcgtctttactatgaattctgaataaaatggagaacacactctcaatatgtagaaaaataaaattttggcaaaacaataattactgtttttctgtatgtacttagcagtgaaatatttataggcaacagattttaagaagtcagttccatggctattaaaaaatgtttaagttaatgaaatttacagtgcatattaaaagcatgatacaaatggaaatttaaaattttgtattaggaagcccagtttgctaaaagtagcattaatatcattcacatcagattttaatttgttacacatttttgtagttcagcaaaggcccctatgatgaaaaacaattaaaaagtgttatgacaaaaataattatctgtgtaaaaagggggagacccaaaagatttttcatatggttatttaattcagttaaatagaactgttatgaatttgagaggaatgaagatattcaaacactaacagaaaatcattagccttatattagagcattcaaatgcttatgtaactcttcaatccatctggcttcataaaaaccaaaattttgaacacaaaaaagtggcagagtttacattaccttttgtatgttcctaagtatgaaattgcatcaatttattatgaattaaatttgaaaagcatcacagatttaaaaacaaagtacaaaagagcctgattctttttaattccacaaatacctagcatctcaaagtaacatgtaaacaaacttctatgctgctcaatgaatccttccaatttcgataataaactaaatagtattggatctagtatatgactttcatgtgtaagttatggttctatccattactttaacaatattactgatgtaacagagaaaaattttcaactattgtatttatttaaaacaaactgacaagttcaagcacctgtcttcagaaaagccagcagcatttttttttttttaacatactcaaagtaagatttggcctaagcccttaatacctttctgaacagccatgcaactaaacaccctcaggagatgttacataagggagagaagaacatggagcaatttgcactttttcccctagataatattaacaaggtaaagcaaatccagatctttatgaatgaatggctgtcatgtttaatacacttggagctctataaaactagagccactatcatatatgtttatatagatatatatgtatttttaataaagtctctcacttgcttcaaaatttaaggatgatctttttcctggtcagtcatttcaagggaacaataaataaagtagaaaaggatgaactgttttgcatatttctgtggaagaacggaaaacatactttgagaggttcggaaaatncactgtacagaatgaacagcttatatacactatctgtgc

SEQ ID NO: 639364 - DNA, 261 bp, Homo sapiens
ctgatctacaggatccttatcccggttctgggtattcggggtaagatatctgcccctcctggcgggcacggtggctgacggctgtaatcccagcactttgggaggccgaggcgggtggatcacgaggacaggagatcgagaccatcctggctaacatggtgaaaccccgtctccagtaaaatacaaaaaattagcagggcgtggtggcgggcgcctgtagtctcagctactcgggaagctgaggcagtggaatcgcttgta

SEQ ID NO: 639365 - DNA, 282 bp, Homo sapiens
tcgagtaagggccaaaagttcggtttctttaagaactgttcagttaggtggcccccactggtcttctgcttgatagagtttcgtagccaagtagatccactgttagtctgatgggcttccctttgtgggtaagctgactttaatctctcgctgcccttaacattttttccttcatttcaactttggtgaatctgacaattatgtgtcttggagttgctcttctcaaggagtatcttgtggcattctctgtatttcctgaatttgaatgttggccttatcgag

SEQ ID NO: 639366 - DNA, 2550 bp, Homo sapiens
  misc_feature (2511)..(2511): n is a, c, g, or t
tgctgctgactattgagatcaaatatatatatagtcatcatcatttcattcacttattcagccgatgtacactgaatgtatgttatgttcacacactgttgtaggcacgtggggtaccatagggaactaaagagattaaaaagagtattgctgtcctcaaatagcatacattctatcgggagcttcagcttctcatctataaaatggagatacctacttacaaagttgtgaaaatgagaaatgtgtataatgcagtgcctagcacatttgtagatgtttattcattggtaattattattttacaaatatttgtttgagatataaacagttgaacaaaagagaattcccattagtctaatcacttattgaccacacaaatttattgaaatttagacctcagaaacaaacctttaaaaataaaagcaacactgtttcctctgagatcattttttctttcttatgtgcagtggatccaaacttctacagcaaaaacttacttcttttaggaaagacatacttgaaactacacaacaaaaagcttgctgctttctggctaatgaaagccaaggactatccagcacacacagaggaggataaacaggagcctgattccccacgtgtcacattggtccgtgacgtttccccactaagggtgagacccattactgagaacaaaccccaggaatcccttacattctccttcccgtgcagcccccacctgattgttcttgtgtggattccagagctgactgctggattgagatgcttatttccccacgtacatgtatatcaaaggttctgtgtagcctcacctagtgcatcgtaatttcttacttgagggagaccagcaccctgaaaacgaactggaaagctgccttcttcagtcaaatctgctaaatcatacctacaatgaatgatattcaataacttctgtcatggcaaaatttatacagcagtggtaccatttgtaattctaatacttaactcttttatggtatacgcagtcctttttgaaggccagtttccctctatcacataacctgtcacatacattagaattttttttttaattctttaggcttgaaaattaccagagtgttcataataaggatttggaaaaggagtctattcaaccaagcagatctctgcctttctttcgtctttactatgaattctgaataaaatggagaacacactctcaatatgtagaaaaataaaattttggcaaaacaataattactgtttttctgtatgtacttagcagtgaaatatttataggcaacagattttaagaagtcagttccatggctattaaaaaatgtttaagttaatgaaatttacagtgcatattaaaagcatgatacaaatggaaatttaaaattttgtattaggaagcccagtttgctaaaagtagcattaatatcattcacatcagattttaatttgttacacatttttgtagttcagcaaaggcccctatgatgaaaaacaattaaaaagtgttatgacaaaaataattatctgtgtaaaaagggggagacccaaaagatttttcatatggttatttaattcagttaaatagaactgttatgaatttgagaggaatgaagatattcaaacactaacagaaaatcattagccttatattagagcattcaaatgcttatgtaactcttcaatccatctggcttcataaaaaccaaaattttgaacacaaaaaagtggcagagtttacattaccttttgtatgttcctaagtatgaaattgcatcaatttattatgaattaaatttgaaaagcatcacagatttaaaaacaaagtacaaaagagcctgattctttttaattccacaaatacctagcatctcaaagtaacatgtaaacaaacttctatgctgctcaatgaatccttccaatttcgataataaactaaatagtattggatctagtatatgactttcatgtgtaagttatggttctatccattactttaacaatattactgatgtaacagagaaaaattttcaactattgtatttatttaaaacaaactgacaagttcaagcacctgtcttcagaaaagccagcagcatttttttttttttaacatactcaaagtaagatttggcctaagcccttaatacctttctgaacagccatgcaactaaacaccctcaggagatgttacataagggagagaagaacatggagcaatttgcactttttcccctagataatattaacaaggtaaagcaaatccagatctttatgaatgaatggctgtcatgtttaatacacttggagctctataaaactagagccactatcatatatgtttatatagatatatatgtatttttaataaagtctctcacttgcttcaaaatttaaggatgatctttttcctggtcagtcatttcaagggaacaataaataaagtagaaaaggatgaactgttttgcatatttctgtggaagaacggaaaacatactttgagaggttcggaaaatncactgtacagaatgaacagcttatatacactatctgtgc

SEQ ID NO: 639367 - DNA, 2681 bp, Homo sapiens
  misc_feature (2642)..(2642): n is a, c, g, or t
taagacaggtcattttaaggacaaaaaatatagtcagctctactttatcaaattagttatgtttctagaaatcaaatgtcattagagaatgcattacaaaaacagtagcttaagtaggacaaaaagagtttcagacttaacattgtatgtaggaatttcaataataatggactcttaaaaattcactagtacaacgaataaattcagcttttgattatattttgtttttactaaaaatcactagttatgatttaagagaactgtcaaaatagctgagttacacgtgataatgttctttcctttctgcacatgatgttagtttggtacaagttctaaacagcaaccaagttattaccagaagtagtccatatattgtaatcttgatgattgaagtgttacgttcactttgggtgttaactctcactgttgaagaagtgaccattattttaagatgatttacttcctgacttaaatataatatagcagtagatctttgagacaatgcttttttaatattgtcttctttaatcttttttattatgtttgggctctttgtgtttttgacaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacaggagcctgattccccacgtgtcacattggtccgtgacgtttccccactaagggtgagacccattactgagaacaaaccccaggaatcccttacattctccttcccgtgcagcccccacctgattgttcttgtgtggattccagagctgactgctggattgagatgcttatttccccacgtacatgtatatcaaaggttctgtgtagcctcacctagtgcatcgtaatttcttacttgagggagaccagcaccctgaaaacgaactggaaagctgccttcttcagtcaaatctgctaaatcatacctacaatgaatgatattcaataacttctgtcatggcaaaatttatacagcagtggtaccatttgtaattctaatacttaactcttttatggtatacgcagtcctttttgaaggccagtttccctctatcacataacctgtcacatacattagaattttttttttaattctttaggcttgaaaattaccagagtgttcataataaggatttggaaaaggagtctattcaaccaagcagatctctgcctttctttcgtctttactatgaattctgaataaaatggagaacacactctcaatatgtagaaaaataaaattttggcaaaacaataattactgtttttctgtatgtacttagcagtgaaatatttataggcaacagattttaagaagtcagttccatggctattaaaaaatgtttaagttaatgaaatttacagtgcatattaaaagcatgatacaaatggaaatttaaaattttgtattaggaagcccagtttgctaaaagtagcattaatatcattcacatcagattttaatttgttacacatttttgtagttcagcaaaggcccctatgatgaaaaacaattaaaaagtgttatgacaaaaataattatctgtgtaaaaagggggagacccaaaagatttttcatatggttatttaattcagttaaatagaactgttatgaatttgagaggaatgaagatattcaaacactaacagaaaatcattagccttatattagagcattcaaatgcttatgtaactcttcaatccatctggcttcataaaaaccaaaattttgaacacaaaaaagtggcagagtttacattaccttttgtatgttcctaagtatgaaattgcatcaatttattatgaattaaatttgaaaagcatcacagatttaaaaacaaagtacaaaagagcctgattctttttaattccacaaatacctagcatctcaaagtaacatgtaaacaaacttctatgctgctcaatgaatccttccaatttcgataataaactaaatagtattggatctagtatatgactttcatgtgtaagttatggttctatccattactttaacaatattactgatgtaacagagaaaaattttcaactattgtatttatttaaaacaaactgacaagttcaagcacctgtcttcagaaaagccagcagcatttttttttttttaacatactcaaagtaagatttggcctaagcccttaatacctttctgaacagccatgcaactaaacaccctcaggagatgttacataagggagagaagaacatggagcaatttgcactttttcccctagataatattaacaaggtaaagcaaatccagatctttatgaatgaatggctgtcatgtttaatacacttggagctctataaaactagagccactatcatatatgtttatatagatatatatgtatttttaataaagtctctcacttgcttcaaaatttaaggatgatctttttcctggtcagtcatttcaagggaacaataaataaagtagaaaaggatgaactgttttgcatatttctgtggaagaacggaaaacatactttgagaggttcggaaaatncactgtacagaatgaacagcttatatacactatctgtgc

SEQ ID NO: 639368 - DNA, 240 bp, Homo sapiens
cgctagtcctgtcagtatctgtggtgacttcagcttagacagtcttcatttccagccatgtgagtcctggctccagagccatctctgagactcgtactactggatgtttaactatcagatcattcaccaccatatgcctcccacaggccaacgggaaaacagacaccagaacttgggttgagggcactaccagaatgacactggtcagtatcagaccgcggcctgggtaccgagctcgca

SEQ ID NO: 639369 - DNA, 2709 bp, Homo sapiens
  misc_feature (2670)..(2670): n is a, c, g, or t
tagaaatcaaatgtcattagtgaatgcattacaaaaacataactaatttgataaaatatagtcagctctactttatcaaattagttatgtttctagaaatcaaatgtcattagagaatgcattacaaaaacagtagcttaagtaggacaaaaagagtttcagacttaacattgtatgtaggaatttcaataataatggactcttaaaaattcactagtacaacgaataaattcagcttttgattatattttgtttttactaaaaatcactagttatgatttaagagaactgtcaaaatagctgagttacacgtgataatgttctttcctttctgcacatgatgttagtttggtacaagttctaaacagcaaccaagttattaccagaagtagtccatatattgtaatcttgatgattgaagtgttacgttcactttgggtgttaactctcactgttgaagaagtgaccattattttaagatgatttacttcctgacttaaatataatatagcagtagatctttgagacaatgcttttttaatattgtcttctttaatcttttttattatgtttgggctctttgtgtttttgacaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacaggagcctgattccccacgtgtcacattggtccgtgacgtttccccactaagggtgagacccattactgagaacaaaccccaggaatcccttacattctccttcccgtgcagcccccacctgattgttcttgtgtggattccagagctgactgctggattgagatgcttatttccccacgtacatgtatatcaaaggttctgtgtagcctcacctagtgcatcgtaatttcttacttgagggagaccagcaccctgaaaacgaactggaaagctgccttcttcagtcaaatctgctaaatcatacctacaatgaatgatattcaataacttctgtcatggcaaaatttatacagcagtggtaccatttgtaattctaatacttaactcttttatggtatacgcagtcctttttgaaggccagtttccctctatcacataacctgtcacatacattagaattttttttttaattctttaggcttgaaaattaccagagtgttcataataaggatttggaaaaggagtctattcaaccaagcagatctctgcctttctttcgtctttactatgaattctgaataaaatggagaacacactctcaatatgtagaaaaataaaattttggcaaaacaataattactgtttttctgtatgtacttagcagtgaaatatttataggcaacagattttaagaagtcagttccatggctattaaaaaatgtttaagttaatgaaatttacagtgcatattaaaagcatgatacaaatggaaatttaaaattttgtattaggaagcccagtttgctaaaagtagcattaatatcattcacatcagattttaatttgttacacatttttgtagttcagcaaaggcccctatgatgaaaaacaattaaaaagtgttatgacaaaaataattatctgtgtaaaaagggggagacccaaaagatttttcatatggttatttaattcagttaaatagaactgttatgaatttgagaggaatgaagatattcaaacactaacagaaaatcattagccttatattagagcattcaaatgcttatgtaactcttcaatccatctggcttcataaaaaccaaaattttgaacacaaaaaagtggcagagtttacattaccttttgtatgttcctaagtatgaaattgcatcaatttattatgaattaaatttgaaaagcatcacagatttaaaaacaaagtacaaaagagcctgattctttttaattccacaaatacctagcatctcaaagtaacatgtaaacaaacttctatgctgctcaatgaatccttccaatttcgataataaactaaatagtattggatctagtatatgactttcatgtgtaagttatggttctatccattactttaacaatattactgatgtaacagagaaaaattttcaactattgtatttatttaaaacaaactgacaagttcaagcacctgtcttcagaaaagccagcagcatttttttttttttaacatactcaaagtaagatttggcctaagcccttaatacctttctgaacagccatgcaactaaacaccctcaggagatgttacataagggagagaagaacatggagcaatttgcactttttcccctagataatattaacaaggtaaagcaaatccagatctttatgaatgaatggctgtcatgtttaatacacttggagctctataaaactagagccactatcatatatgtttatatagatatatatgtatttttaataaagtctctcacttgcttcaaaatttaaggatgatctttttcctggtcagtcatttcaagggaacaataaataaagtagaaaaggatgaactgttttgcatatttctgtggaagaacggaaaacatactttgagaggttcggaaaatncactgtacagaatgaacagcttatatacactatctgtgc

SEQ ID NO: 639370 - DNA, 2517 bp, Homo sapiens
  misc_feature (2478)..(2478): n is a, c, g, or t
tgtagattttggtaactgccaccataatcaagatacagacctgttccgtcatcacaaagatccccagtgctgtccctttacagtcacacccatctacctcctcctctcccccacccatccctaactctgacagcactaatctgttctccataattttgttatttcaacaatgttatacaaatggaatcatacagtgagaccctgtgatactttttttcactcaacataattcccttgagacctaagttctatcaatagtttgtttctttttacagttgactagtatttcattttatgggcataccatatcaaccatatgctgaggggcatttaggttattcctgatttttagctattacaaataaagctgctatgagcattatatgcaggtttttatgtctacatagattttatctctctgggatacatgcccaggagtgtggctcctgggtccttttatcttcatttttcccctttactctctgagggttaggtttcttctgcaagacatggtgccttcccaagattctgattctgtgcactaagtctcttccatttgacttcccaggagcctgattccccacgtgtcacattggtccgtgacgtttccccactaagggtgagacccattactgagaacaaaccccaggaatcccttacattctccttcccgtgcagcccccacctgattgttcttgtgtggattccagagctgactgctggattgagatgcttatttccccacgtacatgtatatcaaaggttctgtgtagcctcacctagtgcatcgtaatttcttacttgagggagaccagcaccctgaaaacgaactggaaagctgccttcttcagtcaaatctgctaaatcatacctacaatgaatgatattcaataacttctgtcatggcaaaatttatacagcagtggtaccatttgtaattctaatacttaactcttttatggtatacgcagtcctttttgaaggccagtttccctctatcacataacctgtcacatacattagaattttttttttaattctttaggcttgaaaattaccagagtgttcataataaggatttggaaaaggagtctattcaaccaagcagatctctgcctttctttcgtctttactatgaattctgaataaaatggagaacacactctcaatatgtagaaaaataaaattttggcaaaacaataattactgtttttctgtatgtacttagcagtgaaatatttataggcaacagattttaagaagtcagttccatggctattaaaaaatgtttaagttaatgaaatttacagtgcatattaaaagcatgatacaaatggaaatttaaaattttgtattaggaagcccagtttgctaaaagtagcattaatatcattcacatcagattttaatttgttacacatttttgtagttcagcaaaggcccctatgatgaaaaacaattaaaaagtgttatgacaaaaataattatctgtgtaaaaagggggagacccaaaagatttttcatatggttatttaattcagttaaatagaactgttatgaatttgagaggaatgaagatattcaaacactaacagaaaatcattagccttatattagagcattcaaatgcttatgtaactcttcaatccatctggcttcataaaaaccaaaattttgaacacaaaaaagtggcagagtttacattaccttttgtatgttcctaagtatgaaattgcatcaatttattatgaattaaatttgaaaagcatcacagatttaaaaacaaagtacaaaagagcctgattctttttaattccacaaatacctagcatctcaaagtaacatgtaaacaaacttctatgctgctcaatgaatccttccaatttcgataataaactaaatagtattggatctagtatatgactttcatgtgtaagttatggttctatccattactttaacaatattactgatgtaacagagaaaaattttcaactattgtatttatttaaaacaaactgacaagttcaagcacctgtcttcagaaaagccagcagcatttttttttttttaacatactcaaagtaagatttggcctaagcccttaatacctttctgaacagccatgcaactaaacaccctcaggagatgttacataagggagagaagaacatggagcaatttgcactttttcccctagataatattaacaaggtaaagcaaatccagatctttatgaatgaatggctgtcatgtttaatacacttggagctctataaaactagagccactatcatatatgtttatatagatatatatgtatttttaataaagtctctcacttgcttcaaaatttaaggatgatctttttcctggtcagtcatttcaagggaacaataaataaagtagaaaaggatgaactgttttgcatatttctgtggaagaacggaaaacatactttgagaggttcggaaaatncactgtacagaatgaacagcttatatacactatctgtgc

SEQ ID NO: 639371 - DNA, 246 bp, Homo sapiens
ctagaggatcccgtcacacgccgaagaacagactgatgatacctcacatgttgaccggctatgtgaactgcctatttcctatgctggggtttcggcgtgtgcatgcacacgccgaagtatccacactacatgaggttaccctgaggtcggtgtggacgaagttgttgcgcaacaacttcgtccactcagatctgcaacaacttcgtccattgtgacctttctgcgagtgtggagtctcggcgtgtg

SEQ ID NO: 639372 - DNA, 1833 bp, Homo sapiens
  misc_feature (1794)..(1794): n is a, c, g, or t
ggatatctataattgggtatgaaaagtggaagaccctgatgaattctccaaaacaaagctggttttgtctcttgtagggttctgtgtagcctcacctagtgcatcgtaatttcttacttgagggagaccagcaccctgaaaacgaactggaaagctgccttcttcagtcaaatctgctaaatcatacctacaatgaatgatattcaataacttctgtcatggcaaaatttatacagcagtggtaccatttgtaattctaatacttaactcttttatggtatacgcagtcctttttgaaggccagtttccctctatcacataacctgtcacatacattagaattttttttttaattctttaggcttgaaaattaccagagtgttcataataaggatttggaaaaggagtctattcaaccaagcagatctctgcctttctttcgtctttactatgaattctgaataaaatggagaacacactctcaatatgtagaaaaataaaattttggcaaaacaataattactgtttttctgtatgtacttagcagtgaaatatttataggcaacagattttaagaagtcagttccatggctattaaaaaatgtttaagttaatgaaatttacagtgcatattaaaagcatgatacaaatggaaatttaaaattttgtattaggaagcccagtttgctaaaagtagcattaatatcattcacatcagattttaatttgttacacatttttgtagttcagcaaaggcccctatgatgaaaaacaattaaaaagtgttatgacaaaaataattatctgtgtaaaaagggggagacccaaaagatttttcatatggttatttaattcagttaaatagaactgttatgaatttgagaggaatgaagatattcaaacactaacagaaaatcattagccttatattagagcattcaaatgcttatgtaactcttcaatccatctggcttcataaaaaccaaaattttgaacacaaaaaagtggcagagtttacattaccttttgtatgttcctaagtatgaaattgcatcaatttattatgaattaaatttgaaaagcatcacagatttaaaaacaaagtacaaaagagcctgattctttttaattccacaaatacctagcatctcaaagtaacatgtaaacaaacttctatgctgctcaatgaatccttccaatttcgataataaactaaatagtattggatctagtatatgactttcatgtgtaagttatggttctatccattactttaacaatattactgatgtaacagagaaaaattttcaactattgtatttatttaaaacaaactgacaagttcaagcacctgtcttcagaaaagccagcagcatttttttttttttaacatactcaaagtaagatttggcctaagcccttaatacctttctgaacagccatgcaactaaacaccctcaggagatgttacataagggagagaagaacatggagcaatttgcactttttcccctagataatattaacaaggtaaagcaaatccagatctttatgaatgaatggctgtcatgtttaatacacttggagctctataaaactagagccactatcatatatgtttatatagatatatatgtatttttaataaagtctctcacttgcttcaaaatttaaggatgatctttttcctggtcagtcatttcaagggaacaataaataaagtagaaaaggatgaactgttttgcatatttctgtggaagaacggaaaacatactttgagaggttcggaaaatncactgtacagaatgaacagcttatatacactatctgtgc

SEQ ID NO: 639373 - DNA, 199 bp, Homo sapiens
ctctgatctggtacatcagtcacttgcattctgggatggatttgtcaattcattaattaccgaacagaaattgacaaaccatcccagatcaagtaccgatgttcaggacaacagcattagtgtcaagtggctagcctatcaagattcccctgattactaggttacagcagtaaccacgcacacccaaacaatggaccac

SEQ ID NO: 639374 - DNA, 133 bp, Homo sapiens
gcgatctagaggatcccaaactcgtttctgtgcagtttacgtaaacttctcccttctgctataaaagcttctctttagcctccgtcaccaaacgcacttgtgtggtgccattccattcatcctggactataat

SEQ ID NO: 639375 - DNA, 158 bp, Homo sapiens
tgtgtggtgactctaaggatccaacgcgctgatacctcgcggatcttcccttctgtggtggcgaaaacaagctttgaaatggacagagaggaccgacagggactccagggcttattgaatcccgatcttaagaatgttaattataacaaaaaggtgtt

SEQ ID NO: 639376 - DNA, 132 bp, Homo sapiens
taaatgagcagaccaactcaaaaatagagaaaacagagaatatggaagtaactgatggtgacgacaaggaggtaaaagttaaagtaggtaatataacagaatctaacagataagtcagaagaaatagaaaca

SEQ ID NO: 639377 - DNA, 553 bp, Homo sapiens
ctgcgataatcagcacaggaaaaagatgtgagctggaaggctaaggctaagcatgactctcctattacacgttggtctgcctgcttcatattttctggcagctgattagatcgtgcccaacagatgacgggtggatctgcctaccccagtccactgactcaaatgtaaatctcttattggcaacatcctcacaggcccacccagggttaatactttgtgtccttcaatctactcaagtcgacactcagtattaaccatcacacatatgttgtagttcagcaaactgtgccagcaagggacaatatagctatttaaagaaacacagtaatgctatcatttagaacctcaacctgattggcgtccctggatcatagctcggcttcccctctctcaagtttacaagagcgttgtctgggaaaattcatcaacaaggttagaaatgagttctgggaaacttggctcactatagtccaggaaccaggccgaactacagcatgggccaggtactgaataaatggaaggagtatagttagggcagtaggtggctctaaac

SEQ ID NO: 639378 - DNA, 382 bp, Homo sapiens
  misc_feature (11)..(11): n is a, c, g, or t
  misc_feature (167)..(169): n is a, c, g, or t
  misc_feature (188)..(188): n is a, c, g, or t
  misc_feature (221)..(221): n is a, c, g, or t
  misc_feature (380)..(380): n is a, c, g, or t
ggggggggggngggggggggggggggggggggggggggggggggggggggggggggggggggggggggggggggggggggggggggggggggggggggggggggggggggggggggggggggggggggggggggggggggggggggtgggggggggggggggggggnnnggggggggggggggggggnggggggggggggggggggctgtggggggggggngtgggggggggggggggggggggggggggggtgggggggggggctggcgggggggcggcggggcggccgggggggctggggggggggcgtgtctgcctggggggagtgtgtggctgtggtgggttgggatagggtgggatgcgaggcgggggtggttgngg

SEQ ID NO: 639379 - DNA, 822 bp, Homo sapiens
tactttccttttttcctttctgggaggcatcacatgctgggggctggggtctttatgaatggttttaaccattttcatgggtgggaaagaatttaatattctatcgcagttggtacaattattatattttttctggcaaggaaaagggtgtaagtgtattgaaattaaacacaaagttcacttgtgtgttggaaaattaaatctttaattgtggaacttttataaaagagcaagtgcagataccccaatagacgtgggtgttaaagtgtgggtctacaggtggcaaaactccagtgtgtctcataacattatgtgttacaataagtgtgccgaggagttcacaggtgccccatgggtggactcttgggtattccagtctcaggtttaaaacacagcgggacaataaagagaagtggaacacttataaaaacaaaaaaaaagaaaaaaataaaaacaaaaagaaaaaaagaaaaaacaagaggaggagcgcgccgccccaaaaagacaccccacgaaggggccgccacagcagcaggacgcaccacagcggagagagaaggcgaagagacgagaggggcagcacagaagaggagagagcgtcagaaaaagaaagaggagggcgccagcggcgacgcatgactaaaacagcagggcgaccgagaagacgacaaccacagcaaagagccgagagaacacaacaggcgaggagagagcaaacacaccgcctatgcgggggagaaagagaaaagaggagcgaccaccacccacacgacagaaacagaagggccagcagggcaaaaaaagaactgagggcggaacaag

SEQ ID NO: 639380 - DNA, 803 bp, Homo sapiens
cgcagtggctcacgcctgtaatcccagcatttgggaggctgaggtgggtggatcacgaggtcaggagttcaagaccagtctggtcaagatggtgaaactctgtctctaccaaaaatacaaaaaattaatcaggtatggtggcaggcgcctgtaatcccagctattcgggaggctgaggcagagaattgcttgaacccaggagacggaggttgcagtgagccaagatcatgccactgcaactccagcctgaacgacagagtgagactccgtctcaaaaaaaaaaaaaagagggccaggcacgggggcctcacaccctgtaatccaagcatgttgggaggccaagggtaatgtggatacctgagggtctggagttgggagacccagcatggccaacattgtgattaccccattctctactaaaaatatacaaaatttagcccaggtgtggtggtacaaacctgtagtcccagctacttcaggaggctgaggaccaagagttgctttggccctggagacggaggtggggtgagccaagattccgcaccatgtgcgctcccaggcctggcaccaacaaggagtgaacttccctccgaaaaaaagcaacaacaagaaacaaaactttgggcgccgccagcggccgggaaaaggtctaaaaccactggggggcgcgggcccaaaggatatggacctgggccaaagggggccaagagcaccgggccaacatagtggggttcccccaaaaaaccggggcccgggcgttgaaccagggccggctcgctcaagagccggcacccccggcgggt

SEQ ID NO: 639381 - DNA, 976 bp, Homo sapiens
  misc_feature (36)..(36): n is a, c, g, or t
  misc_feature (73)..(73): n is a, c, g, or t
  misc_feature (98)..(98): n is a, c, g, or t
  misc_feature (121)..(121): n is a, c, g, or t
  misc_feature (162)..(163): n is a, c, g, or t
  misc_feature (170)..(170): n is a, c, g, or t
  misc_feature (177)..(177): n is a, c, g, or t
  misc_feature (191)..(191): n is a, c, g, or t
  misc_feature (193)..(193): n is a, c, g, or t
  misc_feature (198)..(198): n is a, c, g, or t
  misc_feature (207)..(207): n is a, c, g, or t
  misc_feature (215)..(215): n is a, c, g, or t
  misc_feature (225)..(225): n is a, c, g, or t
  misc_feature (282)..(282): n is a, c, g, or t
  misc_feature (291)..(291): n is a, c, g, or t
  misc_feature (308)..(308): n is a, c, g, or t
  misc_feature (314)..(314): n is a, c, g, or t
  misc_feature (345)..(345): n is a, c, g, or t
  misc_feature (352)..(352): n is a, c, g, or t
  misc_feature (416)..(416): n is a, c, g, or t
  misc_feature (431)..(432): n is a, c, g, or t
  misc_feature (473)..(473): n is a, c, g, or t
  misc_feature (477)..(477): n is a, c, g, or t
  misc_feature (488)..(488): n is a, c, g, or t
  misc_feature (514)..(514): n is a, c, g, or t
  misc_feature (561)..(561): n is a, c, g, or t
  misc_feature (564)..(564): n is a, c, g, or t
  misc_feature (630)..(630): n is a, c, g, or t
  misc_feature (632)..(633): n is a, c, g, or t
  misc_feature (637)..(637): n is a, c, g, or t
  misc_feature (656)..(656): n is a, c, g, or t
  misc_feature (674)..(674): n is a, c, g, or t
  misc_feature (931)..(931): n is a, c, g, or t
tggtgggcggtccttcctgtgactcgacccttgtantgatagttctttttgtttgcctccggtactgtgaggnaaggacacgactctttggtgaggtntgatggacatacattatctgagnaaagaaactaccaggtgacaaacagcatgtttggtgcttcnngaaagangtttgtngagggggtcgacantnactancatgacganaacatgtnctacagccantcttctatgtttccacatcggtcagaaaaagatatgctggcatcaccatctacatcnggtcagctntctcagtttggggcaantttatncgggcaacaaagtgcactaggccttccaatnagggggntgagcaacaatacccctcagttaaatcgcagcttatcacaatgtgcatctcttgtttccgttcnatcgtcacgccaacnncaggggtaccaacaatgtcacttcacacgcctccatctccnagcnggggtattttncctttttttcctaggaatatgatganccactcccaggttggtcagggcattggaattcctagcaggacaaatngcntgagcagttcagggttaggtagctccaacagaagctcgccaagcataatatgtatgccaaagcagntnntttntttttttttttttactgtnaacagtatgtctggattnggaatgaacaggaatcaggcatttggaatgaataactccttatcaagtaacatttttaatggaacagacggaagtgaaaatgtgacaggattggacctttcagatttcccagcattagcagaccgagacaggagggaaggaagtggtaaccaactccattaataaaccccttggctggaagagctccttatgttggaatggtaacaaagccagcaaatgagcaatcccaggacttctcaatacacaatgaagatttncagcattaccaggctcagctataaagatccacatcagtaatgatg

SEQ ID NO: 639382 - DNA, 148 bp, Homo sapiens
cgctcggacgaggactacctgtaccggtaggacgctgccgcagttccacagggacggtgcgctcacccacgctcaacgtggccttctcccgggagcagtcccacaaggtctacgttccagcacctgctaatagcaacgaccgatagca

SEQ ID NO: 639383 - DNA, 339 bp, Homo sapiens
agcctagaggatccccgctctctctgtggggcaggtggccaggaagaggagtggtggggcggctcaagtcttggttggcagagtccgacctctcaccaccaataccagattatccgggggtagggtttaacacgcagatctgtgactccactccggagccgggttctcgggggatgcaacccttaaattggcgttttttaatgaccctccctctgatttaagtacggggatacggctgaccgggtgctgcctggccaccctttacatgctgtgtcattggggttaagacattggacaacttactaatcttctgactatgtgtccccacagagagagcgt

SEQ ID NO: 639384 - DNA, 285 bp, Homo sapiens
  misc_feature (1)..(1): n is a, c, g, or t
  misc_feature (11)..(11): n is a, c, g, or t
  misc_feature (19)..(19): n is a, c, g, or t
  misc_feature (32)..(32): n is a, c, g, or t
  misc_feature (44)..(44): n is a, c, g, or t
  misc_feature (47)..(47): n is a, c, g, or t
  misc_feature (50)..(50): n is a, c, g, or t
  misc_feature (54)..(54): n is a, c, g, or t
  misc_feature (76)..(76): n is a, c, g, or t
  misc_feature (104)..(104): n is a, c, g, or t
  misc_feature (156)..(156): n is a, c, g, or t
  misc_feature (158)..(158): n is a, c, g, or t
  misc_feature (163)..(163): n is a, c, g, or t
  misc_feature (169)..(169): n is a, c, g, or t
  misc_feature (171)..(171): n is a, c, g, or t
  misc_feature (178)..(178): n is a, c, g, or t
  misc_feature (191)..(191): n is a, c, g, or t
  misc_feature (196)..(196): n is a, c, g, or t
  misc_feature (213)..(213): n is a, c, g, or t
  misc_feature (216)..(216): n is a, c, g, or t
  misc_feature (232)..(232): n is a, c, g, or t
  misc_feature (235)..(237): n is a, c, g, or t
  misc_feature (242)..(242): n is a, c, g, or t
  misc_feature (257)..(257): n is a, c, g, or t
  misc_feature (278)..(278): n is a, c, g, or t
naaaaaaaaantttaaaanggggaaaaaaaanagggaaaaaaanttnggnaaanaggtttaaaaaaaaaaaaaaanaaaaaaaaaaaaaaaaaaaaaaaaaggnaaaaagaaaaaaaaaaaaaaaaagggggcaaaaaaaaaatctcctttccttnanaaggnttaaanangaaatgnaaaaaaaaaaaanttttnaaaaaaaaaaaaaaaanggnaaaaaaaaaaaaaaanatnnnaaaanggccttcaaaaaaanaaaaaaaggggggggggaggnaaaaggg

SEQ ID NO: 639385 - DNA, 102 bp, Homo sapiens
atctaaggcgtgggtaagaactgcattcttgcattcttgcattaaaaaatattctttttaccgcaatttagtaatgaagacctaacagtagcaaaacttgaa

SEQ ID NO: 639386 - DNA, 139 bp, Homo sapiens
aagatcacaccactgcactccagtctgggcgacagggcaagattccatctcatacaaacaaacaaacaaacaaaaaacaggatgtactactattttgatgtctacaacatctaggaccgcaaaaaaaaaacacctggag

SEQ ID NO: 639387 - DNA, 904 bp, Homo sapiens
gcggcagctggagtaggagtgctgatgggcaagactgcggtcggccggcacagccgcggtagtgctaggcaagcccacggagtcacgccggcctcagccagtctgcgaacctctcgcccccgccacccctgatccgccggcccctgccgccgagtggtccggggaggcctaatctgcaccaccgccgggctcctggggcacgcgacccgaagcggaacatgtcggcagtccgcggaccgcgcacccggacccatggcccgatcgcgcgaccggacaacatgatgagaggagatcgacaggtaccaggacgccacaacgccgcctccatctctgacggagaatgtgaagacccgggaggagaagcagacgggagcttggccggaagggatccctgcaaaaatggaaagatgggtagacatgaaacaccaggaaacccaagacagacacaacgcaatgggccggaacaaggtggatggacgaccaaaacggctacccaccaacatggacaagcagcacctgaagagaagccacagacagcaccagacaaggaagcagctgatgactagaccagctgacatactccaacaccgggaaaacgccgctagagcgatcaaaacaagctaagaagcgacagggtgcaggaaggtacaggtaagaagcatacccgacacgacgaccacaccaaatcccaaaagacaggacaccagagcacggcgcaggcaaagaccacgccgacacacaaagaggagcgaacgaaaacgcgcagcgaaagacagcaagcagcgcaaccaaggcggagccagcaacaaaacacaaagataaacagcgccagcaccgccagagagcagcacacgacaacagaaaagaagatacaaagaaaaaaaaacaaaaagaaaacgacaga

SEQ ID NO: 639388 - DNA, 2751 bp, Homo sapiens
taagacaggtcattttaaggacaaaaaatatagtcagctctactttatcaaattagttatgtttctagaaatcaaatgtcattagagaatgcattacaaaaacagtagcttaagtaggacaaaaagagtttcagacttaacattgtatgtaggaatttcaataataatggactcttaaaaattcactagtacaacgaataaattcagcttttgattatattttgtttttactaaaaatcactagttatgatttaagagaactgtcaaaatagctgagttacacgtgataatgttctttcctttctgcacatgatgttagtttggtacaagttctaaacagcaaccaagttattaccagaagtagtccatatattgtaatcttgatgattgaagtgttacgttcactttgggtgttaactctcactgttgaagaagtgaccattattttaagatgatttacttcctgacttaaatataatatagcagtagatctttgagacaatgcttttttaatattgtcttctttaatcttttttattatgtttgggctctttgtgtttttgacaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattctaaacttaatatatgaactataactgttctacggctttttaaatgttgtgaccatttaaccgtgtaaatataaaatattctaggcttcttcacaaataatagggtaaaataaataatcgccataagagtggtagaaataaatctccatggctcaggcaaagagattattttgcatcctggataccagcaatgcaaaatggtatgagatttctaaggattgatcacattgggatgggagatcaagcaaagaaatatttgtagaggaggggaaatggatctataggggatatacagggggatggattttcaaattggattgattctaagttgaaatcttgaagagaaggtgtggtgacagtggttaggatgttgtgggttcctgacataaagtagttaaatgatatatcttggagctaacctgtgtaagtaaagaactaagtaaggagatgactaaaaatggagtagtttccttttttatttttttgagacagagtctcactttgtttcccaggctggtgtgcagtggcacaatctcggcccactgcagcctccgcctcccgggttcaagtgattctcctgccttagcctcctgagtggctgggattacagggttgtaccaccacactcggctaacttttgtatttttggtagagatggggttttgccatgttggctaggctggtctcaaactcctggcctcaagtgatctgcccgccttggcctcccaaattgctgggattacaggcgtgagccaccgcacctggccagtttactttaaatgtggtgtagtctcatggtaaactgaatttgtcatcagatgcaaagttctattccctaatggaatggaaggaacacaaaacttaagagtgaaatggaatactaagatgtttttaaataggcaggactatgctactcacttgaggctggagtgccaccactgcaaaatctttttaagttttgtaaaaaggagcatcttgaatccacttagataaagagagactgtgtgtgtaggtggatttttcccaaaggatttgggaattgtaatgttacaatgaactgtatggatatgtttgtcatgtacattttcaaacaaaaaggaaaactgaaagtagtgatctttgtatacccatctcttagattcagtgattttgctatataggttgtgtatcccttatctgaaatacttgggactagtagaagcatcttggatttgggatgtttttccaaattttggaatacctgcatacacacaataagatatcttggagatgggacccaagtttaaacacaaattcacttgtttcatatataccttatgcacatagcttgaaggtaactttatataacattatttttaataattttgtgcattgagaccaagtttgcataccttgaaccatcagaaagcaaaggtgtcattatctcagccactcatgtgggtaatttgtggttggttgatgtcaccatcattcctgactgaatgtatatgctaccaataagcagttattttcttatacttattcatgcataagtacttaacagtaaaaaatatgacataactcgcacaggaacaaggatggcaaaaaaaaaaatatgacacaccactgatacagtgaaaaaataatgtggtcagggtagctaggcaacagtagcatcaccagaaacctgtatcagctgttaaacggcaacaacaatggcaggctttcagtttcccacttaatgatgctgtattttaaaaggttattgtatactgtaattttatttttgtaggtgaagagaaacagaagcagctgaagggccaggaagtgggtctttctagggatgtggcattctgctggatggctttttaaaatgggttttttcctttagggagaccgaataaactgtgttgtgcacctgcaaaaaaaaaa

SEQ ID NO: 639389 - DNA, 2395 bp, Homo sapiens
ggtcgacgcataatattgttgaaaacaagtgtgttcatttcaagtgtaaattgattgacatttatatttctatataggaaataatttagttactatcaccaggtggatgttacgggttgcctgctacaatgcagaattattcctgtttgacacacatggcagatcgagttaacatttctaaaacataaaagtcatgggatgtgtactaaagtggaagagctgagagtctcatctggtcactgtcaagacattttattgttataatgtcctatctggtttttggaaactcttagaaaccccactttataaacttaaatttcacaagttagtctcttagctctcctgtttacttataacatgtatttttccattttagatacagacagaagctgctcagttgcttacaagtttcagtgagaagaattgagaacttttcagagaagatttatgaaatagctaataaacattgccttttcttttaattctaaacttaatatatgaactataactgttctacggctttttaaatgttgtgaccatttaaccgtgtaaatataaaatattctaggcttcttcacaaataatagggtaaaataaataatcgccataagagtggtagaaataaatctccatggctcaggcaaagagattattttgcatcctggataccagcaatgcaaaatggtatgagatttctaaggattgatcacattgggatgggagatcaagcaaagaaatatttgtagaggaggggaaatggatctataggggatatacagggggatggattttcaaattggattgattctaagttgaaatcttgaagagaaggtgtggtgacagtggttaggatgttgtgggttcctgacataaagtagttaaatgatatatcttggagctaacctgtgtaagtaaagaactaagtaaggagatgactaaaaatggagtagtttccttttttatttttttgagacagagtctcactttgtttcccaggctggtgtgcagtggcacaatctcggcccactgcagcctccgcctcccgggttcaagtgattctcctgccttagcctcctgagtggctgggattacagggttgtaccaccacactcggctaacttttgtatttttggtagagatggggttttgccatgttggctaggctggtctcaaactcctggcctcaagtgatctgcccgccttggcctcccaaattgctgggattacaggcgtgagccaccgcacctggccagtttactttaaatgtggtgtagtctcatggtaaactgaatttgtcatcagatgcaaagttctattccctaatggaatggaaggaacacaaaacttaagagtgaaatggaatactaagatgtttttaaataggcaggactatgctactcacttgaggctggagtgccaccactgcaaaatctttttaagttttgtaaaaaggagcatcttgaatccacttagataaagagagactgtgtgtgtaggtggatttttcccaaaggatttgggaattgtaatgttacaatgaactgtatggatatgtttgtcatgtacattttcaaacaaaaaggaaaactgaaagtagtgatctttgtatacccatctcttagattcagtgattttgctatataggttgtgtatcccttatctgaaatacttgggactagtagaagcatcttggatttgggatgtttttccaaattttggaatacctgcatacacacaataagatatcttggagatgggacccaagtttaaacacaaattcacttgtttcatatataccttatgcacatagcttgaaggtaactttatataacattatttttaataattttgtgcattgagaccaagtttgcataccttgaaccatcagaaagcaaaggtgtcattatctcagccactcatgtgggtaatttgtggttggttgatgtcaccatcattcctgactgaatgtatatgctaccaataagcagttattttcttatacttattcatgcataagtacttaacagtaaaaaatatgacataactcgcacaggaacaaggatggcaaaaaaaaaaatatgacacaccactgatacagtgaaaaaataatgtggtcagggtagctaggcaacagtagcatcaccagaaacctgtatcagctgttaaacggcaacaacaatggcaggctttcagtttcccacttaatgatgctgtattttaaaaggttattgtatactgtaattttatttttgtaggtgaagagaaacagaagcagctgaagggccaggaagtgggtctttctagggatgtggcattctgctggatggctttttaaaatgggttttttcctttagggagaccgaataaactgtgttgtgcacctgcaaaaaaaaaa

SEQ ID NO: 639390 - DNA, 83 bp, Homo sapiens
catggatttgctggtgcagtacaactaggcttaatagggaacacactaggcgttaatagggacatgttcataattcagcagga

SEQ ID NO: 639391 - DNA, 1095 bp, Homo sapiens
gaggcggaagaggtgctgtgcaggaggcgggcgggcgcggttctttccggaaggattgaatctcctttagccccgcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattcta

SEQ ID NO: 639392 - DNA, 856 bp, Homo sapiens
  misc_feature (711)..(711): n is a, c, g, or t
taagacaggtcattttaaggacaaaaaatatagtcagctctactttatcaaattagttatgtttctagaaatcaaatgtcattagagaatgcattacaaaaacagtagcttaagtaggacaaaaagagtttcagacttaacattgtatgtaggaatttcaataataatggactcttaaaaattcactagtacaacgaataaattcagcttttgattatattttgtttttactaaaaatcactagttatgatttaagagaactgtcaaaatagctgagttacacgtgataatgttctttcctttctgcacatgatgttagtttggtacaagttctaaacagcaaccaagttattaccagaagtagtccatatattgtaatcttgatgattgaagtgttacgttcactttgggtgttaactctcactgttgaagaagtgaccattattttaagatgatttacttcctgacttaaatataatatagcagtagatctttgagacaatgcttttttaatattgtcttctttaatcttttttattatgtttgggctctttgtgtttttgacaggccttaggctactttcacagggcagaacaaggtaaggtatttttgattacacatattaatatagttaaaattgtatgaatgctgaatatatactataatagcaatgtctaaagcagttgtttattctgttatacttatttttgngctagatactgtaaaacaatttttaaagtctttattcagtaaagatcacctgaatgacaaataggctgctattgaacttagagctgcagttctggaatgtctatcatttgatggaattctgcttcctttgtgagagcagtctctg

SEQ ID NO: 639393 - DNA, 993 bp, Homo sapiens
  misc_feature (1)..(1): n is a, c, g, or t
  misc_feature (12)..(12): n is a, c, g, or t
  misc_feature (444)..(444): n is a, c, g, or t
  misc_feature (455)..(455): n is a, c, g, or t
  misc_feature (480)..(480): n is a, c, g, or t
  misc_feature (524)..(524): n is a, c, g, or t
  misc_feature (531)..(531): n is a, c, g, or t
  misc_feature (630)..(630): n is a, c, g, or t
  misc_feature (784)..(784): n is a, c, g, or t
  misc_feature (790)..(790): n is a, c, g, or t
  misc_feature (793)..(793): n is a, c, g, or t
ngttctcgagcntctcggagcatgttggctgtgctgtgcaggaggctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagtgcggcaatattagaacccaaggaaggaaaaactggcaaagttgtcatatgccaagtggccattgcctcctgaaatgaaggtaggttcacttggtctctcctaagcagaagagantgtccaggaantaaaatatttaaaaaaccattgaanatccaacaaaccccagccttgaggtgcgcatggagtgcgtgggntaagaanggaatcaagtagcagcattcagaagcagtcctgggttcatcctgatgaggtctctcattcagggagaggtggctttcccatgctgggagggaggtgganggaggcatgacttagacattggtggtggtctccttagcagcctggatgctgttcatctccatgatgccatccttcccagatctatctgcaccatgtgcctgcctttttaaaggccatgtgatatcctcaaaaagccctgccatgggtctcatgnactttngangaacggaaccggtcccccaacggggatgaaggaagctggggaagataataaaaaatacggccccaaataaaaggcgacaggggaaaaagcggccataaaagagggggcaaatggagcaccggcattggaccatggggggggccccgtgaagagtggcaaaaacgcgagggccggccctaggggcaaaaaaaagccgaaaa

SEQ ID NO: 639394 - DNA, 460 bp, Homo sapiens
ttgtcagcgtatccttaggtctcagcatagaaggagagtagagtcatgttaccctgtggtttctggggtcgaggcactgaagagtcagcacctgctcctcctgtggagtacccctggtgacagagctcagctggcagctgctcatcactaacgaatcccagccaccggcacctgctgctgcttgcggatcttgttgatgagttccatgtactggcccatggtatctactgggccgtagaccgcatcatgtctgttcccaaacactgcgggagcccctggtgtgtggctgcctagaaaactctgtaggaactcgagcagcagactccagcagtcactagctaccaaacaggagccatactccaccttggctgccaaaggtagaggcggccgtatagtaagtctcacagtccacacaaaatgttcctatgcttatctgctggaaatactttgggtaccgagc

SEQ ID NO: 639395 - DNA, 843 bp, Homo sapiens
taagacaggtcattttaaggacaaaaaatatagtcagctctactttatcaaattagttatgtttctagaaatcaaatgtcattagagaatgcattacaaaaacagtagcttaagtaggacaaaaagagtttcagacttaacattgtatgtaggaatttcaataataatggactcttaaaaattcactagtacaacgaataaattcagcttttgattatattttgtttttactaaaaatcactagttatgatttaagagaactgtcaaaatagctgagttacacgtgataatgttctttcctttctgcacatgatgttagtttggtacaagttctaaacagcaaccaagttattaccagaagtagtccatatattgtaatcttgatgattgaagtgttacgttcactttgggtgttaactctcactgttgaagaagtgaccattattttaagatgatttacttcctgacttaaatataatatagcagtagatctttgagacaatgcttttttaatattgtcttctttaatcttttttattatgtttgggctctttgtgtttttgacaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattcta

SEQ ID NO: 639396 - DNA, 323 bp, Homo sapiens
tggcggagcttaaactccaattctggcggtgcttaaatttaatctgaatggtatcattcaccttgaatgaggggatcgtggtaccggatgcgtgcggcgcactcatgatctcaccagtatgaggtgattcctttcgtgcccactaaagatctttctcacgtttgcacaacttgtacttggcctcctcaggtgtaatacgatgtacacgcaatagcgacccttggtgtcatatatcatcacgtaatatcatctcccgtcttgtcaatgctgatgacatccatgaatccagcagggtaggttatatcagttcggaccttgccatc

SEQ ID NO: 639397 - DNA, 518 bp, Homo sapiens
acgctgcaccgcgcgttcaacaattctcgtgcctagcctcctgagtagctgggactacaggcgcgtccccccacacctggctaatattggtatatgtaaagagacgggttatgccatgtatggcgaggctggcctcgaattcctgacctcaagtgatctgcccacctcagcctccccaagtgctgtgattacaggtgtgagctaccatgctcagcctataatagtgtctatctaatgtctcttaatgcggtatggtggatgacttccttatatccatcttatattaaattaggcctttttatggaggataatagaaacgttatctataataaatttggcatgtataactccagaaactattttataattttcatttttggactgggatctccatgtcttgtatgtatgatttgtgcctattttggtttgataacttcttgtttccttttttatctaatggtgcatccgtaactaccttttttaaatgtcttgtcaacgtacagctgtcttcatttgcc

SEQ ID NO: 639398 - DNA, 150 bp, Homo sapiens
ttatttgaagtgtagtggtctgctgtgcagccagaagtcctgagagctgtcttcatgggtggttcctggttggagccctgaagggagagtttctgcctttgtccacaatggccctggggggtaagtggcctgtgtggtctacccctatta

SEQ ID NO: 639399 - DNA, 830 bp, Homo sapiens
ttgtaacgccctcaaagttgtccgaaaaccagtccttgctgaggatgcccccctgggagaacatctggtcgtgggctccatctgcctgtcatgtcactccacttcctgatcctctatgtcgaacccttgcactcatcttccagatcacaccgctgaacgtgacccagtgctgatggtgctgaaaatctccttgccccgtgattctcatggatgagacgctcaagtttgtggcccgcaatacctggaacctgcaatactggagtaaccgttcctaaaccatttggcagaactgtaacgggtgtcggttgcgtgcatgtgcgtttttagccaacacatctaccaaccctgtgcatgactgatgttggggacaccacgacaacgtaaaaaacttcccaatcacttgcgtggtatgtggcggaactgtgtattaccaatggggtggtaagcttttaaatcacacatactgattacagatgtaacaactttagcttaatcagaaagctctccagagaagttggtttctttggctgcaagaggaatgaggctctgtaaccttatctaagaaccttggaacgcccgtcagccaaagtcgccacattttctctagcaacatgtcatagctttatatacatgttccgtattccattgtaaatggcgtgccttcgggttggtaagtagcaagatccctccttcaggtggacattggaccatgctacttttaattggcctgacaagttgttattataaaattccttaacaccttagggtgtgctggtcacatgtaggccccagtcaagcagaattcagggggggcgaacggtatcgcagga

SEQ ID NO: 639400 - DNA, 476 bp, Homo sapiens
  misc_feature (395)..(395): n is a, c, g, or t
  misc_feature (402)..(402): n is a, c, g, or t
  misc_feature (425)..(425): n is a, c, g, or t
gctaagctcttagcttgcattcccagcattactgatcagttctcctagctataaaatttaaaagaaactatagctttaaccatgtttctaacttatactaacaaaccatggcacagtgtgtagtaaattcctcttataattccaactaatttgccattgtaaataagtaaacatttggcttttcaaataatttcatagcagctgggcttatctgtagaatcctagcttttcttcactcttgattctaggctgttccaggaagaaaataattagggattaatacctaaaataattctccttctcaataatgtcactttgggactgatagcattatttgcattttaaaacaaaggctgggtgcagtggcttatgcctgtactctcagcactttgggnggctgangtgggaggatcgcttgagctcangagtttgaggccagcctggggaacatagtgagaccctgtctttacatttaa

SEQ ID NO: 639401 - DNA, 153 bp, Homo sapiens
  misc_feature (1)..(1): n is a, c, g, or t
naatggtcgagaattcctgcgcattgtgcagtgctggctctgtgagagggcagctgtggcttctaggtgccctgagtagcatcctgtgacccctccccgagtgtactggcactcccagtggtacctgagctctgaattctgtaatcactggtc

SEQ ID NO: 639402 - DNA, 105 bp, Homo sapiens
ggcctgtggcccaagcgtgctgtggcttcggggagttggaagttgaggcaggagccttccttacaattcgccatgagtttccttattggcttcaggatatatgta

SEQ ID NO: 639403 - DNA, 221 bp, Homo sapiens
atttttttttaaacagccccccttttgactccccgcccgccccaatccattatttttttttcccttccggggcccacccttaaagctggagtggttccttcccctcctggattccggggaacaaaggcagccccccaggaggggggggcccttttttccccggcctgggggtggtggaggaaggggggttggaccaataaacggccctttcccaatgtcca

SEQ ID NO: 639404 - DNA, 557 bp, Homo sapiens
ctcaacgctttatactttctaccagtgaggacacagtgctcctgctctctggaggatgcagtattcaaggcaccctctgggcagcagagaccaggccttcaccaaacacaaaacctactagcacctcaatcttggactcccagcctacagaactatgagaaattaaatttctgttctcaataaattatccaggctcaggtattctgttatggcagcacaaaacacactaagacacctataaaccaatctaaccatgagaaaaacaacagacaagcacagattagaggacacactataggatactgggctagtattcttcaagactgtcaaggtcatttcataatgtacatatatatcaaaacatcgagtttttttacgccttaaatatatgccatttgaatttgccaactatatcccaataaagccggaaaataaccataaggctcattaaaaactgaaacagtgatctgacatgatggggagacatgataagtaagtgcaatttagctggttagcaatttagtggtagcttggatataatcctggaacagaaaggg

SEQ ID NO: 639405 - DNA, 644 bp, Homo sapiens
ctcgggccgctcctcacgaggagggggacgccacccacctgcgccgtccttcgaggattattggcccgcgccctctcaagcgcgcccgtgtggatcgcccaccgtccttgtcgccccaaggagggccccccgggagtgtcgttcccggcgccgccgcttgcgtgcccgcgatggtcgccaatattgaagcgatcctctggcgcggatccccagaaggcgctctacgaacccccgggttttgtccagactacttccagcggcccgcggtttccttttagagccgcccccttggcgttgtcgggccagccaccgcggattcacgccaagcgcccttggtggcccccgggcgttcccgcggagtgttctggtgtccagcacaacgtgaagagggtctggagaatcctgcttgatctacgcccaccaatttattccgtcagccagcttcgtgacacccacagcagttctctcccaagaacccccacaccccttcttggtgatagagtctcccccccgtgcggcctccttagaggacttcaccacccctactgccgcgccgggccacccactgacacgagaatgagaatggcggcccaccattggggaacgctctgtcgctttaaaaaaataacccccccaacaaaaca

SEQ ID NO: 639406 - DNA, 339 bp, Homo sapiens
  misc_feature (299)..(299): n is a, c, g, or t
gctctgcaccccgtgttcttctgcagaacacggcctcctttgtgttcccagcatggcagtgagcaagagaaggctggggagaaaccggggtggccagccccctccccgtcacccccattcacagcaggactgcagcttcaagggtgtcgtggggctcgggcagaatatggggttcagggtggctgctgggggccctaggcattgcttgggagatggctcattgcgggtggctctacgtggttgaccggggccctgggaggaaggcgtctgggggctcctgcgtggcttcagtgagcgtngcagaggacaggtctacacgggccaggcgctgtttttgct

SEQ ID NO: 639407 - DNA, 167 bp, Homo sapiens
  misc_feature (83)..(84): n is a, c, g, or t
  misc_feature (86)..(86): n is a, c, g, or t
  misc_feature (165)..(165): n is a, c, g, or t
cactgcctctattagaggtgatgggctgtcgggaggggaagggcagaggtgccattgtgtcctcttgttttagtgtcacttgnntnccctggatcggcccctgagggaggggcagctggatgtgtattacaccgtgttagtgatcctctccagaaccgatcagcntg

SEQ ID NO: 639408 - DNA, 107 bp, Homo sapiens
taccggcaggttgtactgaggttagagttatcagtgtgcccagccagccatgatttcctcatctatacacctagcgaatcactaggcactggcacagtgtagcagga

SEQ ID NO: 639409 - DNA, 546 bp, Homo sapiens
attgcctgctcctagattctgcatgcgcattcacactcctttgcctgagtttaggcaaggacccaaaccaaccatcctaactttcacagaccatacaatctattgttggatccttacatatcctgctaggtatgcgggcggctttctattcatagcattgactcacaggcctctaacacattgtgtgtcctaaccctatgacaagcatgaccagggagccagctcacatgcacaccatggccaatcgatttgctttgtggggtggcctgactaccctagataatgggccgagggcctccaaagtccatcccatgcaacaaaaatctgaagagccttagtatagctctcagtgagatttcttaggttgcacacaggcacaggtgccattcatctaatggatctatctatgatctatgtgtactatcagggctacttaaccacggaccgatggacgactgttcttctagattggcactggcacctttgtgcatattgatgggagatcctgaggctcccatcgctgggctgaccttgaatcatgaaaca

SEQ ID NO: 639410 - DNA, 343 bp, Homo sapiens
tttgggttttcccccccccccccgtttttggccctggggtttaggccaaggattcagggtttttcttttttccaaagtttcccccaaaaaacaaccacccgcctttgttttttttggggggcccccccctgggcccccggggtttgggggggttcccctctggggaaaagggggggtttttccccgttttagccccccccccccgggggggttttaggaaaggcccccccttttttggggggccccctttttttaataacctttttcaaaggaataaattttttctggcgccttggggctttgtgttttttttttcctggggccctttattaaacccctttta

SEQ ID NO: 639411 - DNA, 324 bp, Homo sapiens
aaactgtgtacatcaggtatcagcatagtacccaacaggcagtattcaatcttcatcctcttcccaaactccacccataagcccgtgtctactgttcccttctttgagtccatgtgtaatcaatgtttagctcccacttataagtgagaacatgggatatttcattttctgtacctgcattaattcacttaggataagagcctcagctccatctatgttgctgtaaaggacacagtcttgttcttttttatggctgcatagtattccatggtgtatatgtaccaaattttctttatctggtctctgctgatgggagaagatgcg

SEQ ID NO: 639412 - DNA, 178 bp, Homo sapiens
tgcgcttccaaaagcaaatgataattatgttaatgtcattagtgacaaagatttgcaacattagaggaaagaggcaccaatattaaattaaaaacctaagttccaactctccaaaacttaatttgaacttaaaattattgtattaaccccttattaaactctgcttttaaaaaaaaaa

SEQ ID NO: 639413 - DNA, 1209 bp, Homo sapiens
ggcatgctgaaaacttcggcatggacagagaatcgttatgatgtgaaccgtcgacgagacacactcttcagatggctttgatactgctattggacgtcctaatggaggtaacttaggatacggacatagaaaaaaatggatggcgtacacatggaagaagatggtgacagaaaatcctagaatcatcgcaggtggataccatggatggaagttcccgtatctcgctagcagtagttttccatgtcaggtaaaaagcctaaggcactgacattgaagacaatcataccattgtagcaaatgtagaccgggacggaaacagaatgacaaagaagagaatcgcaacacaggttctggaatgctggatggatgcttcctgtcttttacaaatcctggacgtatgatgagacgaaccaaactcacaaactgaacgtccttgtaggctggcacgggtcgtcgtgcggaaatcatgcctcacgaatccctaatagtcatagtagtctctcaatgggactgcgtggactcatccaacggaaacagggctaataccacagtatggaacctctacaagcctattcgtgtgattgcccagattaggtacgcgaaacactcgttcccgttcaccagtcgcagttctaacggacactgcgcaagctgggatccagagtagtgactacacacgcgtatgtaagatacccctaaaaacacatgacgtcggctcccaccctaacaaagacacgcgtacacacagactgggacaacaaaagcggcaaaccgaaacaaggacaccaactccaacgtcctcgcgacacgttcatacatcccgcgtcagtgaagctccccacccaatactatggcgacagcttagggcaaaccattttacattagcctttctcgaaagatcccaaccttggcccaaacgcacaccctttatgattacccagtgcttaacggagaagtggccaggttggaaacacgaagtcgtgtacagtcccggcaccaaaagattccccatgctcttcccacccgggcatcggaacacgaagcgcaggacaagccaagggcaggagccatcggcactaaaacgcaagaggctgaagcaccgaacacatggcgacacagtggacaacaacggaaagcaggcgggaactggcggggaaaacaggcgcctgggcaacgaccgcacggcacaagaaggtgacgcaaagcaag

SEQ ID NO: 639414 - DNA, 116 bp, Homo sapiens
ccccccccccccaggaccttgggccgagcccctccgtgaggaacacaatttcaatggttgttgaatcctttcatatcctaaaaggaattaacccccaaataaaacatgggtggtta

SEQ ID NO: 639415 - DNA, 181 bp, Homo sapiens
atcggatgccacctctaacatggataaactgggaatagcagtacactagcaagtatctggtgaatccttagcacggacgggttaacagaaaggcttgggtaatacctacttagttaatgggaggaagtagtaaataaacattaggtaatcggcagattacttcaaaggggaaaaatctttt

SEQ ID NO: 639416 - DNA, 151 bp, Homo sapiens
gaaagggggaggggggaagtccgactaatgttggggcctgaaactatggaaaggggggtaaaatttttatattggcaaacattttttggggacttcatgggcttttttttttaatcacccatattaaatttttaataaaaaaggcccccca

SEQ ID NO: 639417 - DNA, 138 bp, Homo sapiens
gcctatctcttcactctgacctcgttgctcttggtattgcgcccccagatgctgtctccctttctccaaagagggagccagccctcctagtttccgctggtgggtaatccatattcttttggttaagtccctgtctcc

SEQ ID NO: 639418 - DNA, 171 bp, Homo sapiens
tagaggacccgggtgtggcaggttcagaccagcctgcgctgcgactcttcacagtgcaaattccccacaagcgctgcgcagccccctccctgctacctcacaggccgggatggctccaacttcttgccccttcggaccaagtcctgtggccatgcagccctcctgccacaa

SEQ ID NO: 639419 - DNA, 387 bp, Homo sapiens
agaatggattccagggaagtgtttttcttaggagtacccaagaagctcagctcaggttgggctccctgttctattctgagaactacaaatcaaattcaaaatggagcacagaaaattctcatttctagttgacttatttgtattttggtgtcctgtgccctaaatatcttctcaaggaaaccttggctttaaaagtgattgtttacttaaacaaataaaacaacaacatacaagaaaaggcagtaaatccgagcgtccatcaacaaatgaatcaaaaaacaaatgagatatatatgtacggtggcatattattcagccttaaaaaggaaagaaattttgacacatgagacaatatgaatgaaccttgaagacattaattatgctgag

SEQ ID NO: 639420 - DNA, 404 bp, Homo sapiens
  misc_feature (404)..(404): n is a, c, g, or t
aagtatgtttaaagtgatgatggaccataaaaaagttttaaatataaaacatgagaaaagaaggagatacctattcaaaaagactggcaaatttgaaaaactagaaataaaaaaaaaactcggtgggggctgtgtgcagtggctcatgcctgtaatcccagcattttgggaggccgaagcgggtggatcacctgaggtcaggagtttgagaccagcctgaacaacaaggagaaacccagtctctactgaaaacaaaattagccgggcatggtggcacatgcctgtaatgccagctactagggaggctgaggcaggagaatcgcttgaactcaggaggcagaggttgtggtgagctgagattgtgccactgctctccagcctgggcaacaagagtgaaactctgn

SEQ ID NO: 639421 - DNA, 483 bp, Homo sapiens
ggcctcccagctcgaagtgctaggatgcaggtatgaaccactatgtcctgcgtagttttcattgttgttgcaattgcgggacttagtcataaattctttgccaaggcttatgtctggaagggtatttcccaggttttcttccaggatttttatagtttttgttttacatttaagtctttaatttgtcttgcattaatttttgcatatggtgataggtagaagtccactttcattcttttggatatggttagctagtttccactgcaccatttattaggggtcttttccccattgattattttttgccaactttcttgaataacaattggttgtaggtgtgcagcttttttttctgggttctctattctgttccattggtttgtgtatctatttttgtaccagtaccatgctgttttggttactgtagcctgtagtatagtctgaagtcctggctttgttcttttttggctaggattgctttgg

SEQ ID NO: 639422 - DNA, 698 bp, Homo sapiens
  misc_feature (497)..(497): n is a, c, g, or t
  misc_feature (524)..(524): n is a, c, g, or t
  misc_feature (551)..(551): n is a, c, g, or t
  misc_feature (560)..(560): n is a, c, g, or t
  misc_feature (593)..(593): n is a, c, g, or t
  misc_feature (596)..(596): n is a, c, g, or t
  misc_feature (599)..(599): n is a, c, g, or t
  misc_feature (605)..(605): n is a, c, g, or t
  misc_feature (608)..(608): n is a, c, g, or t
  misc_feature (611)..(611): n is a, c, g, or t
  misc_feature (617)..(617): n is a, c, g, or t
  misc_feature (626)..(626): n is a, c, g, or t
  misc_feature (629)..(629): n is a, c, g, or t
  misc_feature (635)..(635): n is a, c, g, or t
  misc_feature (644)..(644): n is a, c, g, or t
  misc_feature (655)..(655): n is a, c, g, or t
  misc_feature (666)..(666): n is a, c, g, or t
  misc_feature (669)..(669): n is a, c, g, or t
  misc_feature (675)..(675): n is a, c, g, or t
  misc_feature (679)..(680): n is a, c, g, or t
  misc_feature (682)..(683): n is a, c, g, or t
  misc_feature (686)..(686): n is a, c, g, or t
  misc_feature (689)..(689): n is a, c, g, or t
  misc_feature (694)..(694): n is a, c, g, or t
tgatgcttgaaccgtggtcgagtttcagcgtgacgtcagtgcccgctttgttggacagcgtggcggtgtacgtgatctggccaccttcgttaacagcgttaggcgctgtcagcgtcacagtagtggtgttgtcggtacccggagtgtccgtaacggtggtgttcaccgcggtagtgccagggaccagattctcgaaatgctcccgccggtcacgcctttgatagcagtgtgacggtctgtcgcccttatacacgtcatcaggagcaataaccgaaacgctaccgctcgattggtttacgccgatggtgatggttttgccgttatcgagggtgacggtcaacgggttggtgatgttggtcaccggcgcgccgttcttatccacaaggctggcggtgtaaacgatgttgccgccttcacccacggtagtggtggcggtcagaactacatccaccttgtcgatggtgtcgttgatcgtggtggttgcgccgttgcctgcnacttccagtttttcgaagttgccgccngaagcgtcggtgatcttgacggtctgngtgctcttntcgatgaacacgtcatcggtaggcgcaggcacngtnacngtgccnacngtntcgccngccttgatngtnatcgangagccgttntccaacttcancgtgactcgtnccngccttnttgnncnnggncgngggtngacc

SEQ ID NO: 639423 - DNA, 321 bp, Homo sapiens
acctgtgtgtagcacaactagggtcagttttgcaggtggtagccatttaccaagatagttgtaggtaagaagggcagatttattagagaaattcgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 639424 - DNA, 104 bp, Homo sapiens
tctgttcgcgcttctgccgttcctgcttctgctgcttctgctccctgcttctgcgcttcctgcttctgctgcttcctgcttctgccgcttcctgctgcttcctg

SEQ ID NO: 639425 - DNA, 375 bp, Homo sapiens
tcagggatgattaccttgacctctttggggaccacagctgtgcacggcaaaatgtgtactgatgtccaggagaacaaatgcagctggctggaggttcagtgtctgcaacgggccactccaaaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagatcgccttggggtagtatcgggtacc

SEQ ID NO: 639426 - DNA, 276 bp, Homo sapiens
  misc_feature (31)..(31): n is a, c, g, or t
  misc_feature (96)..(96): n is a, c, g, or t
  misc_feature (227)..(227): n is a, c, g, or t
  misc_feature (259)..(259): n is a, c, g, or t
ctggtggggagacagcatgccactggaaaanttcgtagacatggaattcctggttcaaatgatactaagggggacttgcctggaagcagacttgtntccgcagtatacaaactcaccctttaatgcacacactgaccagataacacaaacacatttacccccacagcacctagactcttctcacagtacacacacttgccttccagtacacagacatatccaaaggnacaccgacaagcaccacagcaaaaagatgttncccagaacacatggaca

SEQ ID NO: 639427 - DNA, 241 bp, Homo sapiens
gcctagtgaaactttagctaacaaaattcacacagtgaaaggcacggactctgggtgagactgggaaggtcctcagccattcatgcaccatgcggacgagctccgccccatgtggcccgatcaccccggagaggatatgcctcgcaaacgcttctactagtcgatacaacctcagttgcggtactctcatgaccatgccgcacctagcatctctgtctctctctgcgttgtagggcggatc

SEQ ID NO: 639428 - DNA, 860 bp, Homo sapiens
cattttatagagaatccccttcccccttgttttcattcctttctctccagatccaggagataatcaactaagagccaggcacccttttaggtctgataagaagcattttataacctgctctctcttaagtctgctatctgagagcttcctctgcacaataaaattgggtctccacaatcctttatcttaacctgaacatttcctttctatgatcccaggtcttcagataaactcaaccgtcatccagaaaaatgtttaaatttacctatagcctggaaggctccgcttgagtgtcctgcctttctgaaccaaaccaatgcatttcttaaatatatttgaagtctcatgctttcctaaaatatatcaaaccaagctataccctgaccacctgtggccacatgttctcaggaccttctgagggctgtgtcacgggccatggtcactcatatgtggctcacaactaagtctgtaaaaatattttacagaattgactcctttgggtcacattaccaaaagttatttatttgtcaaatgatgactcagaaatttgaagaagcgaaaccttttataaccttgtacaaatttggcaaagagcagattaagattagcactttaggaaacctcgttatgctttacttcaacgctcaattacagaaaacatatatacctggtgatgtgtccggttgttccacggaactctctgcggattattccacctcttccccttctggctcggttctagggtcaccatctacctcgaagtattcggattttaacttggaacattgctccaccgggacttggggaccccactgcaacgtgttgggcgcgcggcttaggggccccgggataaatcccct

SEQ ID NO: 639429 - DNA, 892 bp, Homo sapiens
  misc_feature (892)..(892): n is a, c, g, or t
gcgacagggcgagactccatctcaaaaaaaaaaaaaaaaaaggaaaaataaggggatgataaccaataaaaatattaggatgactcggggttttagttccgtaagcttttaaaatttttcaaacccataggatgtcctgtgttttaaaattaaaaactttaatcatatcgtggtgattggtacctttttaaatccctcctaggagagtgtaagttcctcaagtttccctttaagcccagttccatccattcatttcattcattcacacatattttatgtgcctgtggtgtcaaggcttggttgcttacaaagataggaaacgaattctgggaagaaatatattatccatatctatgtgacacttttatagaccgggactggtaacccaaaggggtaaacacgtgtttaactggtcctctttaaaaagccaacgggttaagcaacgtatccacgggtgatttttttgaaaaaaaattcaatctggggctctgaccaagaattgtccctccctgacataattacccctctaatttaaaataaaaactatttattttccattattatcacggtaccaatatttaaaatgccatctttttgtgtcattgtaaattgatttaaattgaggaacccttctcggaagaaatttagccatcccccatcctaattctgaggtctgtgactcttggaggcctacaggaccccatgttcgggtcccaggaatgaaaaaatcattccctgggtaatcaaacaaacagaaaataaaaaagtgtgggcccagacagaagttaaacacttgaggggcgccctgaaagaagtgctagtccgaatcgcgcaaggtggttcacaaaccgagcgctgaaacggggggcagctcaggacatgacaccgagan

SEQ ID NO: 639430 - DNA, 212 bp, Homo sapiens
cttattttcctttttattagatttagattcgagttcatttatttgaaacatactgggccaatctccatccagaattcctgggtcagccccacctatgtccaatggtgcattatcgcggaagggcaggcgtgatggcttatttgttttgtattccatgattgtctttcccctttcatttgtctttcttgagctgccatctacaagaacagtgt

SEQ ID NO: 639431 - DNA, 141 bp, Homo sapiens
cggaccacagaacatgaccaggtcctccactgggccggatgagagtggggagtggcaagggacgtttctcctagcaatagacacttagatttctctcgttgtgggaagaaaccacctgtccatccagctgatctcttctac

SEQ ID NO: 639432 - DNA, 102 bp, Homo sapiens
agtcggtaccactcttgaatattacttaatgggcttgcatgcgggctagtgagtttaattcaatcaaaaactggggatttttaaccctaggcaaaacctagt

SEQ ID NO: 639433 - DNA, 187 bp, Homo sapiens
attcttgcccccactttcataaaaaaaacttcaaaacgctgacgctttggagagtaacacaatcaatacttggctgggcacggtggctcctgcctgtgatcctagcactttgggaggctgaagctgaaggatcacttgagctcaggagttggagaccaaccctggcaacataacaagaccctgtctc

SEQ ID NO: 639434 - DNA, 124 bp, Homo sapiens
cccgactagcacaggattgacaggattgataggtcttctttcgattccgtgctatggagcatgctagtgtgactgtctcttacattaatggatggattcgtctgtcgttattcctaataaggaa

SEQ ID NO: 639435 - DNA, 155 bp, Homo sapiens
tacactgatggatacttcaatgacatcaatattgacctcatacagacaaaagatgaaagctgggttttctcgtgtcccaaggtacaaaacatgtgctagaaaagttaacatacacagtttgtcagacgatcaagcgtcggagatgactcatagtt

SEQ ID NO: 639436 - DNA, 297 bp, Homo sapiens
  misc_feature (13)..(13): n is a, c, g, or t
ttctttcgggcgncaggtggaaaccgttttattgcttggcggcagcccagctgggccagccaattttttcagcggagttgttcggacccgggctttcttcgaatgcctttcgcctactttagtagttaagttgaagggaaaccgattttcagcacccggctttcttggccatttcgccaacattgatttcaggttcttcacgaacgcctgctcaaccaggctcgcttcagccaggaacttgctgatacggcctttgatcatgttttcaacgatgttttccggcttgccggcgatctg

SEQ ID NO: 639437 - DNA, 109 bp, Homo sapiens
ctgagcatcagaggctgatttctgttgtgtgtggtatgtatcgggtgtctgatgggattgttaaccccgtcgctactcaaggatggcgcgatacaaacaccttcagcgt

SEQ ID NO: 639438 - DNA, 261 bp, Homo sapiens
tatgtcatcagaaatcgctcattattaaaacttttggttgttgttgagacacagtcacacactgtcgcccacgctggagtacactggtgtgatctcagcccactgcaacttctgccttctggattcaagccaatctcctgcctcagcctcccgagtagcatacaggcgcatgccagcaccacgcctggctcatttggtattttgaatagagacggattttaccacattgcccaggctgctgtcgaactcctgatgtcaggt

SEQ ID NO: 639439 - DNA, 508 bp, Homo sapiens
gcccaaggtatcatttttcttttcccggaggggggcgcggccggcatgtgattagcaaactcatccctagcttgtggtttacccgccgcgtattgcgttggagcccccttcccctgtgtcctctaaaaagggggggtttttgccctcatgggggggttctttccctgatttccccttttttcgggggcccccctgggccaaacctaggccaaaatcctttttccttttatttttcggggggggaatttaccttttttcccccacccctttttggggctttcgggaatgccccggggtttttggggctcccccgggggataccccccatgaaacatcctttttttgggggggccattccttttttcccacgcgggaatttttattttttttttgttttggggggccttcgctttgaagggaaaggtttttttgggaggaggccccccctttacccggggggggttttttgggggccccccccccccataaaattgtggtttttggccca

SEQ ID NO: 639440 - DNA, 476 bp, Homo sapiens
ctcgaagcacactgacaattatagctggacaagacagggtcatatacataccacatacggtacagccagacacagcgccaccctcctactccctatcacccctagacaccagtggtggatagggatccccaccccacagagaggagaatgcccaggaccaccctgacaggagtgtcagggtccagctctgagtgtccgaactgtcggacaccaagctgtactgctgtagagggtgcctggcccggccccagggagctagggcgagagccgccattgctctgagtcagaagctaggagctggacggagtgggggctggtccaggttcagtgccccagattggctccttcctccaatatactcccttcttctttctctgcctgctgccccaccaaccaccaccataactgtctccaagaaaacacaaccttggcatatagcgggtggagggggtgctcctgtagcaagtgtgcttccg

SEQ ID NO: 639441 - DNA, 410 bp, Homo sapiens
  misc_feature (33)..(33): n is a, c, g, or t
  misc_feature (131)..(131): n is a, c, g, or t
  misc_feature (154)..(154): n is a, c, g, or t
  misc_feature (186)..(186): n is a, c, g, or t
atattgtattaggataatttacatgccataaantttgcatatttaaagtgattttataaatttattgggtggtgcaaccatcactacaatctattttaaaacatttgcatcacgtcaaggacatcttcccngcccatctgcagtcagtcttcantactactcccagcatcagacaaccactaatcntactttctgtgcctatggatttgcctatcctgaaaatttcatctaaataatgtctccaaagtttattaatgttgtggcatatataaatacttcattcctttttatagctgagtaatattccattgcatcagtatactacattttgtctatctagtcatcagttgatgaacacttggattgtttctatcttttggctattatgaataaagctgctatgaacgtta

SEQ ID NO: 639442 - DNA, 415 bp, Homo sapiens
ctttgagctcaccaccagttttcttaaccccatttaaaacaagatcctgggtttttgtggtttgacttttagggtgttttaaaaaaacccagatttttagggttaatatggggtaaaggtaccccccttagggattcatttgaatgagggtattatcccatgatggtatccagtttgtgaaattgttgcaagggcaaaaataacttttaaaaacccgtcgagattccaatgctttagaatcagcatataagaaaataaatgatatttgcatgttgaattggggtggatggggggaccaagcataatttttaagtgtgaagctttgcatcaagaaattattaaaaagctttttttctccagtattttctgtattatcttaaggtttagggcaaatattatgtaaaggaccatccca

SEQ ID NO: 639443 - DNA, 688 bp, Homo sapiens
tcatccccaagggacatttggaaatgtctggatgcattttatgatgtcatgactggtaaggagattgttaccagcatctagtgggtgcaagccaggatggctgctaagcattgacaatgcatagtctagtgcctccaacaaagatttatctaccgtcaaagtcaatagtgctgaagttgaggaaccatggtttagggagtcttgattaaaccgtttcatctggagtaccctcagatggtgatataagctagtatgctctgcttctcagtgtcaactttactcgcgtatgcagcaggtgagttataatcttcacagaaccatgctcctgaggaaagactgatcatacaaggtattctcattggctctgaacaaatccttctccttggcaattagaaaatatcgactttctaatgtattagcaaaagctccctctgaatttgaatatatgtttggttagatcaaatagcttgtttccgcgaatggaaaaaagaatcgtaaatgccatcagatatagtttagtgctgactttacatggtgcttgtacctcttatagcacaggcaaagctaagtactttcaactgaaagccatcaagcaaaatgcttacaaattagaatgtaatggccatagctctacttgtattgatgacgcagaattacaggcttccgcatattgaatctactattgatc

SEQ ID NO: 639444 - DNA, 892 bp, Homo sapiens
gttgcggcgggcggaacggtgtctccttcacttcgccctccagctgctgcagtgccagcccgaccggagcgtgccaaagcggttcagaagtagcggagcggtggggggcccccctcagggaaaccaccagattcccctcttcccgcgacctcgcaatggagaccacggacaagacttgccccgcgtccaatgtgtatcctccaatcaatatgctggaccttgtggacaaaacggttggccaggacgatatctccaaccaacgcgattgggcgtttccgggtggctcggaacacttggctgtcgacaccccaatcagtcctgcgccagtggccgtggcacaattttctccaaaccgtcccgggttccattcattaaattaacacggcaccatctggttacaaacgtttcaccgtggggcacccttggggaagaaccccaaaatttaccacaggtggcgtggtcaagttatgggcgccctggactttttccacagaggcaccacacgctgccaccccgtgggattaaccaccttctggggacaccacgacacttcggcaatttggaaggacccaggattgggtccaagggtttcggacaacgtggacacttggtgaataccttaccttttcttcaaccaaaaacaacgagggaaaacgaaacactggtggtaaaatctccaaggtctttcctttacaaggaggggcagtgtataaaccctgcggtggtgactgtgacctttcgatttgtgcgtggacctgcaaatccacatgggtcagacgggtcatgggaataatgaaggggcgggtatgctggtaccaagatgacttttgaccagtgccaaatcaagagtgacagggataacttggcagggcgctacaggactggggactcc

SEQ ID NO: 639445 - DNA, 301 bp, Homo sapiens
agcaaaaccaataggcaacatgagcggaatatatacaacaaaaccgacacagtaatgtgagccatacctttaatctacaaacaccttcatcaccgcaagcagcgatattgacataaagtgcgcgtcggctagagcagtacttttcctaaaggaacagatagcccatatgtttcatgaagatttaatttcgcttctagaaatacaatttttcggacaagcgagtcaccgttactatggatgccgtacgaagcaagcccgattaacgcgtcgccttctggaattttttcaccggtaattaatt

SEQ ID NO: 639446 - DNA, 956 bp, Homo sapiens
  misc_feature (42)..(42): n is a, c, g, or t
  misc_feature (56)..(56): n is a, c, g, or t
  misc_feature (257)..(257): n is a, c, g, or t
  misc_feature (429)..(429): n is a, c, g, or t
  misc_feature (625)..(625): n is a, c, g, or t
  misc_feature (645)..(645): n is a, c, g, or t
  misc_feature (678)..(678): n is a, c, g, or t
  misc_feature (704)..(704): n is a, c, g, or t
  misc_feature (712)..(712): n is a, c, g, or t
  misc_feature (855)..(855): n is a, c, g, or t
  misc_feature (923)..(923): n is a, c, g, or t
gaggtttataaagaactcattattataaaaaaaaaacataanacatcaggattaanaaaaatcaatgcggtctctttgcagaatgttgtgcttgatgtttaaaaaataccttggatcttattttgtaaatacttacattcttgttaaaaaatacaagtattgcattatgcaagttatttcataatcttacatgtcctgtaacaggcttttgatgttgtgtctttccactcaaatgaatttgctaggtctgttctttntgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacattngttcgctcataatctacttactggctaaaaactacaaaaccaggctaagagataccaccagtcatagcacttacttctgctttctctgggatatgtgctacaaatgtgctttggctttagaaaggcatggatgagaagacagacctgagaccaatctgggtagaagcaaaagttgaccttttaagtgctgacacanatcaaattcgaatggtcaangcagcgtgaatcgctctcataaagtgggctaantctctagttaaaagtcttcgatggantgactaantaatgtgtaagtggctaattgtggatgcatgatggggatgtcattttaagtttacctatgtcacgtcatgatgctctgataattttcacttggaactgtaactgggtgttgattaaaaccaacatcaaccaaatccatctacnacagccacaccaaacactcatttgtgaggtgacccctaaggggcttggcaggattgtggcactagaancacagaatccacttaagtctctgtgtgtttgat

SEQ ID NO: 639447 - DNA, 531 bp, Homo sapiens
agagaccaggtgaggcctggtgcctatctgctggaggcaagagctggacaggcttgacgttgtggggcagcgattactctgtagaccactattcccaagtggacaggtgccatatatgcctctttgggagccctagcctgtccaactccataatccactccaagtggcccaacaatacccaaaccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacaaccaccccctctgtagaaggcctggaagagctgagaccttgctatgagactcctcagcacccctccagttttgcctgagaaggggcatatgttcccggagcagaagacgtctccccttctctga

SEQ ID NO: 639448 - DNA, 208 bp, Homo sapiens
  misc_feature (190)..(190): n is a, c, g, or t
ggcattagacagcgcaggcagacatgacctcctgggcttctgcgggtgccaacactgccgctccttctggaggctcagggaggctcttgagggcattgggacatcgtgctgccggccgccgggcagagcggtttgtttattttttgagacttccgggaacatagttataaataactttaatttgccttgnctgcccactgcagtacag

SEQ ID NO: 639449 - DNA, 110 bp, Homo sapiens
ggggccagttgctggcattttatacttgacttgtcacttgtagtaaagcagggagtccctctggacatgggattttaagagaaatctacataaagcataggttatacatg

SEQ ID NO: 639450 - DNA, 549 bp, Homo sapiens
  misc_feature (392)..(392): n is a, c, g, or t
cggacgcgtggggtgtcttttatatataatctcctataatgtcttttatatgtatatataaaatctacatctaatttcagagatactaagatgtggggaaatgtacttagaatcaatgaaatacggtgttggtgaatgcaaaacttgtcagtcatatttattgatttcttctgtgtacagataatgggcatttggtatttattcatttatattttttttttggtcttaatgggacatggtgtctgcttatttgaattttccggtctgatttctatattccattgtagaattttcatttacttaatatttatatctgcgcccggccattatctgtcaatttttttcttaaaaaaaattggaaagtagccaaaaagaaaacaaagtccctttangtttaaataggaaaatgaatttagtaatttgtggaaaacaaatttatatcagatttttgtttgttggttatttttaaaacttggaataatttagtctacttttagagtgtatttgagaatggttgcaagttgtgaggcccttttagtgacttgatcc

SEQ ID NO: 639451 - DNA, 131 bp, Homo sapiens
cgtggagttcactgtttcagtgcttacctcctcatggaggtgtatttttgctcactgtgtgtaatagaagtaagatagatttttctttcttttttttatttcctgtctgtgcgtccccactccccgtcgac

SEQ ID NO: 639452 - DNA, 152 bp, Homo sapiens
cgggtacaaaaataagcacgtcaaacaaaacaagtatcagcactcaagtagtcaaacagaacaagagtgccatgcaggcatgctgtgggtgatcaggcacgtttccactcagatggagtggggcaagttccaaaagactagtctttacgaag

SEQ ID NO: 639453 - DNA, 124 bp, Homo sapiens
cgtgggcccccaggattagatgtcacctttgagatagatgtgaatggtattcttcgagtgacagctgaagacagggtacacgtaacaaataacaagatcacaatcaccaatgaccagaatcgcc

SEQ ID NO: 639454 - DNA, 633 bp, Homo sapiens
  misc_feature (430)..(430): n is a, c, g, or t
  misc_feature (517)..(517): n is a, c, g, or t
  misc_feature (530)..(530): n is a, c, g, or t
  misc_feature (570)..(570): n is a, c, g, or t
  misc_feature (580)..(580): n is a, c, g, or t
  misc_feature (633)..(633): n is a, c, g, or t
cgcggtggctcacgcctgtaatcccagcactttgggaggctgaggtgggtggatcatgaggtcaggagatcgagaccaccctggctaacatggtgaaaccccgtctctactaaaaatacaaaaaattagccgggcgtagtagcaggtgcctgtagtcccagctacttgggaggctgaggcaggagaatggcgtgaacccgggaggcggagcttgcagtgagccgagatcgcgccactgcactccagcctgggtgacagagcaagactctgtctcaaaaaataaaaaataaataaataaataaataaataaataaataaataaataaatatcattatatagccaggtgtggagctcaggccagtaattcctgtactttggggagccgaaggggacggatcacttgagctcaggagtttgagaccagtctgngcaacatggtaaaaccctgtctctactaaaaaaataaaaaaaattagccaggtgtggtggactgcacctgtagtcccgactacttgngaggctgaggtgngagaatcgcctgaacccaggagcgagaccccgtctcaaanaaaaatcaanacaaatgcggcccgaattcgagcttattggcctttggcctgtgaggcgcatcn

SEQ ID NO: 639455 - DNA, 1076 bp, Homo sapiens
gatcaatagaggaaggtgatcaatagcaggaagggtaatcaatagaggaaagtaatcagaggcaaggtaatcaatagaggaagggtaatcaatagaaggaagggtaatcaatagaggaaggtaatcagtagaggaagggtaatcagtagaggaagggtaatcagtagaggaaggtaaatcaatagaggcaaggtaatcagaggcaagtgtcaatcgagtagcaggaagtgtaatcagtagcaggaaggtcaatcaagaggaaggtaatcaataagaggaagggctaatcagtaagagggggcaatcagttagagcgaagggtaatcaatagaggaaggtagacaaatagaggaaggggtaatccaatagaggcaagtgtaactcaataacaggacgcggtaatccaatagaggaaggtagtcactagcaggacaggtagtcaattaagaggaaaggtagtgcaaacacgaggaacgggataatccaatcagcacgggaccggcaagtcaagaccgcagcgacacggcacgcgcaaacaagaacggacaaggtcacaccaaacaagacgcgcacgcgcacacacatcacaagggaacaggccaccgaccacactacaaacggacaacggggtaacaagtcagaatacgacagcgaaaggggacaccacgaaagaacgaagcgcaaggggataggaccaaccacaccacgggcacagggcgaacacacacagaagagagcgacacgggaagacacaagtaagagcgcaacgggcaaagctccaaagaacgaaacagacacggaggccaaaacagacccaccgcgacagagggacaaggggcgaaaaaccgagaacgacaccgccaggcagcagagggctaagggccaagcacagaaagcgcagaggcggtaccacccacagacagcacagaggaaccagaggatagagcagacacgcaagaggaccagcagaacacaagcagaacgagacagcaccgaggacaggtagcaacgaggaggcgcgaggagcgacaagcagacgaaggagcaaacgcatccgcatacagcagacacgagac

SEQ ID NO: 639456 - DNA, 789 bp, Homo sapiens
gattgctgacaaggcacacgagatcacgggtacaaagtattgctcccaacttggctcctgacctgtgctctgtcttctcagtgatggaggcatcttcctgcaaaacaccttatccaataaaattaacacacaaatagaaaatcaaggccacagaaagaaagaaagtggctagtatggttgctccagttgagcactggatttggttttgcacttcttggcagccaggacataatgaaaaccaggtgaatcgcacagctttattgatcagaaaggggaaagtctaccaactcttcaggggaggcaaaattcttcctggcacatttttctaaaatcattttctcatgtgggagtttacataaaagacacagtggcataataaacataggtccatcgacaacaaaagccttcataagcgtggaggattgaacaccaaggcgtgacacgatgaaggtaatttggccagtggctaagctggcaaggtccagtgatgtggcttttaggggctctggcttgatgtaaaattaacttagaatcattttcttgaagacgagactgaagacaaattcccaaaggaggctttgtagtggacattcagaggggaaagctcgttggccttggtgagattatacccggtgaaacggatgtgggtgcctcctgccctgggttccactttccatcatataattaccctgtctgggtatcggattggtgctgactgtctggtgtcaaaggcttaaggggaacgcccgttgatcagagttcagaattgactgtttttacaaaacttaa

SEQ ID NO: 639457 - DNA, 114 bp, Homo sapiens
ttagagctggggtgagtggtggtgtcctgtctggctttttagctgagtagacaccagcgaatgctgcttgagtcatcatcatgtactgcacatgaggagcacctagcaatctag

SEQ ID NO: 639458 - DNA, 393 bp, Homo sapiens
  misc_feature (1)..(1): n is a, c, g, or t
  misc_feature (3)..(3): n is a, c, g, or t
  misc_feature (6)..(6): n is a, c, g, or t
  misc_feature (8)..(8): n is a, c, g, or t
  misc_feature (22)..(22): n is a, c, g, or t
  misc_feature (72)..(72): n is a, c, g, or t
  misc_feature (97)..(97): n is a, c, g, or t
ncnacngnaagctcgcctgctnttgggaatctcgaggatcccccgcaaatttccttccactcgtctttcgcngacctcggcgtccgagaagatatcngccaggcgctggaaggggtgggaattgtctccccgttcccgatccaggccatgtcgatcccgattgccgtcgagggcacaggatcttattaggcaggcgcgtactggcactggcaaaacactcgccttcggcatcaccatcttgcagcgcatcaccctgcccggtgacgaaggttgggaagaactcaccaccaaaggcaagccccaagcactcgtgatgtgccctacccgggagctagctctccaagtgtctaaagacatctccactgccgcttctgtccgcggcacacgcgtcta

SEQ ID NO: 639459 - DNA, 131 bp, Homo sapiens
tgcgcgagtcatgagatgtaattattatacgaatgggggcttaaaacgggagtactactcgattgtcatcgtcaaggagtcgcaggtcgcctggttctaggactcatgggggaacgtctgtcggcgttgaa

SEQ ID NO: 639460 - DNA, 701 bp, Homo sapiens
tgtttttatttaaaaacatgacatttggggccacgcgcggtggctcacgcctgtaatcccagcactttgggaggccaaggcagtgcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgggtgacagagcaagattgcatctcaaaacaaacaataataatacataataaaaacctgatatttggctgggcgctgtggctcatgcctgtaatcctaacactttaggaggattgctggagacaggagtttaagaccagtctgggcagcatggccaagaccctgtctctacaacaaaggcaacagattagctgggcgtggatggcttgtgcctgtagtgccagcctatctgggaggctgaggcgggcaggatcacttgagttcaagctgacagtaagcctatgattgcaccgctgaactccagactgggtaacaaacctaagaccacatctctctgatctcacagaaaagtgataccttcgacagagatgcatagactccaagaagtttatgcatctctatgcaacccaacact

SEQ ID NO: 639461 - DNA, 1071 bp, Homo sapiens
tgtatctgtttctgtttcattgtgtggtgtgtgccttggtcgtttgttgtctgtgtggtcatgtcatggttgtgtgcctgacatgcttgggtttttggtggtgagggtcctcggtcgtggttcttatatttgctagggctcttttgtcgtggtatgtgggtttcgtagttgcgggtacctgtttttataggtgctgctgagtggtgtcaactgtgggtggcgggggcgggttgatctacgtgtttctttcgtgatactagggtgtagttattgtgggtatttgtgtgggtattgttggttgtagccgtgccctgttggttgaactgtcccttggctggttgcggtgtgttgaaaaacacaaaagacccgggctttccccgtgtgccttggagcgggaccctttcgcccagcgtttaggaatgtctcctgcccactttggggaccaatggggcgcgcccagatgaccccataggatggccgttgagcccccggggggacatcccacgcatcccctgtggggacacctggggcccattagtcgcatatcttgccctcggcccttgggaaggttcccacgattcaaagcctgcgctgccatccgtgaattcataaattgtataagcccgggtaccccttcttcacacctcgggaggacccacattgaggcttacaggggggtgcaagccacaccctgttgtgtcgagcaactgtaaacacccttcaagctgcgcttccccaagctgttgaacgcccaacctcttctcgccactgattaaacatagagtggctgccagcccctgggacccaggccaccccccaggatgacctgtgcccgccagatgaggccggattggagaaaagagctccccacagaggggctttttgggaaaacatcatggtccaagaaagacatcgtgtctggccgttgttggggatgacatttttgttttggttttgtccctttttagatttttccaagaatagggagggaaaggggaaactgagcccttgttgctatccaacccagaacttaattgtaccatttttttccaataaaaccttgttcccatg

SEQ ID NO: 639462 - DNA, 214 bp, Homo sapiens
gagcttttgtcatataagcgctcataaccctcacgttacactccctcttagccaatattgtgcctcattgccatactagtctttgccgcctgcgaagcagtggtgggcctagaccctactagtctcaatctccaccacatatggtctagactacgtacctaacctaaagctactccaatgctaacactaatcgtcccaacaattatattactac

SEQ ID NO: 639463 - DNA, 994 bp, Homo sapiens
  misc_feature (439)..(439): n is a, c, g, or t
gtatcagcattcgtcagtgctggctgagtgctgtctggtaatatgagcctgtgatgactaggaggtatgcatacgagagtagtcctgggttcgtgaatctagtgtgtccttgcgaactagtcatccatggtaagccatctggcctgcgacgagcagaaccgtacgacgtgtgcgagaagagctgatattgctagtattgcgcatgatagtagaatcgtgctatacatgtagtcatgttatacaactctggagtcgattcaccacggctgagaacgtaagatcatctaacaatgtaagtctccagctctgtggattttcgagcctatagtgatctctctcgtgcctacagcctcttctcctacaatacccaaggcagggataaatgagcatactagttttatagcagcaacagagttggacgagtataggtctactacantttggaaagaacacaaaggttacaatccaagaggtttatcgaaaaaagtttcccgggctccagtttgcaccaattctgtggttgaggctggggggaagattcccttcgaattcaaggggttattttggcttggaaaagttttttgggggaatccaaaaatggggggaaacaacgcttttttggggttggaaaaagaaaaaggggggttcctttggacgggaaacccaagggagggggtttttaaaccattatttcgggggtttgggggggacaacaaccggggcctttcccaaaagagccgacgccccaaagaaggaaattcttcggggtacccctttggtgggtggtggccccataggggtgaaaaaaccgcaaggggggaaagttttttacggccgttttaagactttgtggggaggtgatgggtaggggagacccaaaaagaagggggagatttaacattaattgggggaaacgattttaaaggggggggaaaacagggggccgacgaagagagggtgatttatgaccacgcgattttatttctctggggga

SEQ ID NO: 639464 - DNA, 526 bp, Homo sapiens
  misc_feature (228)..(228): n is a, c, g, or t
  misc_feature (235)..(235): n is a, c, g, or t
  misc_feature (243)..(243): n is a, c, g, or t
gtcattagccagtttaacatgattcaaactctgtttatttcatactaaactagtgaataagtgaaataaaggaaactcgtcattaatctaaagacagagttcaaaggaattgggccaaatatattctcagtatttggcaactaatggtttttaaagggttgttaggcaaaatcaggtcgatttaagaaattgtttagtagtttctggtgttatagcagttcttcaagnttttccnatcttcancatgtatgtctgctgaaaggtgcaggatcgaggatacagacgttgataattttctacgaaaccagtaacttttaccttttaacggaaacttggctaagctcttatgagctagaagaagctgtaggatagctcaaacatttcttttgtaagcaggaaacgcttggcttattttctcggcattcgtaacgaggcttatttaacaaaaccagtttgggctgtgtccggtctggaacttcgtaatacggtgtacaaaaggcgaataacctgtattgcacggttctga

SEQ ID NO: 639465 - DNA, 273 bp, Homo sapiens
ccgtttgatccggtgtagctaggcagcacaaatatccagtgtgctgtggttgcagctgttggtccagtggaggaccccagtgctgaaaggatgggcactggtggtgtggagcagaacggggcctgcagagtgactgtgcagagcctgtccctgtgccctatggcatcgtcaggccacgctggctgttggcatccaggccattgggtctcctgggtcctcccctccaccctggaacagtagaggggtccgaagcctggtctgactgctcgctgg

SEQ ID NO: 639466 - DNA, 705 bp, Homo sapiens
  misc_feature (13)..(13): n is a, c, g, or t
  misc_feature (66)..(66): n is a, c, g, or t
  misc_feature (96)..(96): n is a, c, g, or t
  misc_feature (108)..(108): n is a, c, g, or t
  misc_feature (111)..(111): n is a, c, g, or t
  misc_feature (114)..(114): n is a, c, g, or t
  misc_feature (150)..(150): n is a, c, g, or t
  misc_feature (154)..(154): n is a, c, g, or t
  misc_feature (171)..(171): n is a, c, g, or t
  misc_feature (177)..(177): n is a, c, g, or t
  misc_feature (234)..(234): n is a, c, g, or t
  misc_feature (248)..(248): n is a, c, g, or t
  misc_feature (292)..(293): n is a, c, g, or t
  misc_feature (318)..(318): n is a, c, g, or t
  misc_feature (323)..(323): n is a, c, g, or t
  misc_feature (326)..(326): n is a, c, g, or t
  misc_feature (328)..(328): n is a, c, g, or t
  misc_feature (354)..(355): n is a, c, g, or t
  misc_feature (361)..(361): n is a, c, g, or t
  misc_feature (393)..(393): n is a, c, g, or t
  misc_feature (415)..(415): n is a, c, g, or t
  misc_feature (508)..(508): n is a, c, g, or t
  misc_feature (583)..(584): n is a, c, g, or t
  misc_feature (586)..(587): n is a, c, g, or t
  misc_feature (648)..(649): n is a, c, g, or t
  misc_feature (677)..(677): n is a, c, g, or t
taaaggccaatgnaattaataaacaggaacatgatattattaaacaaaaaacacagatacctttanaagcgagagaactgattgataccattttgnttaaaggaaatnctncgnccaacatcttcaaaaactgtctaaaagaaattgacnctanattgtataagaacttanttgtgnataagaatatgaagtatattccaacagaagatgtttcaggtatgtcactggaagaanaaatgcaggaggtngcaagaagaacgaactatgtaaagtgtgtatggacaaagaagtnnctgttgtatttatcccttgtggtcnactgntcntntccccccccccccccccttccccacnnaaatgncctatttgcaggggtataatcaagggtactgntcgtacatttctctcttaaagnaaaatagtctatatttttacctgcataaaaaggtctttaaaatattgttgaacacttgaagccatctaaagtaaaaagggaattatgagtttntcaattagtaacattcatgttctagtctgctttggtactaataatcttgtttctgaaaagatggtatcatatatnncnncttaatctgtttatttacaagggaagatttatgtttggtgacctatattagtatgtatgtnnacctaagggagtagtgtcactgcttgtnatgcatcatttcaggagttactggattt

SEQ ID NO: 639467 - DNA, 266 bp, Homo sapiens
gcggagaggcgggaggcgctgagagtctgtgcggaggtccatgcacagactgctttgcctgttgttgctcttcggaggcggcgatccccgaagcgagctgaaatacggctgcaggctacaatttgcagccgaccattaaggaagacgacgagcggagaggtggccaccctcatggagcgctttcctcggatggctcgattcccattactacataaaccgtatcatctgagagatcacagagctgtctacgtgtatctgagaactga

SEQ ID NO: 639468 - DNA, 830 bp, Homo sapiens
  misc_feature (548)..(548): n is a, c, g, or t
  misc_feature (556)..(556): n is a, c, g, or t
gcccaggcccttcctctaccgccgctcggcccacggactccgacgtgtccctcgactccgaggactccggggctaagtctccaggcatccgggctacaatatctgtccccgcgggtggaatggcagccttcggctcaagcgtggcagcctccccgccgaggcctcctgcaccacctagagccgcagccccgagcccaccccgggagggcagagccagaagaaggctcattagacctgggggacccaaagggtctggcctcttgggcagccccagagatgaggggtcagcagaggagagctctggggtggggatgggttagggacgcaagctgagtctagcccttgctctcattcagctgtgtgtgaccctgggtaagacccttccttgtgttgagcgctcagctttccgcatgctgtttagtggtggcttatggcacaaggctatccacgaaacgtcaaaattccgcctttccatcagtacagaagcgatgaagcaacactctctctttctctctctctctctctctcacacacacacacacacacanacaacaanacaaccgataagatgagctgccctgggtaaatgacagcggaggcatggcggtagtaatacttggaccccccgcgagagcgtgcatccgtgccaagggaggacaaaacacacaggcccggccacctacgctgggctccgaatgaccggcgaagtctccggacaaggcgacgctggtgtaccaaaccgctcacacccgtgggaaccacgctcccacccaggtggcagaacaacggggccccggggccaaaacccagacaacaaaggcacaccggac

SEQ ID NO: 639469 - DNA, 146 bp, Homo sapiens
ccatgtaaagccagtttgacgctttgcatcaggtggcaaaattcattctatgtgccgttattgttgttattcacattttattgtaacttacgaggtgaacgacctacgttacaataaaatgtgaataacaacaaaatgaaccaagt

SEQ ID NO: 639470 - DNA, 109 bp, Homo sapiens
gccctgtaggccaggcagcgtgcatcctgcgttagtgtaattagtttgctgtctctcccttccctctgcgctgtatgttctttaatgtgcttgtcttgccccttcccac

SEQ ID NO: 639471 - DNA, 690 bp, Homo sapiens
cccgcatttccccacccttggtatcacggcaagggccattggggcaatttaatgtttattttgaggaccaaatggggatgcggttaggaatcatccgaaagccctgtcccggggtctcatggtctgggtacaaaggcccaaaatcacgattgctccaaggggcaactgatagccccagaatagctccctaaaagacgcataaagccagaattcactgccttcccctccagtccatgaccctgggcccagggaagttttggcgacatataaaaccatgtttgtagggtagacctgtgcattaaacttgggcatgactggaacgaaggatgagcccccctcgaatgtgtttaagatacggcgggcatttttgtaaaggccgcccccaatgtttcccatagagtaaatactgtttaggccccaggagagtttggaatccggaataaagactccctgaagggttgtcctctccgtttttctctgtagcccacgggcctggcctgaaaatgatacctctctcaaaagcatatttcctccaagggcgacaatgtgagctggtgcttcttctggactttaggctggcgccgctttaaatgcctttatataaatgcgattgtagggcaatggacctttaacgcaatccgttcttgtggcgatctgttgatttgtttgcaaattaagtgcgaattccca

SEQ ID NO: 639472 - DNA, 129 bp, Homo sapiens
tacattcgtgtcctattaaaagcctatattgccaggaacagtggctcatgcctattatcccaggcatttttgggaggccaaaactcgttatcatggttacccaggtgattaccttctatgatatggctc

SEQ ID NO: 639473 - DNA, 110 bp, Homo sapiens
ctcttgtacgtgttcagctgtggctgctcagaggttcctgcgtggcttccaggctggagcggagtgatacccttctttttcagctgttcgtgccttcctttcttgtgtcc

SEQ ID NO: 639474 - DNA, 120 bp, Homo sapiens
gaatatagaactcaaagaagcgggagatggatataacgatgatccgtcgagcggtccatgacgatcaccgcggctgtacccagacatgtctgagcctgcaccaacagcatcacagtccat

SEQ ID NO: 639475 - DNA, 1210 bp, Homo sapiens
  misc_feature (510)..(510): n is a, c, g, or t
acccacgcgtccgtcgacccacggcgtccggagctggtgagaagacagcgaaatggcgccatcgcggtcgcccgggccgtgcctccgcgtgggctctcggagagtaggtacgacgatgctagttacgacgtacatatgaacgccttctatcatcgggtagactatccagcattgcataaacgatggcgcagcgggtgaagctatcaagcccagagagagacgtggagagggactgtcttcactgtatagagcgtacctagggcagcagaggaagttcggtgtggtcctaggatgagatcaagccgctcctcgggcacctgagctcctaggccgtgcgcatgttgggctgactacggtcgtcccacgagaagtcggagggacaagcgtcgatggaccgaggctggaacctgaggagatgatgcagggacgcgtggatcgtgacacaagaaacatgcttcctgctcgatggtccagctcactagtcgttatctctcaacgatcgcagtagangctcggaattgcacggatctcatgacggttgcggcttgcatgcgagggagtggacaagaccatggtagatggcatcaggcctactgacaagttgcgaggaattccatgcttgtacaggactggcaccgtcgtgcgacgctcggcccgggaaaggtagctgtcagagaatgcatggaacgtaggacgagggatgcctatccgtacaaccccgagctcgacgactgccttgggtcacgccgtggccacgggtgagttgaaaaagctgctaggatgcgtaattacattctctccaatggaagcatgtgcgtgaacaaagtagcttcggccgacccatgagttggatgactcgaatggggccagggagagacctaggccagatgggccagggccccttgggtaaggcaggtgaagggcctgattgaaggaaggggctaaaccaaggaagggagaaaccacaaagaagctggttcaaccacacactgggccaggaccccaacaccggggggaacggcccccgtagggtgaacacacggtatcacggtccaccagaaaggagaggcccaggaccacacaccctataaaggggcacaagcacagggaagaaataaaaggagtgaaagaagaacccccacgaaggtgccacaaagaatcagaagaacggacgcgcaccgcgtacacaagagcgagagcgggggaacac

SEQ ID NO: 639476 - DNA, 832 bp, Homo sapiens
agcgggtgtcctgggtctctggaggagcccatgaaggaggctccgctgggttccgctgggtcaggcgcttacgggacccgggctgcgagaactcgttatgcgggtcatgtcggcctgcccaggggctggtgacacaggatacctgcctggtaggggacgtgacgtgcgccgacgtgcgcttgtgtgagcggacggtacgcgtgggtcctgtgcgtgcggcgcagatgtggcggcttgccgcgtggtgtccgcgagggagctggctcagacttcaacgcgctatccgctgcaagactctgccgggctggtcgcattcttgccgaggccgacagaccatcacactcaagcacggaagttggcactatcagcttgtgttggcaagattgatacgcgaacgcatactatgatgtatgtggaggttaataaccgcagagttatgtattgaatcggggagggcctgcataatgatagactatccgtcgtcttcagaggaagcgtctggcaggtagtctattctggctaccaggacgctattggcacgcagatgggcacgagagttggctacagtgccgccgggaattgggcagtctaatgttcaccttgatgcctgcatggagaacaacctgttagtagtttgggagcgtacggggcatcccatctctggacgagagctgcggtgatgcacgtccagtgctgtgtaactgtcgaacgtatacccagatggcgcgttggcatccagcatgtcggtgggaaagaagaccgagtcgtgctattatggacagggctatggccatcatcactggcatccctgttgtgtcttgcggagggttca

SEQ ID NO: 639477 - DNA, 134 bp, Homo sapiens
agaagcccggttgccagctttttacgcctcacaggaggaaggcggctgagggcctgtgttctgcttacatcaactttccatttcatgtgggcttcctcatcttcctcttacaccttcactatgacgataccatc

SEQ ID NO: 639478 - DNA, 180 bp, Homo sapiens
ggtagctttggaaaaggctgagttcacaaggaactctcctaagaaaagtaccagaaggaacctgaagatgttggtgtgttggaggctgcctgcagcatctaatctctgccatattgaaggctgtgtttcttgaagatggtcctaggacaggaatgagcccagggactgaaaatcagagag

SEQ ID NO: 639479 - DNA, 115 bp, Homo sapiens
gagacttgagagtaagatcatatgtcctcagaataccttcattatgaatttcattcatttctggccataagcctgctcttgtgtacacgagaatgatatacgttacatttcggtt

SEQ ID NO: 639480 - DNA, 169 bp, Homo sapiens
ctgagtgatccactgtatatgtaacaacacagatagagaaaacattgagggttacttgtgggtgtatgggtgtttacttgcaaagttctttcaagtcttctgtatctttaaatttttgatagtgaactactgtcataacagttctccccatcccttaaggccccttcag

SEQ ID NO: 639481 - DNA, 460 bp, Homo sapiens
  misc_feature (316)..(316): n is a, c, g, or t
  misc_feature (339)..(340): n is a, c, g, or t
  misc_feature (428)..(429): n is a, c, g, or t
  misc_feature (455)..(456): n is a, c, g, or t
cagagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaattggagctggagaagattgatgaaagtgcaggtgtgtaaggaaatagaacagtctgctgggagtcagacctggaattctgattccaaactctttattactttgggaaagtcactcacgcctccccgtaagccatctccagggtggacggaacccagggtgtatttacctngctggaaccacaaggaaactaanncaatagtgaggtgtactaaagtgaaataccccagataggttgtctccacattaatgccctatgaaacaccaaacccaataaaacaaannatttctctaacacataacaaaaaaannaaaa

SEQ ID NO: 639482 - DNA, 327 bp, Homo sapiens
  misc_feature (39)..(39): n is a, c, g, or t
gcgtcgaccattgctacgttgccagcctctcccagtaantgccgcgttgaagttgtcgccgaagcttccgccctggatagccgtcgagattccgctggagatgaccgctcgaccaccagcacgcaaggcaatatcacctgcggacgtccacgtaaaaatatcgctaggagagttggtgacggccaaggttgaccccgcgctggggctcacgccttggactgctgttgtacttgtgctctcagtgccgctgaaccaattggtgtcagcataagaaagcgcgccagccgtaaaaccggcgacgtcgacgcggccgcggatttagtagta

SEQ ID NO: 639483 - DNA, 1079 bp, Homo sapiens
  misc_feature (257)..(257): n is a, c, g, or t
  misc_feature (612)..(612): n is a, c, g, or t
  misc_feature (626)..(626): n is a, c, g, or t
  misc_feature (996)..(996): n is a, c, g, or t
  misc_feature (1067)..(1067): n is a, c, g, or t
accggtccggcacttcccgggactccgccgccgcccgccacgaccgcgcccacgtactgcgggcgatcgtgcccactccacggccggccacgtgcggcacacccacgactcggggccacacgttctgggaacgtcactcacgtgactgacgcactggcactcgacccccacgcggcacacctaccgtgggcgcctcggaccttgcacgctggacgcggactcacgcgtctacctacccccgacggcctcttctcccncgtaccgtgcctcgcgcccttctggtggaccctggacccccggaacccctggcccgtgtccgctcacggggcctttggccctctcttccggcctgaccacctttcctctttggtccgacgtggggccggcacccacacctgggccaccgggtcacctaccaccggacgggggcggacgctggtggacttcggtcctggactgtggtgcggaacggacgtgtgaaacacctgcgacctgcctgcacgggcttccacgctgaccccacctcgctggggggcggcacgggctccggcactgggcaccgttgctcactcacgcccggtgcgtgacggacgtactcccgacccgcactcntgaaccccctttcngcgtcgtgccctcacccaacggtgtcagaccacggtggtggagccctacaacgccacgctgtccatccaccagctggtggagaacacggatgagacctactgcatcgacaacgaggcgctctacgacatctgcttccgcaccctcaagctggccacgcccacctacggggacctcaaccacctggtatcggccaccatgagcggagtcaccacctccttgcgcttcccgggccagctcaacgctgacctgcgcaactgggccgtcaacatggtgcccttcccgcgcctgcacttcttcatgcccggcttcgccccctcacagcccggggcagcagcagtaccgggcctgaccgtgccgagctcaccagcnatgttcgatgcaagacatgatggcgctgcgaccgcgcacggcgctactgacgtggcacgtgttccgggcgntgtcatgaggag

SEQ ID NO: 639484 - DNA, 325 bp, Homo sapiens
caaggagtattacatgacactctcactcatgaccttggattgcaacacaatcctaaacacaatattagcacatggaacttggtaagcatattacaaagattactacatcatgacaagtcgggttgattttaggaacgctaagactgatctaacagaaacatcaattaatacaattcattagcaaagaaaagccatgtaatttttgcaagttatacaaaaaaggacttgagtgaattaatttatccgctatgcaaataactaaaacatctcttgcacactacggaaacgaataaaatacttttaacctgataagctgcatgtcaaa

SEQ ID NO: 639485 - DNA, 727 bp, Homo sapiens
tgtaattcaaaacagtcactctgaatggtcttagctaagaacaattcaatgattaagtaaggtcagtgtccttggaagtccaaatctctagccagatttccctggtctacacccctagggatacggtaacatgtttaagcacacagtgaacttcctgaggcccccaaatctaatggaactagctattgagggctaaaacgaggatggtttcttttacgaagaactcgaagcaaatctctcaggctggcggatatttcaaagactactacatacttatctatgtaataacaatatgcaatatatgttgagtccctaaatgcaagcatacaaactttgttctaatcacaatttcaatcttccacagcaaccttcatgaggtagataatattgtcattcccatgaggcgagctaacggatcagagcaacggtaagtcacttgtactaaggtctacatagctagcatgttatgcaatcaggagtcaaaacctggtcatgtcctagaatctgaagtccatctgctctgtgcactttatataccgtctgctttttcctttattcactaaccttcttccatgctgaattcccactgagtaggtggacaggaacctacgtgaagttagcctgaaacatagaaccaggcctagtacacctggtctttgcctttgccctgctgtgtgatcttagcctacactgacacaggtccaacagccatggcatgggccaggaa

SEQ ID NO: 639486 - DNA, 246 bp, Homo sapiens
ttggcaggagcagataatcgcgacggcgacatccgcgtgaccagccggagacgcccatgaggaagaggccgcagtgtttccggcggtcgaggtcgtggtggaccacgtggtggcgaatcctccctcagttctgtgctcgaagatcccgaccagcgctccatacagcttacttgactaataccgaatcagatcagactgcagacactgatgcccgcgaatctcatcaccgtactaaccgtcgtaagc

SEQ ID NO: 639487 - DNA, 997 bp, Homo sapiens
gttgctcggagcgcagttactgtctggaacgtgtagttctgatatcgagctcgaggtgtccccgcgcctgtcaagcttgacttctcatcggcttgttctctgtttgcattttccctcccaccggctcgtaagctggtctctcacctcgtccttgggcggacacagctggtccgtcttgtcatgtctgtgagtgattctcatcacaaccagtgctccccatctcgggaaacattgtgacacggtcttacagagaccaccaatagacataggtccttgtggtgacgtagtctgagtgcaagaagctcagttgttacggaggacgccatgacctcgggtcagaatggatccttgggtcaagcgtgcaatcatataaaccctaaaggatgagatgatcataatatggactcttgcctttagtcatcgacgatatctaagggccaacttcagtacaagtggtgtcctcagatatcgccggtattatgacctattcgcctgttgatagacaattacaagggtttgttccgaatatgcgtcggtgaagcctcttttagaagatctaggtttggaagtcattctggaggattctttacacgactatatagactcaacttgcagatttgggggaatgttccattgtgttaactaggactctgatgggggctcaagaatgacatctggcgggattgttgtaatcaagtgacttgtgaaatggatttgttcatgggtggttgtattgtgggattaatgatagtccgtctgtctctattgggacttgcagtctattgacctttgatcatgtgaagtggtgataatgtaattgcttgtaaagtgaggtgggtgtaatgatcaataggatggttccatggggaaaagaagtggtgggaaggattactcgaagtgaaagagactaaaaatattgaaaataagagagcggaaatgtggaaaaaaaaaaaatgtggatagttgtgtattttttgttgtgtatgtttgttagggg

SEQ ID NO: 639488 - DNA, 285 bp, Homo sapiens
tgtgcccagaggcgtgggggcgacatcaacgggcctgtcgccgggtgctggatgagctcactctgtctagactggcctggggatgcgatctgagagcttggatgaagaggtagctacattgaagaagaacccttgggggggttggagggctttttcacccagggtgggcccggcacgtggggtggttgggcccccccggttgtgtttacccgtggtgggggaatagggaggcagccttggaaaaacccgcgctcgttggatgttctccccccgcgtgtaagggtc

SEQ ID NO: 639489 - DNA, 305 bp, Homo sapiens
  misc_feature (19)..(19): n is a, c, g, or t
tccagctgtgcccctaggnagatatctactccggtgggggtgtaggcggtcccgatcctcccgtggcggcgaggcggcgggggcgcggggtggtcgagacagaacggctttccaatgggcggtgtgtggcggttacaacagctacggtggttacggcggtggcggaggcggtggctaccattgcctacggatggcggtggcggtgtgttcgtcctactgtgtggagagcgactacggtaactggcttcggttggcttcggcagctacagccaagcatcagtcctcctatgggcccatgaagagcg

SEQ ID NO: 639490 - DNA, 603 bp, Homo sapiens
cacaattgacgggcggatcggatggatacggatgggggttgtggtgaaccaatgtttcagttccacaaaggctctggcgaacggtggagaccatgtgaacgtgtacttgtggagagatgagtggcgaagaggaggggcggcagggtgatgttaccccaaatggaaggcgggagaagttaggaaaaaccaggaaacgtttcaactggacgtaggtttgaggcaatccaactgctgctttccaccagggatcccatctggcacatttcccctcagcgatgatatatccccagaaaggagattgtagagcggtggaacttacacttctcggctttcacgacagtggttctcgaggaggtgcttgaaggacctgttctggacattgagaacgtgttcttggggcgaccggggaaaaaaatcaggatgtccgtcacggtagatgaacaccaaacgtgttgagcatgtcccggagcacatccggtttacctggaagaaggtatccgaaccaggtgggaaggtctagcatggaaaaatggtgacctctggagaggtcaaaactgaggagaggtgtatggggtacgatcttaaccataatgtattagaccg

SEQ ID NO: 639491 - DNA, 258 bp, Homo sapiens
  misc_feature (19)..(19): n is a, c, g, or t
caggtctcagatatgcttntgtatatctgtatggatagtatcattgtgttttcatcatgaacacctgatgtttggataaatctattggtcatatgcatcatctataaacctgctgattttcatttggccacatctaatttcagatacctttaatctgtgtcccacaatgaggtttgttttcttttgccatttgttttgaatttttgggatcagagctatactaaccttataatggaaaatacatatttctcaaacttt

SEQ ID NO: 639492 - DNA, 183 bp, Homo sapiens
gcaccgttggtgttcgtgccgtgtcagttgcccgccatggctgagctggatccgtttcggcgcccctgccggcgcccctggcgtgtcccgtgcatggtgcgatacggcagtggcctcggggaccggtcgaccgaagatcccgggtcatgacgagccgttcattggggcgctagacacagagga

SEQ ID NO: 639493 - DNA, 396 bp, Homo sapiens
gcatacttctctatgcgcatgatgatcctgactaacattagccagtctcttttagcacattgtccgagcccgctgcttactttctttctttctttttcttgagatggagtctcactctgtggcccaggctggattgcagtggtgcgatctcagctcactgtaacctccgcctcccagcaaagctcagtatcttcatctgtaaaaccgttcattcattagcagagttactcactgagcatctactatgtgctagctaatttatatatctttagcaccgatgggatttcaccagcttgaccaacatggtgaaaccccgtctttcctaaaaataaaacaaactcagcagggcgtggtgacacacatctgtagtcctagctactcgagaggccaagcagt

SEQ ID NO: 639494 - DNA, 319 bp, Homo sapiens
cttcatgccgaccgacgtgggagtacgacacaaatcatccacagggcgcgttcaatgtctctgtcgcagcccgatatatcccctcgatcggaacaagacatatgctactttgcgtgtggccattaatacacagtcactcttaaagaatgcgctcctgtgatcacctctggtccattacctttttcccttgttttaaaaattctacccctggaactgtctccaaacccaacaggaccttgggggccaaggctccctgcagggacctagctgctactcctggagcccctgctaatccaaatgcagaggaagtgaaggggag

SEQ ID NO: 639495 - DNA, 310 bp, Homo sapiens
  misc_feature (282)..(282): n is a, c, g, or t
gttatccaaaatttcatggaaggaccaccttttatatttattgtgcttcgagtgactgacccccgtggttgatcctgggacaagtaccgcccggagtgttaagcgttcagtgatgtggggtgaaaagttactacctgtcaaggtttgtgttaccctcctgtaaatggtgtacataaagtattcgtggtaattattttggacttttatgaagtatatttattaaacagagtttttaccaatgaaaaaaaaagaataaactagtctcaggcatctacgtcggtncgagaagagtagtgtctcgttctctgtt

SEQ ID NO: 639496 - DNA, 151 bp, Homo sapiens
agtaaagtagttgagccttcagaaatgaatagggtctcttcttccacctgtgacatcattcctatagctagatgtcagagtagaagttgaaggatgggctttatcttctatccagccttcatgtgatgtatagaagccctgagaattattc

SEQ ID NO: 639497 - DNA, 710 bp, Homo sapiens
  misc_feature (27)..(27): n is a, c, g, or t
  misc_feature (85)..(85): n is a, c, g, or t
  misc_feature (143)..(143): n is a, c, g, or t
  misc_feature (159)..(159): n is a, c, g, or t
  misc_feature (175)..(175): n is a, c, g, or t
  misc_feature (224)..(224): n is a, c, g, or t
  misc_feature (287)..(287): n is a, c, g, or t
  misc_feature (293)..(293): n is a, c, g, or t
  misc_feature (301)..(301): n is a, c, g, or t
  misc_feature (370)..(370): n is a, c, g, or t
  misc_feature (538)..(538): n is a, c, g, or t
  misc_feature (562)..(562): n is a, c, g, or t
  misc_feature (572)..(572): n is a, c, g, or t
  misc_feature (578)..(578): n is a, c, g, or t
  misc_feature (602)..(602): n is a, c, g, or t
  misc_feature (623)..(623): n is a, c, g, or t
  misc_feature (628)..(628): n is a, c, g, or t
  misc_feature (671)..(671): n is a, c, g, or t
gttttttttatgttttttgttgatgcncaagttccccacattttttatcccagatttgggaagctggatatttttcgtgttgttntctccccatagctggtttgaggttgtggtttatacgcaggcacaggtaggtgattttnagcatcaacgcagatngaggggagggtgagcngtcgtgggagaactggcccaagaccagcacctggctggtgtcgccagcnccggctgcattggtgggtgaggcaggtctggctggagtttgggtttgtaggattggtcggggnaggttntgggggancaaggagcctgggtgtgaaccccaatgtggaggcagcaggacctagtggtgcactgggaaaaccggatncaggactacggatgttaacaaatgcgtgagttttggcgtttacacccccctcggggccagtgggtgagcagtggcccgtggtccccgccagagctcccccagagtggacttggctccgcgggacacagtgccctgctctgagctgccgctggctgctccacgtctganaccacgcgacgttgcctcatgaantgacgtgganagcagnaggggagacgctggggtggttctntggccaaacacagcccgtgtnaggancacaggccgtgcccttttcccagggggcacactggggcatttntcaatggccttcacaggaggcaaaggggcacacagaggc

SEQ ID NO: 639498 - DNA, 374 bp, Homo sapiens
  misc_feature (7)..(7): n is a, c, g, or t
  misc_feature (28)..(28): n is a, c, g, or t
  misc_feature (58)..(58): n is a, c, g, or t
  misc_feature (110)..(110): n is a, c, g, or t
  misc_feature (357)..(357): n is a, c, g, or t
ccccccngaaaaaacctcctaaattaancattgaaagaagttgcggttccttccctcnagaaaatgcactgccgaaagtacagaaaagtaaactggatgtagtttttttnttttttttgagatggggcagtggcaccatcatggctcactgtggccttgacctctaagttcagatgctcctccctcttcagcctcctaggtggctgggactacaggcgtgtaccaccacacctatttttttgttttgttttgtattttttgtagagatggggttttgccccgttgcccaggctggttttgaactcctgggctcaagcgatgtgcccacctcggcctcccaaagtgctgggattactnatttgagtcaccatgcc

SEQ ID NO: 639499 - DNA, 633 bp, Homo sapiens
  misc_feature (402)..(402): n is a, c, g, or t
  misc_feature (407)..(407): n is a, c, g, or t
  misc_feature (427)..(427): n is a, c, g, or t
  misc_feature (443)..(443): n is a, c, g, or t
  misc_feature (447)..(447): n is a, c, g, or t
  misc_feature (449)..(449): n is a, c, g, or t
  misc_feature (541)..(541): n is a, c, g, or t
  misc_feature (543)..(543): n is a, c, g, or t
  misc_feature (552)..(552): n is a, c, g, or t
  misc_feature (571)..(571): n is a, c, g, or t
  misc_feature (584)..(584): n is a, c, g, or t
  misc_feature (596)..(596): n is a, c, g, or t
aattaaaaacccaacaaatgtttttaatacgtccctttttaaacccctttttaaaagcacaaggtttttatatttccaagctgttgatatctttctaaactgttttaggttatagtctattgaaactttttaaatccaattttataaatataaaaattataattttatattaatgggaccaaaaatacattttttaaggttaaaagcatgcccttcatgcatacttgcttttggggagagtggggagaacacattttaataatcagtttgtgaaatagcttctgttggaaaccttttgaggggaataaggaatggtcatttaaaatgagagattttggattttaatgcagttcaaagttgacccgtatttttgttgttgattaatcgggattttttttaaanccttntaaaacccagtgaattcaancccttaattaggacanactntnttatgtaatgcataaagcaatgccagtccctgagaacatttaaatatatttatattcctggagaaacccattctcatttttgttggtttatnanaaattattnttctaaatgcatcttttanaactaggatttcnttttgtgggtanagcttatgtaataaattttaaaggtgaaaactctctt

SEQ ID NO: 639500 - DNA, 315 bp, Homo sapiens
ggcgctagcagcgcgtgacttagtgtgtccccctcgactcccttcacacaaatcccgccacaccacggaaattcggggatactccccagagggtcccatccggccacgctccctccccccattcaccgatccccgaaccaacccacgtctaccactcccccaacctccatccctccgggccgatacaccctcagtctatactcgcacgcgactccacctcgtggaaatcccccgccccgaaagcaccctgccccgccctactccatccatgctcggcagtgtaattgatgtggcttgcgcatgatacggggggaa

SEQ ID NO: 639501 - DNA, 949 bp, Homo sapiens
gctcgcactctgttcttccgccgctccgccgtcgcgttactctgccggtcgctatggcacatgaatgagatcgccgcgctggtcattgacaatgagctcctggctagtgtgcaacagcatggtttgtagcatggggactgacgcatccctcggagtcgcgtgtttgtcctatcctatctgtcgggcgacccctagacgaccaggggcgtcatggtgggcatgggccagtaaggactccatacgtgggctgactgaggcaccagaagcaagacgtggcatcgctgactcgcttaagtaccccattgagcagtggcatcgtcaaccagactgggacgacgatggcagaatgatctggcaccatgaccttcatacaacgatgctgcagcgtggccccggaggagcacccagtgctgctgaccgaggaccccctgaaccccaagggcaacagagagaagatgactcacgattatgtttgatgaccttcaatcagtccctggccattgtacgtggctcatccaggccgtgcgtgtccctctacgcctctggagcgcaccactggcattgtcatggactctggagacggggtcacccacacggtgcccatctacgagggctacgccactccccacacagcctatcctgcagttctggacctggtggacgggactgaccgactacctcatgaagatcctcagatgagacgaggggtaccagtttcaccaccaaggacgacgcgggaaatcgtgcgcgacatcaaggcagaagctgtgctacgtcgcctggaattcgagcaggagatgggcaacgacagaatactcctcattctctggagaagagcctaagaagctgccgatggccaaggtcattcacattggcaatgagcgagtccggtgtcgagaggcgctgtcaagcttcctactgggtatggaatcttgcgggataccgaaac

SEQ ID NO: 639502 - DNA, 248 bp, Homo sapiens
cagttggaaatgagaattcataattaccagcaaaatttaaggaaaactacggctgctgggttgggatttctgccagctagctggtacgggcttcttgtttcaagagatgaacctaaatgagataggaagcctgtcccatagcagccttcctctcactactttccgggcatttaatgcaacaaacttatcacactcactcaccccccacattaacaacataaaaccctcattcacacgagaaaacccca

SEQ ID NO: 639503 - DNA, 917 bp, Homo sapiens
  misc_feature (213)..(213): n is a, c, g, or t
  misc_feature (385)..(385): n is a, c, g, or t
  misc_feature (430)..(430): n is a, c, g, or t
  misc_feature (598)..(598): n is a, c, g, or t
  misc_feature (726)..(726): n is a, c, g, or t
  misc_feature (787)..(787): n is a, c, g, or t
  misc_feature (892)..(892): n is a, c, g, or t
tggggatcctgggaggaataggagaagccgaagcgtggcctgggagattggcagtagcagtcgtagaggcctacgtagttgggaggttgagacttgtacataggaacgggaggcctccataatggctagtaacacaagaggacaggttaagctgtgtgatttggagttagcactcagctggtgaattctatagccaagacgtatgttggaacnaatgctatatggcgcctgaaaggatttcaggggagcagtatggaattcattctgatgtctggagcttaggaatctcttttatggagcttgctctgggaggtttccatatcctcagattcagaaaaaccagggatctttaatgcctctccagcttctgcagtgcattgttgantgaggattcgcccgtccttccagttggagagttctcggagccatntgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggccccngtgaggctgccgcagggcactgaaagcccaggaccagtaaccaaggagaacaacccacccgtcgcccttctccgtatgctgcctgcgccagaagagctttgctgggcctggcttccctgccctcgccntcacctctgtcagcaggtggccttgcctggggagccccatgtgtggcccaccccaccaggncatccccataccttctggtttgaaggcgctgacactggcagagaggtaaagggtggggcattgagaatggaggctccacagggtacctgcccacttctgttttcntaatcttcttctgtataaagagtaa

SEQ ID NO: 639504 - DNA, 393 bp, Homo sapiens
  misc_feature (340)..(341): n is a, c, g, or t
cagtgttattaacaatagccaggaggtggaagccacctaaatgtccatcaacagatggatggataaatgaaatgtggtctatacatacaatggaatattattcagctttaaaaaaggagcaaatcctgccatgtgctacaacgtggatgaaccttgaggatgttttgctaagtgacataagccagtcacaaaaagacaaacgctgcatgattccatttatatgaggaatctaaagtagtcaaactcttagaaagtagaatagtggttagcaggggttagggggaggggaaaaagaaaagttactgtttaatggctatagagtttcagatatgcaatacgnnaatttctgggggattcttttgcaccaccaatgtgcaccgtataattccactt

SEQ ID NO: 639505 - DNA, 868 bp, Homo sapiens
  misc_feature (868)..(868): n is a, c, g, or t
atgacaaaaatcacatgtttatcttaatagatgcagaaaagtccttgacaaaattcaacagcctttcatgctgaaaactctcaataaaccagatatgatggaacgtatctcaaaataataagagctatttatggcaaacccacagccaatatcatactgaatgggcaaaagccgcaagcattccctttcaaaaccagcacagggcaaagatgccgtctctcaccactcctattcaacatagtatggaagttctggccaggtaatcaggcaagagaaagaaataaagggtattcaattaggaaaagaggaagtcaaatgtctctgttgcagatgacatgattgtacagttagaaaatcccattggtctcagcccaaaatctccttaagctgataaaaaacttcagcaaagtctcaggatacaaaatcagtgtgcaaaatcacaaacattcctatacagcagttaacagacaaacagagagccaaatcatgagtgaactcccattcacaatgtgctacaaagagaataaaataccaggaatcaacttaaaagggatgtgaaggacctcttcgagaataaaaaaccatggtcaaggaaataacagaggacacaaacaagtggaagaacattcatgtcatggatagaagaatcaatatcatgaaaatggcatacacccaagtatttaaagattcatgctttccaataagcacaattatttttcacagattggaaaactattaaatttatggagcaaaaaaaaaaaaaaaaatgttggggtcggcgaaatttaaaatgggggggccaagagaaagtaagaagaacggggggggtacaaaaggggggggaaagtgttgtcacagcacgcgccgn

SEQ ID NO: 639506 - DNA, 358 bp, Homo sapiens
cacgagaagaagtcgatgtttccaaacagcttcattcaggaggtccagagaatgatgttacaaaaatcaccaaactgagacgagagaatgggcaaatgaaagctactgacactgccaccagaaggaatgtcagggctacaaaccactgagtaagcagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttgctttgc

SEQ ID NO: 639507 - DNA, 253 bp, Homo sapiens
agccccgggggggggggggccaagtggttccaaaaaaacctgtttttgaccaaaacccctggggtgggggcaaaaaccccggggcggggtttggggccaattgggaacccggggttttttggttttggtctgggggaagggggaagccccccccccaagggggttaagggggatttttttttttgccccccccccggggggggggtaaaggggcccggcgggggggggccccggaaaaagggcttttttttta

SEQ ID NO: 639508 - DNA, 468 bp, Homo sapiens
  misc_feature (468)..(468): n is a, c, g, or t
ccagcttggatgacagagaaagagctggtctctaaaataaataaataaataaataaataggctcagatggtggtggtatcaacattttcatgccagtgatttattctataactccatttacattttgtttgaatttccctttcagtaatattacatttcatttcttggcttcattttcatctttattggtaaattcactctttcaattagccatttttaggaaatgtcatatgaggtgattactgggaaacacataggaaacacaatgacatgctttattgtttgtgaatgaactgagcaagagatgcccagtgagcaaccatcaatgactttgaagagtgatgtagttggtcacctattataatgtgcatctgttatttacatagtgatttgtggactgaagagctagcaacaaagtttgtactttattcaatgattaatagttaatatactatggtaactgaaacn

SEQ ID NO: 639509 - DNA, 452 bp, Homo sapiens
  misc_feature (8)..(8): n is a, c, g, or t
  misc_feature (267)..(267): n is a, c, g, or t
  misc_feature (335)..(335): n is a, c, g, or t
  misc_feature (350)..(350): n is a, c, g, or t
  misc_feature (395)..(395): n is a, c, g, or t
  misc_feature (402)..(402): n is a, c, g, or t
  misc_feature (436)..(436): n is a, c, g, or t
  misc_feature (450)..(450): n is a, c, g, or t
tatttagnagcattcaagagttagattgtaaataaacatattatgagtaattaagatcgccatttattataaataccaactaagttaaataatactattttaactatcccctttgagctggagttcagataccttttctcaaacatgaataaaatctttagtgttgtgttgccttttctttcaccatctggacccaaagcttccctttataaactaaatgagacctagaactcttgacagagccttcttcccatctattctaatggnaaactaacctttctgtgggttagccccaaagcattacttcctgttctcggctttctagggctggatanctcacaaggggattncacacattcggaaaagtcagcagcagttctgtgtctttcacccanacccganttactgagatgagtatttgcacatgctgtccttncaatccactgtganag

SEQ ID NO: 639510 - DNA, 158 bp, Homo sapiens
gatctctatgaggatccccatgactgcacgagcggtatgcacacgttagaacgggaagaatgggtggcaatggtgtgctcctggatggagctcagcccagcgagaggttgcccttgagctcggggcccttggtttcctgtcccctggggatatttata

SEQ ID NO: 639511 - DNA, 356 bp, Homo sapiens
tctggaccgtctcatatactaccagatgaggttgggtgtggtgggtcatacctcaacccagcacttaggaggcgaggaggagggatcacttgaacctagaattcgagctcagcctgggcaacatagcaagaccccatctctacaaaaaattttaaaaaattagccaagcatggtgctgtgtgcctatagtcctagctactcaggagtctgaggtgggaggatcgcttgagccctgggactttgaggctgcaatgagctatgattacaccactgtaccccagcctgggtaacagagtgagaccctgtctcagaaacaaacaaacaaaaacagaaggtaggtatgatgaaggacggga

SEQ ID NO: 639512 - DNA, 793 bp, Homo sapiens
  misc_feature (661)..(661): n is a, c, g, or t
tctttcgcgcctctccgcgctacttggccaccgtcggtgtggaaccacccccatctggcactccctccttgaggccggcccccctcggatgccctgggtacataagggtactcactcctgcgagtctcgccgtcgtcttgcctcgcggcaacgccacaaaatttctcccgcttccacgcgaagcgccgaacggtcgaacatgtctgcttctaaaagcaccccctgggtgacgcgccagctcgtacggcgctcatatttatagggagctgaccaccaaggggcagccccaaataaaatgatatgggggtaaaagagcggagtttccgttcagataaattccacgactcgcgaatagactagatacaactacggttaagacatgatgaggttttcagcgtccctcttacaagactggtacttgtcgcctcgagagagtgctcacatcgtgcttcacacagagtggtgagcactcacctctctgggcgagagtataccacagcacatctcagagtagcgacgcggctctctacatttgtttcgccaatacaaagtacatttttgcggctacaaaaacatatagtgcccgactatattccctctgtcaaacacttcacaaacaccaacaatacttatcttcgcgcaatactaattgtctgtaaangtagatcaccaccccccggtgaactattatacacttacgtgcatcttaaattgctaaacagtcgtcccacccccttatatttgttgtcacgatacacatactccccccaacaatcccccactcaacaaaaca

SEQ ID NO: 639513 - DNA, 735 bp, Homo sapiens
cggcggggggagcagcaacggtgctgcctgggccgccctgtctcatccctccgtccgggccatgggacgcgtgaggagccggaccttggattgtgacctgcgggcgaaagaatcggttaaacggaccaggccaaggcggggagtgccaggcagcgtaggccagcggtggcgtaccaccatccgtcctcccccggtgccgccagcgggcccgtttaagcacggaatgccgacctgcctgctgattagaactgggggagggggaggggaaatgctgggaaagaccgaaccactgggcatgcagctcagagggggaactggaaagaaaagcacaaactctccgctctctctgttagcttgtcatgtagcgataggaacaagaagagccagcaagcttcacagccttctgaaaaccgcttagagacgcgatttggccggcggaaatatttaacttagcttggccccacctctgtgacgctacctccccgagcaccgacttgtgttacgcccgggtgtaaaccagtccattgagctaaagccctagacggagcccagacggaacagaaccaaagtccaccgagggcgacgggatagaacggcgattggctgaacaagtatcgcgcttctcagagagtgcgactggcccgaaggcacacgaattcacctatcacacagcgcggagcgcagtggcagtaaactcacagacatcgaacgactggacatatcaagtccatccca

SEQ ID NO: 639514 - DNA, 410 bp, Homo sapiens
catcattttgtcttggtgtgtgctgtgttgggaagctttggaggttcctaggtacctggtatctggctcccagcagcagctcctgttccttgtagatccatgggctcctttgtgaacagcatacgtttttctccatccttctcactgtggtggcagccttgttcagtgtgcccaagccatgtttggtgggacccaaaaggcaatgtgagaagcagagtcttcatttttggcagttgcttttgtttatttttcaaccagatagctgttgtgtttttttaaaaatgtaagaaacaggactgaaattgtaaatactttgtaaacacaagcatttgtacttgaataggattttaaaaggacaagatgtcctactaagcaaaggctaataaataacctttctacaaaaaaaaaaa

SEQ ID NO: 639515 - DNA, 250 bp, Homo sapiens
ctcgagtacgcgtccgattgtgcctgctgttggcggcgcaatatgcctcctatgcccattaattattcctggagtatacatagtccggccatcgttaacaatccggtaccacttgaagtatatctagcatgcgcaaatttatagcgcccagtatctatcgctgcgcagatctatccatgatgatcattgcatgtctggatccatctatcgagccccggtttataattacctcaggtctatatcccatggg

SEQ ID NO: 639516 - DNA, 922 bp, Homo sapiens
gcctgaggcagttggctcagacaggtcccccacaagctagaataaccctaaagttcaatagatcctgcacgtcaagaccaacctgctcctgcaggctacactatgtactacgcatagcagctagagtagctagcagtatagcagtacacgataactggcagggaacatacctataagtaaagggcaatacctggctacataccgagggcctagctgtaggcatatgtacctatatacccagtcacataggggtaaggctacaagccctagctactaggccagctaattaggaactagggcgccgagataggtacacccgaagaccatagtaggtaccaaggcactcatacctagaagcagctagccacacttcacctctgagcatatcaaacgttgcacagacaagggagtggagagtgttttcgacatcatggagatggaggatgaacgaacgggaacgcgtatgcttcagcttgactagacagcccagattgcagatgttggctcgctacccggtaaccggctaacccttaattcatcgaactattctatattgacggtaggtagcatacagggacagcattccgcacgtggcgggcccaggtagctgggtggcagggctgcaagccttggagccgaacaacgggagggaaagcatcaacaaggacccctgatcacttgggccccccatctatctatcacacatcacgaaaaaaacgatgacacgacggggggcctgcggtaggggcatgggccgactcccggggacgaaatggccccgggatcccacaactcagcccccatccattacctaccccaattccaacacgaaaggcaccttagaagccccatctcgcaagtccacccacaccgggcccccaaggggttatccaaccgcttacggcaccctacaaggccacgg

SEQ ID NO: 639517 - DNA, 260 bp, Homo sapiens
acaaatagcgacctcctggagaaaaatcgaaaacggccaagtggatacctcacgtggttcacgtctgaacaacggcgaatgtgagctacctcagaaccagtacccgaagttgctggaaggcaaccacatttggttcaaacgaggcgtggaagaacctcacgacacgcttacggagtccatgaacgcttgttgcaatccaggaacaattccgcgacacccttcgtctgacaaaaaaccttcgtgacgcgtcgagtatccgc

SEQ ID NO: 639518 - DNA, 328 bp, Homo sapiens
gattgcttgagcccaagtgtttgagaccaacctgggcaacatagtgacaccttgcctttacaaaaaaaaaaaaaaaaaaaattctagatttaagcattttggtaatgcttccatttcactgcttctttcttaactgttttggtgtgattgcgatccattttgtagttcactaatttggtatttaactgaactgatctgtcagatctatcaaaacatgggctgttgatacaatttgagctatttcttcatcgtacctgtgtttactttgagagtttatcagcgaatgtttatcaggaatttggaagcctagcagccaggtgaattctag

SEQ ID NO: 639519 - DNA, 407 bp, Homo sapiens
ataaacctttttttctacatcaaggaactagtctaaaccttattccctactgtttataaaggtttttcgaccacttttagctaatgggagttaagtattttccacaggtaaaagatccccttcagtgtcttaagttccaatctctcaatcccagaggaccgtcaccatgaagttgcagctcgtgctcttaacgtccagtgatttataagctatgcccgcgaacaggccagcacatgcgttcacataaactcttttgtcaaactccagagcagattttgtattaaattcccgttatgaaaccagagacctatttatatccttttcaaagtttttcatagggttctgatcaaggaccgatgcacatgccttgtgctagttggtagctcacacatgttagtccagcaccc

SEQ ID NO: 639520 - DNA, 680 bp, Homo sapiens
cccggattatgcgatgaattgaacctcaaaggttacactgtccagctgagaagaataaaccatccgggcgctgtctctctttgatggaatagctacagggctcctggtgctaaaagaacttgggcatcaggtggaccgctacattgcctcggaggtgtgtgaggactccatcacggtgggcatggtgcggccaaccagggggaagatcatgtacgtcgggagacgtccgcagcgtccacagaatcatatccatgagtggggcccattcgatctagtgattgagggcagtccctgctaatgacctctcctattgtcaaccttgcttgcaagggtctctacgatgggcactggccgtctcttcttagagttctaccgcctcctggatgatgcgcggcccaaggagggagatgatcgccccttcttctgactctttgagaatgtggtggccatggacgttagtgacaagagggacatctcgagattactcgagtccaaccctgtgatgattgatgccaaagaaatgtcagctgcacacagggcccgctacttctgggataaccttcccggtataaacagggcgttaaaatccattgtgaatgaaagctggagctacaggatttatgacctggcaggtagccattcagcaagtgcaggacttattaaaggccatcctcgaaggt

SEQ ID NO: 639521 - DNA, 151 bp, Homo sapiens
agaggctgagaccgaggagaccaggcagaagaagatgaagaagaagaggagcaaggaggctgaagatgcccatgaggagtccaaccaagccaggcgtcagccacttgtgctccagatccgatgagagagagtgacttgatgcatcaccgag

SEQ ID NO: 639522 - DNA, 146 bp, Homo sapiens
acggtccatgctgatacgtgcttgatcttgtgcaggacagcaatctcgttctccatgctgccttccttgccctccaggacctccttgaggaatgcattgggatggcctaccaggttctacgttcctcgttatcttctgccaggatg

SEQ ID NO: 639523 - DNA, 213 bp, Homo sapiens
  misc_feature (150)..(150): n is a, c, g, or t
tcacttgtctttcctggcctaatgtcccttaggtcttttccatctctgacattctttgaggggatgatccttttaacacttcttactatgcattcattaatctaccaagttgcatggcatgagctcagctggcttgaggctagtcagacncattggatcacatgtttcatccctgtaggaaggctcttgctgtatttcctgaacttcagactc

SEQ ID NO: 639524 - DNA, 121 bp, Homo sapiens
  misc_feature (112)..(112): n is a, c, g, or t
taatcagaggctaccaactacaatggccacacgtgtctacacttagcctctatccatggtctacctggcgcatcgttggagctttttggtgtcctttgggtgctgatgtcanatgctcagg

SEQ ID NO: 639525 - DNA, 270 bp, Homo sapiens
gcacaccctcgagcagatacacacacactatattgtatctatcatcatgggatgttgcaaagatgcaagtgagctaacatatttaaaatgcttatggccgggcctgggggctcaggcctgtactctcagcactttggaaggcaggtggatcgcttgagcacaggagtgagagaccaagctgggcaacatggcataattttgttgtatcttgtgtagagacaacattttcgccgtggttgcccaggtattgtctccaactttctgacgctc

SEQ ID NO: 639526 - DNA, 818 bp, Homo sapiens
agcggcttctgcggctgcttaacccacttgttcctcacgccactgacccagcccaaggaaccccaaagctgctgaccatgagcaaacctaatggcccacaccggagtcatgtaaataagtcccctcttcacacatgtttactttaaactccccagtccgcaactccagcaggaaagcctaagggataacgcccacggagcttaggcctggccccacaggccctcctcctctcccccaactctccacacactaggagagctatctgccactcctggacatcctatcagcgcccccagaagcactcccgacctctctggaactttattcactcagggtgatcagatgtctattcaaaacagccaacaatgagctaaaggagtgctgttccagccagaatcctactgctaccacaagtgatgaaagcacaagaaatcctccacaaaggtattctacaactaaacttctgaactaagggttggagaaaactggctctttaaatttcaaaataaaaatcagtttgtctatcaatataaggcaataaatactcattcaccacctctcatgtgccagtaatttctagggcccctatagaaatctgactgctgtgcacataggagggactgacacaaagacttcagtcaccggattcttgggtggtctaaatacgaagagacacttccgggttcctacgatcgctcgtccatcactttttaggattatgattttctaattatttaccgcacctgggactgccggtgatctgcgggtatccgcgcgagggacgaaggcccctctggcgggacctcaggcgcggtccg

SEQ ID NO: 639527 - DNA, 191 bp, Homo sapiens
caccaggagtggcaagaccaaccaagcatggaggaggtgggtctgctcagtcctatgcagcgccggctcagagcaccaacgaagacctttctgaccaaagctctcatcctacccatgagaaccatcatactccagagactaaaaaacgccagtcccagctggagacggggaaggaggtccattcctatggg

SEQ ID NO: 639528 - DNA, 575 bp, Homo sapiens
  misc_feature (12)..(12): n is a, c, g, or t
aggaccccaggntctttcccctcaaattatgtggcttaatagtggtgcctgactttaaagggaagatgtaacgatatctagaataaattatttcatatattattaacactggttgctagtaaaatgtacatacttatattgtaggcatcatgtagtaaactttatctgttcatcatgaaattagtggttctcaactttggctatacactagaattacctggaaacttaaaaatattgatgtccaatccaatttaaatgtaatctctagaggtagactcagaaatcagtattttttaaagctctacagatgatttcacagggtcatcaatgtggatagctgttgcaggaaaccaagaagtggtgttttgtaatagcacaaatatatttataaaatgttttctatagccattttttaatgtagtaattgagcacaaagttgttactgaaaatgctcctaaataaatagtccatggaacaattttattttgctgcaacaggaaaaactgagtcaagctctacaaggtaaattatgctaacaaaacaccaagaaaagaaaatatttcgaggggaaaaga

SEQ ID NO: 639529 - DNA, 216 bp, Homo sapiens
tttttataactaattaggctaaaaaaaccttcaagccccttccaatggaatggctaagcctgatactgttaagagttgctgaggtttttttagcctaattagttataaaaaaaagatttaagaccagaaattgctaaagccataaaagccagtcaatgtgaagccagatctgtcgttcaccaagatgaaggacaagccaggctgagggatcggcat

SEQ ID NO: 639530 - DNA, 539 bp, Homo sapiens
tctcagcgcaagtgggagaaaaggttaaaatcacattggattacagaaatttagaagatgtatgggccaaggcagattttcttctggaatgtgcctctctccggaggccaaagtcaagaaaatatgacatattcacatattggtggtcaacttatgcagcattactcatacggtaggtagttaacatcaacttttacaaacagcttctaattataagacattaagaagcatgacagtggaaatatataaaaggcagtagctaaattggggggtggagatgtaaacatgatgtaatcttcctcatttttcctttaaaaatcggtctgggccgggcgcgggggctcaggccggtaatcccagcacttggggaggcccaggtgggaggatcacgaggtcaggagatcgagaccatccgggccaacacggtgaaaccccgtctctactaaaaatacaaaaaattagccgggcatggtggcgggcgcctatagtcccagctactcgggaggctgaggcaggaagaaatggcgtgaaccccggga

SEQ ID NO: 639531 - DNA, 116 bp, Homo sapiens
attcgccctgtgagatggagttcttcatagcatcgactagtctttaacattatggaatgttctctgcagtggctggtactggttgttcctttccatgtttaatgcttcacttcagc

SEQ ID NO: 639532 - DNA, 193 bp, Homo sapiens
tgcactaatatacgtatgcacatattacccatatcttaatattctcatcaccaataaaatttaaacaaatacacctactcctcacgaagcccataaaatcaaaaattataccaacctgagaacaaaatgaacgaaatctgttcgcttcattcattgtccccacaatactaggactacccgacgcagtactgat

SEQ ID NO: 639533 - DNA, 130 bp, Homo sapiens
agaggatccccccttgtaaaggtgttaacaggcatccaaaggcatcgaggtgcatttgaaaagcccaggccaagtattgccaggatcactattgtccaagtaatcatgtccatccgcaccaagctgctag

SEQ ID NO: 639534 - DNA, 313 bp, Homo sapiens
tgtggagggtgaaatatactccatccagtgatttcttctttgtgctgttgagaggagctggtgttgtaagtcagtgcacgcttagttgctccctgggggcagctcgaggtgaggctccccttacttgcggagattctcttcctctgtgcgcctgtgtctctcccagtgacaggcacaaacactgcacctcaaagctgttccgtcccagtagattaccactggagtcttccagtgtgatgatggtgaggatgggactccggtacatgccgcccatgcaggaacagtaacaattgtagttagagtggatggtggt

SEQ ID NO: 639535 - DNA, 647 bp, Homo sapiens
cgggggggcagaggttgccgtgagccaaaatcatgccactgtgctccagcctggcaacaagagtgaaacttcaaaaagaagaagaagaagaggaggacggacgaaggagaagacacgaaccggaagaagaagaacgaagaagaagaagacacgaagaagaagaagaacgaagaagacagaacgaacgaacgaagaacgaccggagaacgcaagcacgaacgacgacggaggacggacgacggaacaaacgaaacgggaagaaagaagcaagcaagcacacaacacaaacagcagaaacaacaaaaacatacaaaggtgtggggcggcgcccaccccccctaggaaaaacgttctcaacaccccacttggggggggggggcggcggccccggataggtttgaagtgacgacttggcacacaggtgtggctccccagagaagactctgccggctcacaagacacgggggggctggggttctcctcacaaaaaaaagaaacgcccggggggcgagagacgaagcaaggtggtttgtcgaacaaaaaattccgagagggaggttccgcggagacacagcggggggatacaacacaagaggacgccgacagcgaaacagcaaaaaaaaaaacccgcgcggcgcggggacact

SEQ ID NO: 639536 - DNA, 572 bp, Homo sapiens
cccctgtgtcgtaaatagtccctgttaacccccgtctggtccccagtttttgctttgccccgagacaagggattgttattattcctcttggggggctctcccagggcacagggtgttaggccctgcattctaatgagcccggcgtggtcagccccaagccccttcgtgcctgtgaaccccctggggccctgatctgcgttaggaactttgcgtgctgttctttgtttgcggactgtgaatggaaaggttggaatggaatgggtggatggccggtggatggccggtggaaagcgcagtgccttgcataccccaaccacggtgggagcgcttttgttgagcactgacaagcctgcagccggaatactatgtgtgcctatttgtgtggaccaaaatagttacaccttagggtttggagctattccagaggaaatgctcaccacagagcagctaaaccccaggactgagcaccctttggattttgaatttcaaagatgggggcacgggcttgcttgaaggccctgctgagtcatctgttagggccttggttccataaagccctgagccagttgaga

SEQ ID NO: 639537 - DNA, 1198 bp, Homo sapiens
tgaagtggaacgcgcggttctacgggaacgtcgtccggttcagtcagagcaccacaggcgagccctaaggctggctgcctcagtgtggcgtgttcatggtcctaccgatgggacctggcgtgttcgcgcccgggatcgcgctctcgttgcagcgaggccgcgctgcatcagacggggcgggctgacgcgagcgtcggggttggacgtagtcgcggagtaggtctgctctcgtggggagagcactcaagatggctagagcctgcgttcaggcatgtcgcaggtttgccgttgatccgccgccatagggtgccgggcgtgcgtcgacggcgcgggccgcctgggcgccagcgcggtgcaggacgcgagggcggctgggtccccaggtgacggaccctagtggcacgggagcggctttggcccctgacctactcgaggcgtcgcgggttgggcgttgcacgtcggatggcgcccgttagtgtagagaccgctcggtccgggcgcaatgctggggggctgcttcgtgcgtaggctcgaggtggagcctgtcctgtcgtgtgcggctctgagtatgacgaacggggctgatgcgtagggatggaccgagtattcctggcagcgccatagcccgaggacgggggtcctttctggcgcgtttgcgcgcagtcgggcctttccctcggaggggggtctgcgatgggtcgaggggatttagcaagagggccgcccttgtgcgctgggcagggggttgcttgaggttcggccatacactcgagggtgccacgcgtgtgcgcaccacgtaacactggggctggggggccttggcacatgtggccgagggcctcccgagtggttggctcccatggcgcctctgggattggcgggcaaacgaactttctctgggttcccaagggtgtcagactcatgcaaggaccagcctttggtgggatagttctcttgccacattgtggagcaaatcacaaccgcgcgtttcagtcaggagggtttgaccttatggattgggccttcgaatattttggacacggtttgcccggataagcatatcagttcacgggtgtgactttcccctttcggaggacgcttcacagagaggagacccccaggggagatgtgtcaacacaccgtgcgggattttacgtaattggagctaccacttgtgtccagggagaccaaaatgaag

SEQ ID NO: 639538 - DNA, 545 bp, Homo sapiens
gccggggccggggcagccgccgtctccgcctcgagggcctggccgggggctgccctgctgagcgctacccacgtgcgtcgcgccactcgcgggcgacccgcggcaaggccccgggcggagcggctcccgggcgccccgaatagcccccaactttgggccgaagtttgcctggcctctccccgccccacgccggtgcgccgtggtccagaagaacaggaaagagggacccagggagatgcagccttcaccgggggtacccgatggctgcgcacctacagctgattagtgatcgtacagctgattcgcgcccgaatgacttgcagaacagggtgcgccggcccgagactgcagagtacgcgatgcgggcatgccggaacgagccgagagtgacctgaggaagacccagcaaagcacaaacatgaacagcagagacagaaatcaacgcctccgaggactagggcaaaccccgaatgggaagccatcagatatcctaacccagaacgaatccagaaaaatgtaacaggtcttccggaccagaatacaga

SEQ ID NO: 639539 - DNA, 419 bp, Homo sapiens
accagaaaatttgaagagttgtatctgctttccttgtgctgcaacagatgcaacatcgccagccatcgacaaatgagcaccagcactctcaccgccaatgtatttcagcggcgccccgaatctggactctgcattatctactagccactccgcggcgtcataacagtcattcggtccagcagaaaaaggattctctggagcgaggcgctagccaacagagaacagcaagaccccgttcgtgtaggctagattctgcaggacaatgtccttgtgattttgcggtttgcagaccccatcctccgccgtgttatgtgatagtagaccgccccgatataggcttgccattttggagggtctaaagaactcggcttgggttgtctcgacctgcatctcgagatggtatactggtctggctcggt

SEQ ID NO: 639540 - DNA, 954 bp, Homo sapiens
aagcactatagcctaccccttaccttgtaggtatccctatgaggcataattgataacagagctccatctgccgtacgagaaagagacctaaaatcgctcatggcgtactcttcaatcagccacatagccctcgtagtaacagccattctcgaatccaaaccccgctgaagcttcacgcggcgcagtcattctcataatcgcccacggacttgacaatcctcattgactattctgcctgagcaagacgtcgagagagctacgaaggcacatcacagtcgcatcatgaatccgtctctcaaggacttcggaactcgtagctcccaccgttaatagctatttgtgatgacttcatagacaagcctcgattaagctcgccttagccccccactattaacctactgggagaactctctgtgctgagtaagccagcggtgcgtcctgagtcgaaataatcacgtctcgctacgttgacaggactcaacatactagtcacgaggccctatactccctgctagcatattgggaccacaagcacaatgggggctcactcacccacgcagttaaggacataagaagccctcagttgcacgcgagaaaacaccctcatgttcatacaccgtatcccccattctcctcgctatcctcaagcccgacatcattagcgggttttcctcttagaagaagagatcgagtcagcgaaatgtcgacgtggaatgatcagattcacagtgaaataggggggggggcggattagaaagatgtgaggggggacaaaagaagcttggcaccccgttctgggaaaaaggcgggcctaatggagggggtaaaaaacaagggagaagggacgtcacgtttgtctgagggaaagggaagcggggtctttgggagacgcactctgtgggggggattgggcgaccaacaggacattgggccggggaaaacttgcggtggtgc

SEQ ID NO: 639541 - DNA, 1458 bp, Homo sapiens
gcggcacccaggaagaggagaagaagccaccaccagccctaccaccaccaccgcctctagccaagttccctccaccctctcagcacacagccaccaccaacccacacccccagcccggccagctgctcaaatccattggacctccgttgactggagggacacaagtactgataatcgaggggacatggagacagaatgatattcacaaccaggactgggaaccattgaaacacacacgtcagatattcccactggaaacacacgagtcaggatgcatacacgaaccatgaacgacaacaccatcaagccggacacacgtaagacgagccacacggggaagtcacccagaacaagacaccactacatgacatgatccagtcagaaacacatatccatacacattagtcatacgtaacagcgattccaacggacggagagacccctggggagcaccagggagaaggacgcaaagggcaggggcaggacaagaaagaaccagatacacacgaggaaaacaagtatgaacacaaacaaaagagaaaaaaaaaaaaaaaacgagaaacaaaaaaaaaaagaaaaacaacaaagacacaaacaagcaaaaaaacacaagaacacacaacaaagagacaacattcagagagaagaaagcaaagcgaacaaaaaccaaacacaaaaaaaaacacaataataaagcaacaaacgaaaagaaacaagagaagaaacaaacaaacaacaagcaagaacgaaaccaaaaataagcacaaataagtgtttatagatgatagtgaaaaacataacaaacaaaagaaaaaagaaataatgaaacatagaaattaactgaaaaaacaaaagttaaggtataaacagaagaaagatgagaaaaagagaaaaaaaaaaaaaaatgtaaaagaataataaaaaataaaataagatgaaacgaaaatgaaaatcataactagaaaacaaatacaagaatgaaaaagaaaataagataataaatacagaaaacgaagaaaaaaagaaaaaaaagaaaataaaaacaaaaaaaaaaaaaaaacaaagaaaaaaacgacaacgaaaagcagaagaaagaaaagaaaatacaagaagaaaaaaaaaaaaaacaacaaaaaaagaagaaaggaagaaaaaaaagaaaagaaaaagaaagatcaaaggaacaaaacagcaacaaaatagaatgcaaaagcaacacaaaaatgagaatacaaacaaaagaaactaacaagtgacaaaagaacgagaggaaagaccgaagaatggaagagagaaccagaaagaaaaacaagcgcaacgaagaacaaaagcagaacaaaaacacaacccaacaaggaagagcaaagaacacaagcaacaccaccagcaataaagaaacaacacaaacaagaaaaaaagcagaaaaaaacaaaaaaacgaaacagcaaacgatagaat

SEQ ID NO: 639542 - DNA, 279 bp, Homo sapiens
tcgttcactagcaggtcagtgacgcaaggttaccacacacagttagatagtgtctgcatgcacatctaaggctatacagcaaaagaaccagaattagtacaaatacaagaactatatttacagtctgatatactcaagactccaaaacatcacgttaatatttacaacaataaaacatgacaaatgaataatccacaaattaaatgtacattagttgctaatagtgctcaactccattcacggggagagagatcagtttgcaaagtcttggttcaaaaa

SEQ ID NO: 639543 - DNA, 423 bp, Homo sapiens
  misc_feature (43)..(43): n is a, c, g, or t
tcccaaagatcgatcaaatgaaaagttgttttttaaaaagatnaaagacatctataaacctttaaccagaccaagaaaaaaaacaaagaagaccaaagtaaataaaatcagaaagaaaactggaaatattacaaccaatagtgcagaaaatcaaaggatcattagaggctactaggagcaactaaatgccaataaatcgaaatatctggaagaaaaggataaatttagagacacatacaacctaccaagattgagccaggaagaaattgaacagatcagtaacaagtagtgagagtgaagccataataaaaggtctcccagcaaagaaaaaacccgggacttgatgacttcatcactcaattatgacaaacatttaaagaagagataatacctaatctcactcaaaatattccaaaaatagat

SEQ ID NO: 639544 - DNA, 296 bp, Homo sapiens
tacagccgtgtgagaatcgttgcaggtgttctcatgccagagctaccccatcttgcaggcagccactagaggtctcgcttctgctgttctcccatccctatgtccattctttggtttggacgagtgagtttgtttgttttttctttttctttttctttttcttttttcccttttatctagctgccaggcgcctatcagtcagggcttccttaaccaccccctcccataccaccaccgaggctgcagtgcagtggcgtgatcttggctcactacagcttccacctactgggttcaag

SEQ ID NO: 639545 - DNA, 680 bp, Homo sapiens
agtgtggggttcaacccaaacctcttagattctggaaatctaaaaaaaatgggcgcgtattcctttaaggcccgaggacacacaaaaaggcctgcacaggccctcccaacatggtgtgtcaaaaaaggtttgggttgggattaatcatctcattcacgcaaaagtttctttcaatgccggccttcttacgaggcttttcacccttccagcctttgccgtgtccgccattcgatggggcatgtgtccccaacgagtgttcaccccaccaattcccttacaatccccattcctgagcccttctgtataagtcgcgccgaacgtttcatcaacctgagctcgttagcgtttaatagtgacgcccgcggccttataattcaagcactgctcagtcatgtattactgggcctcttttttaccctctttctaccagcatagcattacgagtccccgttcacccttgaagagggaatatccgggtcatcagtttctggagccccaggcttgcagagacctcatgtcacagctggataacttgcatcagtataagtgtcaccaaccaaatattatctcccttttcatccattcgtccttttgggtttggaacagccgtcttctatgtggcatctcgtaaatgtggtttgactattaccggacctctccatgtattgctgagggtctta

SEQ ID NO: 639546 - DNA, 128 bp, Homo sapiens
gggctatctgtgaggatgagaataacacaacctccgcctgcacactgtgacaaagataatcacactactgctatcagcaagtattgtcgttcttgcttcaaagcaccagagagagtttggtgtgcacc

SEQ ID NO: 639547 - DNA, 410 bp, Homo sapiens
acctccccaggactgaagactacaggggtgacaagccctcacttctggctgctcctgtcgcctgctgagtgacagtgctgaggttaaaggagccgcacgttaagtgccattactactgtacacgggccgccgcctctgtcccctccgaccctctcgtgactgagaaccaaccgtgtcatcagcacagtgtttttgagctcctggggttcagaagaacatgtagtgttcccgggtgtccgggacgtttatttcaacctcctggtcgttggctctgactgtggagcctccttgttcgaaagctgcaggtttgttatgcaaaggctcgtaagtgaagctgaagaaaaggttccttttcaataaatggtttattttaggaaagcggaaaaaaaaagtcgtatcgatgtcgacgc

SEQ ID NO: 639548 - DNA, 657 bp, Homo sapiens
agtgacgaattgatgagttcagccactgtgaacatgccccgcaattgatggcgcacacaccgtgtctaggaagtggtgtgaaggacctgtgtgacaccctgtcatctgcaaaatcatgggcgagagctcatagaggacgaagactccgggaaggccttggtcgcccaacagcccattggcaaccttctcatgtctggtcacagagaactgatttgtcctcagtacctctccgtccaccttcatgtacacagtgggcaccaccttcacaaagtactggaacatcatggaggcttggggcgcagtgacattggtgtggtccacggggttcacaatgcctggatagtcctccccaaatgacaggtgctggatgtagtgggtcatgttgatgttgtcaaggccaaagctctgcaaagtcatggacgtgcacatgggactgctggaagctcttcccagggggcaaagtggaagtttccggcaccttattgacttccaagaagccatacacctggcagcctttcattcttctgctcctgcatcttctggctgaagccctctcgccggcactgctcaatagtatctgggttcttgaagggccagcctctacggcgatatgcctcccgcacatcttcaaaggtgttacagcacttgatattttct

SEQ ID NO: 639549 - DNA, 513 bp, Homo sapiens
tgaagagatttagcacttggcactagcataagtggccctcagccttgagtacaatcatagacactggactgcaaaccccagggtaacctgtccataaacctcttgagggactttctagtgaatagcacagtcccctccagtcacggtctttaggttgtagcacagagtgtaagtcagttgaaaagtaatgagagtcttgtatcagaatgcaagattaaaaacactagtataaaggtaccccagttatatgtctgctattctttcctctttggggtcaattcagctatgcctttttaacttctctgtctcacgtacagtaagactatagtaataccaatgaatgttattactcatttcttcattgaggtgaaatccttcagaaactgataggataaaactttgcaaatgctatccatttaactagttaaagcacgtaattctacctctatagtgccagagacaatgtaaggtagtggaaatgccacacaggaacgtatcactttcctgactttg

SEQ ID NO: 639550 - DNA, 104 bp, Homo sapiens
agacgcacatgctgtgggtttggacaaatgtatcatgacatgtatatcactattatggtgtcatacagaataatatctgtgcccattacaagggtgatccgtag

SEQ ID NO: 639551 - DNA, 841 bp, Homo sapiens
ttacttctaggtatgatggcttgttttaattgtgccgatgtcggagctgccgctagtgtagaaggagtgctgttgcgctgatctgggtctgcctgctgcgccagagccagagtctgcagcctgaggggatgcctggggcctggagccctgagccctgagcctgatgcctggagccctgagctgagctggcgtgagacctgtgccccctgcctcgtgcccctgctgccgcctgctgtggccatgtgccctgtgcagtggatgtgaagtgagttgcctgaggttgctcctcacataacatgaatgccactagtcatcctgcagtggctacagttggtgcaacctggtgcgtgccacgttccctgcatgcagtgttttagggattttgagaatttgactgctggtgaactctgtccatgttttcaaaccacacaggctatgcccactggaaggtggccaatgttgctgaattcagatgagctccaggagttgtacgaaggcctgatgtgctgaacaacatgaataaatattgactacgtgctcacagggttatactaggtgacaagtcgttccttggcacatggtggtggacattgtgcaggagctgaagcagcagaacccaaggctggatgtacgtgtgtgatccagtcttggggttgacaggttggacgggcgaaggctcggatgtacgttcccggaggacctccttccacgtcttacaaaggaaaaagttggtgccgcttgcagacatttatcacgcccaaccagttatgagggcgagttaattgagatagcggaaaatcacaagccatgaggaaccttggggttatggacatttgctcta

SEQ ID NO: 639552 - DNA, 982 bp, Homo sapiens
  misc_feature (585)..(585): n is a, c, g, or t
gtatttcctcacgcaagcaaccgcatccataatccttctaatagctatcctcgttcaacgaatatactctccggatcaagtgaatccataaccaatactaccaatcaatactcatcatgaagtaagtcataatggctatagcaataaaactaggaatagccccctttcactgtctgtagtcccagaggttacccaaggcatgccctctgacatccggactgcttcttctcacatgacaaaaattagtcccccatctcaagcatataccaaatctctccctcactaaatcgtaagccttctcctcacgtctctcaagtcttatccatcatagcaggcagtggaggtggattaaagcaatacccagcatagcgcaaaatcttagcatactcctcaagtacccacataggatgaatgatagcagttctgaccgtgacaagccttaaggtaagcattcttaattttaacctatttatcattatggctaactagtaagcggattcctactactcaagttaaactccagtagcgagaacctgatactatttcggacttgaaacaagattagatgagtataaccgttaaatnccatacaaccttcatttcctaggggggctggccccggtacgcggtttggcgaaagggcgtctcggagaatcccaaaaaaaagggcgttaaccgcgatagggacaaaccccttagaacttttttaacacgcagttatttacctaataaagattcccatttaaaggaaataagaggtgcgggtaaaacagcagcactccactaagctatgagaagagaatgccccattattattttaaacaaaaaaaaagagggcgcgcgacaacataggagacgagacacgcagatatttacagctggtatttcttgtttctctttactctattgagggagtagagaggagaagcataaggatagaaacaactagagagagaacggacagacaagagaagaaggcacc

SEQ ID NO: 639553 - DNA, 115 bp, Homo sapiens
aagaagcacctcacatgccctcccggggtctatagctaactggagggtttatgattggtgcatgtgttgcttccctatatcgttggagcaccctatctcaagtcagagactccat

SEQ ID NO: 639554 - DNA, 805 bp, Homo sapiens
cccactattagatgatagctgtgaccaagtctgcagagatcaccccaggacgctgcagacctaattcacagactggaaaatgcatttcaggggaagattgatgctgcttatttatgagaccagcaaatacctgttggatgtactcaataaaaagtacagcattgctggaccacatgcaggcaagtgaggcggtaccatgcttcataggtcaaggagactttataaggcacttaatggacttgctaaaaccagaacttgtccgtccagactacgacatatagtatacagcataacattgactggaattctagaaaccgctgtcagagccaccaaacgcaacagatttgaacagatcctgaagattccatgcagaaaagactggaacagatgacggatgcatggaagggtcatctacacagagtgaacacatggaatgggaatgtcattcaaacacatcgaattatcatgattagaaggacacaaatagcaacatgatataaacatcgatagacatgttattgaggccaaactaaccatacaggaataattaaaaaacttcacttcctggaaggggcgaaaagccgaaattagtaaataccatcccattcaatagaaacatacggagaaaggggaccacaaagttgacaaatggacaaaagataccatgaaaaaacactgcccacagaattcatccgaaagtgaatgacacaaggtgatcaacattagggcacatcaggagatggtccatatccattcaactcagacatgcatttacatcacattgaaagtgaaagacagacaatgg

SEQ ID NO: 639555 - DNA, 264 bp, Homo sapiens
ctctagatgctatgactctcagctgttatatgcccatttactctttccaccttagaggagataaagtgtcttatctgacactgtaagaagggcaaatagcgcacacttggttcacatcaaccatgtttgttttgttattaacctgactttgggacatacatgttcattcaactcctccagggttagggctggttttgtaattctgcggcggatggaagggaaagcctacttcattccaaagttgtcttgaggtatatctaaacg

SEQ ID NO: 639556 - DNA, 106 bp, Homo sapiens
ttttcctccattgagaatgtgacctaatttatgacaaatacgtagatgctcatgtgtatcacttctagttttactttcaaaaatcaaaaaattgagacatgagtct

SEQ ID NO: 639557 - DNA, 149 bp, Homo sapiens
gaccagaccgtaaatcagaaaaccgatcgaatacgagcataatttcttcatgacattgtctctaaatgtcaagttgttctggaaattttttctcgattgtatgattccgtgccttattcattgagacaaactgagttagcatgatgttg

SEQ ID NO: 639558 - DNA, 467 bp, Homo sapiens
atcctagatattttagacatccaatattagagctttaaaatacatgaaacaaaattaatagaatagcaataagaaatagaaagatacccagttaactggagatttcagtagttttctccaaataattgatggaatgagcagatagaaaatgagcaacagtataacaaacttgaacaccactgtcaactaacttgatctgcttggcatttatggaacaattcacccatcaacagctgaatacatgggttttatttttttccaactacatagagaacgtgtaaaaatatatgccatattctggcccataaaacatatctcagtacatttgaaagaattgaagtcaagcaagatgtactttctgacctaaatggaattaagttagaaaccagtaacagaaagattgtaaaattcccaaacatttggtaaataaataacactttaaggtaacccatggattaaagaaatga

SEQ ID NO: 639559 - DNA, 239 bp, Homo sapiens
  misc_feature (103)..(103): n is a, c, g, or t
tctgctgctgcctatgggtcctgatgtcccccaggcgaaccaagatgttcattactttctgacctacatctacactgggctgtccaagcatgttgaagacgcncccgcatttaaggtccttgctcacttaacgacttccgattctttgatacagtagtaaagacaaacggtatcagccaatagggctttatggacacgcgacggctatgtagcctcgtgcgtcagctcgtcagcccgca

SEQ ID NO: 639560 - DNA, 222 bp, Homo sapiens
aatgtagttttatatgtatataccaaatgaatttctgttctgggtctctctgttttatgttatgaagccattcgctcatatacaataatttgtcaaggactttaatcatacttgttccaaaaagtagtaaccggatggaattttagtatttacaggcattggtgctaaatggtacattttatgtgttaaaataaacattgtttttgaggccttgaaaaaaaa

SEQ ID NO: 639561 - DNA, 169 bp, Homo sapiens
atattgtgctggtctcaaacctctgagctatgcagtcctactgcctagtgccttccaaagtgttgggattacaggtgtgagctgccatgtccagtcacaaaaatcttcgagtgtaggcaagctgtcaagctcacaatggcagacaagaaccacaccagcaaagaaccaa

SEQ ID NO: 639562 - DNA, 242 bp, Homo sapiens
tgaaagatagcatatggcggagagatggcatcagttgcaatttataaacctgtcactgattttttccttcaactgtggatgcaggcaaggtggatgatgccagagctctcctacagagatgtggtgcaatggctgaacaaaccccgattgtgttgttgttcctccttaggaattctaggaaacgaggaaaggcatcaacggtgaaatctgtgttagaattgattcctgaatcagctccaacg

SEQ ID NO: 639563 - DNA, 875 bp, Homo sapiens
  misc_feature (663)..(663): n is a, c, g, or t
atggcacatgcagcgcagggtaggtctacaagacgctacttcccctatcatagaagagcttatcacctttcatgatcacgccctcataatcatttaccttatctgcttcctagggtcctgtagtgccgcttgttcctagatcgagctcaccaacaaaatgtaactatatactaagcatctcagacgctcaggaaatagaagaagcgtgctgaactatcctgtccgtcattcatctctagatcctccatcgccctcccagtccctagcgtcatcctttacataacagatcgaggtcaacgatccctcccttagccatcaaatcaattggccaccaagggtaactgaaccctacgagtacgccgattacggcggagtaatcttcaattcctacatacttcccccattattcctagaatcaggcgactgggactccttgacgtagacgtagtcgagtagtactcccgattgaagcccccattcgtataataattacttcacaagacgtcttgcactcatgagctgtccccacattaggcttaaaaaacagatgcattgcccggacgtctaaaccatacatttcaccgctacacgatcgggggtatactacggtcaatgctctgacatctgtggagcacacacagtttcgtgcccatcgtctagatnattccctaaaatcttgaaatagggccgtttttaacctaattggaccccttaacccctttagaggcaaaagaaaaaaaaaataaaacttgggggctctgcgaaaagtttcaacaccctcggggcgccggccaaaatgacggcactcccagacacctcaaagtgggttcccaaaccggggccggcggacccggggggtcggttccagccccggg

SEQ ID NO: 639564 - DNA, 787 bp, Homo sapiens
  misc_feature (74)..(74): n is a, c, g, or t
  misc_feature (178)..(178): n is a, c, g, or t
  misc_feature (205)..(206): n is a, c, g, or t
  misc_feature (215)..(215): n is a, c, g, or t
  misc_feature (233)..(233): n is a, c, g, or t
  misc_feature (253)..(254): n is a, c, g, or t
  misc_feature (260)..(260): n is a, c, g, or t
  misc_feature (268)..(268): n is a, c, g, or t
  misc_feature (270)..(270): n is a, c, g, or t
catgtgctactggattttcgggcgctgctgtgaagctgaattcggagccggtccgctgggcggcgggcgccggnggccggaggggcgcgcgcggcggcggcaccccagcgtttaggcgcggaggcagccatggcgggcaacttcgactcggaggagcggagtagctggtactgggggnggttgagtcggcatggagtgcggtggnngctgctgangtggccagctggcacggngtgttcctggtgcgggactnngagcancagccccngngactatgtgctcagcgtctcagagaactcgcgctgtctcccactacatcatcaacatgcagctggccctgctgccctgccgtgtgccacctgtcgcccgcccagcctccgccctggggtgatgcccctccagactcctgaataggagatcaagagttttgattcatttgcctgctttactggaattctacaaaatacactattttggacactacaacgttgatagaaccagtttccagatccagtgcagggtagttggagtgattctcagtgcaggagtgaggcggagtatgtgcgagccctctttgactttaattgggaatgatgaggaagatcttccctttaatgacaggagacatcttgagaatccgtgacaagcctgaagagcagtggtggactgcggggacagcgaaggccagagagggatgatccaggtccttacgtcgagagttagactgctccgctcgttctggtcgattggggtaccaggggtccccccacagcctgggggccggacc

SEQ ID NO: 639565 - DNA, 435 bp, Homo sapiens
acaatctccatggtggcatgctgggcaggactaaatgaagggacaacacacacttaccctggcatcggtatggcagctgatgagaaggtacacatcgaatgtgttatcggatctaggagagggtgaaaaagtaaatgctgacattctaattaaatgggtcaatccagcactcttaaaagtgcaaaccaaaacagacttctatttcccagcttcaaggcatcacaatctcatacagcaccaagtttaccgtgtcctcagcattcaatagcatgcacatagcgaccaaatgcatgattccgtcaaagcacaatgcatccaggcagcagcaacaacttcatctgcatgcaggcacaagctgcaaccaacgctcaaatacgcccaattcaagtagctcgcaaagcatcggtgccggcatatatagcatatactggatga

SEQ ID NO: 639566 - DNA, 140 bp, Homo sapiens
agactcagataacgtagtgactttaatcgttgaacaaacgaactttaatagcgggtgcaccctcggggatgtacctgatccaccatcgcggtcgtacaaccctattgttgatatggactctagaataggattgcgctgtt

SEQ ID NO: 639567 - DNA, 312 bp, Homo sapiens
tcccgaacagtctccttgctatcctcaaacatctaacatactctcattcttgctgtcttatctgtctggaacgatgcctcccacccccagaaatggtttggctggcccccaacaatcttactcaaacattatttttcagaaggttttctctgatttcttttctccatagattattttcccttctgacaaaaaggcaaaaaaatatacttagagttttacttacttattgcttgtcttttcccatgaaggcagagattgattgctactgtgactcgagatcactgcctggagtacagtgggagctcaatcata

SEQ ID NO: 639568 - DNA, 186 bp, Homo sapiens
tgacctggccggctagagcacagctgtatcatcaacacggcggcaattgatagcagcgctgttcgtgggaacatacctatcaggtcagaaagaccaacaaccagagcggaacgaacttgagcggttcaggaaatctgaaatcgctcgtctggaaacgctgaacgtctcaatcaaacaatctgaata

SEQ ID NO: 639569 - DNA, 378 bp, Homo sapiens
ttgctctttttaacttaatttattaagttttaatttcgtaagctccttattctgatctgttctgttgtcattcgttgattgtgtgatggagatcggaggaactgaccaatgcttctggactttctgactggatttatgtatctctctaaggctccttctgatatcatcactgagtagatgttagctgtttatacagtgtttaccacatagtaagcccgttatgtctcataggtgattagacagcttggtcatagttcatcatgagaacttgccttggattatactttctatgtatggtagctagtagtgagggccctcgatgaattatattattgtactggtagttcctctggatttattctaggtgtcatcattcag

SEQ ID NO: 639570 - DNA, 184 bp, Homo sapiens
  misc_feature (87)..(87): n is a, c, g, or t
  misc_feature (96)..(96): n is a, c, g, or t
ttctcatatcatatagcttattctagtgacttcaaacttaagagcagtgagtgcaggactgtgcactatatactaagaaacattgtncctgtcatntattagtggcagatctaacattgagtgtcttcaccagatagacttctactgttcatcaaactcccttcttaactagacctagactttc

SEQ ID NO: 639571 - DNA, 455 bp, Homo sapiens
gactttcatacactactcacagcattggacaggtctcatctagacagaaaatcaaaaaagaagcactcgatttagactgcactatagaccaaatggacctaacagacatggatagaacatgccatccaacacctgcagaatacacattcttctcatcagcacatggaacattctctagaatacaccatatgttaggccaaaaaaccaagtttcaacaaatttttaaaaactgaaatcatatcaagtctcttttctgaccacaatgaaataaaactagaataacaagagaaactttagaaactgtacaaatacctggaaattaaacaacatggtcctgaatgaccatgagtcaatgaagaaattaagaaggaaactaaaacatttcttgaaccaaattaaataaaaatgcaacataccaaaacctgtgagacacagcaaaaacaatactggaaggg

SEQ ID NO: 639572 - DNA, 416 bp, Homo sapiens
  misc_feature (235)..(235): n is a, c, g, or t
gggccccatattgatctgtcaagaaactgttggctgggaactcctgaggtcaggagttcgagaccagcctggccaacatagggaaaccccatctctactaaaaatacaaaaaattagctggccatggtggctggcgcatgtaatcccagctacttgggaggctgaggcaggagaatcgcttgaacctgggaggcagaggttgcagtgagccgagatcgcaccactgcactccagncctgggtgacagtgcaagactccgtcccaaaaaaaaaaaaaaaaaaaaaaaaaaaaaactgtgtgtgtggggggcccttgggcccccggaaaaggtttttaagaacaattcggttggggggggggggccccagggggtataggggaaagcggggcccaaaaggggggttccccaagggaac

SEQ ID NO: 639573 - DNA, 1286 bp, Homo sapiens
  misc_feature (983)..(983): n is a, c, g, or t
  misc_feature (1137)..(1137): n is a, c, g, or t
actgggttgattttaagtaaaattattgtgtatgataaaagtctaatttcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaacaaaaaaaaaaaaaaaaaaaagaaaacaaaaacaacaacaatgcaaagaacacagaaaagcggaaggacagaagcacaagaaccattgccacagcaaaaaataagcacaccagaactagatcaataacaaacagagcacacgacgaaacgcagacacataacacacgcaacgacatacaccaacacacaaataacagataccaaacaacaaaacaacaccacaacagacagacaacccaacacacacaccaagacacagaaaaaagaagaaggagactacacagaagtagagcacgtagacagcaacactacaagaagaaaggaataataaaacaaaaggagcaatgaacaagaagccagaagcagacaaaaaagacacagaacaagtgacgaaccagacatccaacacagagctagcaagccgaacgagacacctacagatcaatcaaagagcaacgcaaggagacacacacagaaaaaccacgaacgaaacaaacaacaaaaacacgacaagaacacagacaccataccacaatcaaaacaacaccccaaccatacagtactagacgacataaggagagcaacatcagacaagcaacaaaacatacaaatagaaaaagcgaaactagtagtcacagtagaacgacaagagacaacatacacgagagaaaaggagaagtaataggagagtagtcaagaactcaatgacagaacagaaacaaatgaaatgaacacaaactggacacagaaagagcatgtcaatacgatgaacacacacacagaagcgactaaacgaacaacctacaaagcacaacaaagacatgaggaaancaccgacagaatgaacagcaatatgagtcatcagacaaacgacacaacaaacatctatcgcgacacagtgagcacacgaatcgtcatcgactagaagacgtaggaacacagcagatacaaaacccaacgaagagaagaaaacgaacagacaacnaccatgagaacgacatacatgaagatcctagaacgtatagacaagcacccacatgaatggatagacgaagaacgacgcacaagaagcagtgacagagaaatatcacgagcaactacagacagagatacggacacacacaagatgaaacc

SEQ ID NO: 639574 - DNA, 395 bp, Homo sapiens
  misc_feature (158)..(158): n is a, c, g, or t
  misc_feature (181)..(181): n is a, c, g, or t
aactgactgaattaagacctaaagaggtgggaagtaaagcccttttaatgtatcgctttacattatttgactttaggccccatgtggatgtttgccatattcaaataattaattccttaaaaagaagatgaaaatagaaggtgggcgcagtggctcanacctgtaatcccagcacttcganaggctgaggtgggtggatcacttgaggtcaggagtttgagaccagcttggccaacatggtgaaaccccgtctctactaaaaatacataaattagccaggcatgctcgtgggtgcctgtagtcccagctactcgggagactgaggcagaagaatcacttggacctggggtggcagaggtcgcagtgagccgagatcatgccactgtactccagcc

SEQ ID NO: 639575 - DNA, 261 bp, Homo sapiens
  misc_feature (219)..(219): n is a, c, g, or t
  misc_feature (244)..(245): n is a, c, g, or t
ttgctggttggcacttcttaaagtatttgattacgcaactggagaatgaaaagtgtatattggtgacgccaacctcagatttctgagcactcctgctctgtggtgagaatcagacaaaaatttatcggggtgaaaaaaaaaaggcattacctgatttcacaccctttgtcttgcgtagccctctttccattcatttctacacacagacactttgctctngttaaatccttctctctgttctcannaaccaagcaaccccgt

SEQ ID NO: 639576 - DNA, 157 bp, Homo sapiens
aagagcttgaccaatgactgggaagatcacttggcagtgaagcatttttcagttgaggacagttggaattcagagcccttctatttgtccacgacgtgctccttttgatctctttgaaacagaagaaaagacaatatcaatgtatgtacgcagagtt

SEQ ID NO: 639577 - DNA, 434 bp, Homo sapiens
catcgatgtacctttgctaaggttagaatgaataatcttctggtatcgctaatgtgaatagtcggtgcttaaaaatgagccaagactagaggggacactatcgcctaaaatcagtttggacaacaagacctagaaagggaaggggatggggatcgtggggagagagtgggcgaggtgccttaactacatgtgtgatctgaaaaccctgcttggttctgagctgcgtctattgaattggtaaagtaataccaatggctttatatcatttccttcttccctttaagtttcacttgaaatttctcaaaatcatggctattgaaatcgttgggatctttctgtcttctgggttccattttttaaatgtttaaaaatatgttgacatggtagttcagttcttaacccatgacttggggataatgcaaaacattactgtc

SEQ ID NO: 639578 - DNA, 293 bp, Homo sapiens
  misc_feature (33)..(33): n is a, c, g, or t
  misc_feature (242)..(243): n is a, c, g, or t
  misc_feature (246)..(246): n is a, c, g, or t
gatcattcacagtgaggacagacacaggtgaanctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaatagannagnaagagtctgaagcagtctggaggtaccgacgctcgattcgtatctgt

SEQ ID NO: 639579 - DNA, 865 bp, Homo sapiens
ctcatgagctcaagtgatctgcctgcctcaacctcccaaagtactacaattacaggtgtgagccaccgtgcccggccatcttttcaccctcttaacagggttttatacagagcaaaagttttcagttttgataaagtccactttactgatatttcctttatggactgttgcttttagtgttgcatttaagaacaactctacctagtcttagatcccaaaggttatctgttttttcctaaaagaagttttatagttttaaatttaagtatgcatgtgagccatgttaatttttgtataatgtgtaagacttaggctaaagttctttttttttaatcctatagctggtccagctgctccagcaccgtttgttgaaaggctgtccttcctccatgaattacttttgcaccttaaagtcagctgggcatatttgtgtggtcctgttcccgtgatgatctcggctctgtcgatctgtgtgtctgtgcctctgccagcattgcactcttggttcacatagctatatagtagatcttgaaatcagctggactgattcctcctctcactctattctttttcaaaatatttttgctataaatttgtatatgaattttagaataaccttgtctacatctacaaaacatcttctaggattttgataggaactgcatttaacctgtatgttaatttgaggagaattgatatctttactgtattctgtctagcaatccatgaacatggcatgtctatttaaatctttgatttcatcacgttttataattttcagcatacaagtccttgcatatttttttttttttaaaccgaagtatttccctttttcagcaattgtaaacagtacatatttttaaaa

SEQ ID NO: 639580 - DNA, 222 bp, Homo sapiens
  misc_feature (18)..(18): n is a, c, g, or t
  misc_feature (45)..(46): n is a, c, g, or t
  misc_feature (171)..(172): n is a, c, g, or t
  misc_feature (175)..(175): n is a, c, g, or t
aatgagccggcccaaatngagtatgggatatcaataaactgaganntgtcttcacaatctcagtttattggatatcccattactctttttgtggagaaggaacgtgataaagaagtaagcgatgatgaggctgaagaaaaggaagacaaagaagaagaaaaagaaatagannagnaagagtctgaagcagtctggaggtaccgacgctcgattcgtatctgt

SEQ ID NO: 639581 - DNA, 967 bp, Homo sapiens
  misc_feature (98)..(98): n is a, c, g, or t
  misc_feature (256)..(256): n is a, c, g, or t
  misc_feature (577)..(577): n is a, c, g, or t
  misc_feature (629)..(629): n is a, c, g, or t
  misc_feature (714)..(714): n is a, c, g, or t
  misc_feature (862)..(862): n is a, c, g, or t
  misc_feature (867)..(867): n is a, c, g, or t
gtattcacaggatacaaaaaccacatatacagagggctgaattcttgtatgcatgtattctgccgggccaactgtgggacttgagtatgcacagattntactatactcaagtgtcctggaaccaattcttcacatataccaagggacaactgtaatgtgaacacaaacccataaacagtgcaacattaccagctttcccaggatgcatgtggctgacagaggagtcagcgtcaagaagggctccactggcggctgngggcctctgagctggagcttactgacaagtggaagatgcccagatgataaggtgccgtgacagattgtggtggtagcattgtgagctggttgacaacacagaactctggaatcagatggcctggattcaaatcctggactcaccccttattggctgtgtgagctaaggcaagttacttgccctctctgtgccccaatttcttcatctgcaaaatgggaataatgataatggcattatggtttactgaaagggataaaagagttaatatgtctacgtacttggaacagcatccagcacgacactaagtgatatggacgtatntgctatttttatacagagcttagtggcatgaagaacgtagacaagcaatgangacttcaaggtggtgtcctggataaaagagaaaatcgttctggaaggagacttacatacatgacagacagagatgttggtgttgnttcacgactggaagaagcgacacgtggcaatacccacctattaatgatgccaccaaaactgtcttagaccatctaccttgcaatcactatctttctgctttgacttcttctagctttcttcttgctaaaactttaatcttttatattngaaangttacctttgccacacattcttttaaatatgctggtggacgaacttctttcaccccaagaacacctgaatctttttttaaattgtgatgccggaagtatc

SEQ ID NO: 639582 - DNA, 276 bp, Homo sapiens
  misc_feature (33)..(33): n is a, c, g, or t
gatcattcacagtgaggacagacacaggtgaanctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaataggaagacaaagaacaagaataggaaaaagaacagaaagagtcgttagacattaccgcgggaggt

SEQ ID NO: 639583 - DNA, 304 bp, Homo sapiens
  misc_feature (33)..(33): n is a, c, g, or t
gatcattcacagtgaggacagacacaggtgaanctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaacaggcaagcacccaagcacagcacgacacaagaaacagcaagcagcaaagagtcggcaagacaaacctgcacattgcacagcatgtccggttct

SEQ ID NO: 639584 - DNA, 415 bp, Homo sapiens
caggatcccccaagcagttaaacagactcaatcagtagactgtgtgaaaagacagaatttttttctttgagacaaagtctatactctgtcgcccaggctggagtgcagtggtatgatcttggctcaccgtagccttcgcctcctgggttcaagtagattctcccacctcagcctccccagtaactgggattacaggtgcccaccaccatgcccggctaattttttggtattttaaatagagacgggtttcacctgtgtaagccaggatggtctcggatctcctgacctcgtgatccgcctgcccagtcctcccaaagtgctgggattacaggtgcgagccattgtgccagcacctgtcttttcttcatagagacagggtttcgccatgtcgcccaggctggtctggctcaaggtg

SEQ ID NO: 639585 - DNA, 327 bp, Homo sapiens
gtattgtccagtgaaaactatccaggcgcagtggttcactcctgtaatcccagcactttgggaggccaatgtggtttgatcacttgaggttaagagttctggaccagcctgtccaacatggcgaaaccccgtctctactaaaaaatacaaatattagccggtcgtcagttacgcgtgcttgtagtcccacctacttgggaggctgaggcaggagaatcgcccgaacccaggaggtagaagttacagcgagccgagatcgtcacatctgcactcctgctcttcagcctgggtgacagtcgaatttgactatctagaggaagtaaaagc

SEQ ID NO: 639586 - DNA, 517 bp, Homo sapiens
  misc_feature (50)..(50): n is a, c, g, or t
  misc_feature (74)..(74): n is a, c, g, or t
  misc_feature (95)..(95): n is a, c, g, or t
  misc_feature (116)..(116): n is a, c, g, or t
  misc_feature (131)..(131): n is a, c, g, or t
  misc_feature (168)..(168): n is a, c, g, or t
  misc_feature (180)..(180): n is a, c, g, or t
  misc_feature (218)..(220): n is a, c, g, or t
  misc_feature (229)..(229): n is a, c, g, or t
  misc_feature (234)..(234): n is a, c, g, or t
  misc_feature (246)..(246): n is a, c, g, or t
  misc_feature (250)..(251): n is a, c, g, or t
  misc_feature (276)..(276): n is a, c, g, or t
  misc_feature (371)..(371): n is a, c, g, or t
  misc_feature (420)..(420): n is a, c, g, or t
  misc_feature (428)..(428): n is a, c, g, or t
  misc_feature (437)..(437): n is a, c, g, or t
  misc_feature (448)..(448): n is a, c, g, or t
  misc_feature (514)..(514): n is a, c, g, or t
tttgtaacgtggtgggatacagccacacccaatatgtatagggctgaggncgatatcctttgggtcaacgagangcttcaaattaaaatgctgcnaaatggcacacaacaaaaganacaactccatgcganccaggccttctccagcacacactcgttttcctgtggnaaatggcttganatagtcactgtacttgagctttccattttcattcaggnnntgttctggnttttncttttctggttntggnnattcttggttgtcatacaaaacagngtccagagttggcactatgtttgtgcccttggggatgaggtatcctctgaaaatggtgtctcgggttgcttcatggggcaggttggtagggctcnagtgtgatgaaccgctgaatctcatgcaccatagcatccatgtagggcntctcttgnctatcgctngatggcagggnttcggcttggcccaatcacctgtcaatttcttcatgggagcttctcttcgatctcaggggtatttnatg

SEQ ID NO: 639587 - DNA, 179 bp, Homo sapiens
gagaaacactacggccattaagagacgcttctttccattcctttgcatcacgtgcaagtcactgataccggggagggggctggctcaccagcaatattgtacctagactgggtcagaaacagatataatacattattcttttacatatattgcttgttaatagctttaaaaatcctcac

SEQ ID NO: 639588 - DNA, 274 bp, Homo sapiens
atactcaggcttgggttccccaccctcattggagggcagatcccgcataccacgataaccccggacaaccacattgcgtacccccgccattctcacacagtgggagaggctgtagcaaggctttctctttgcagaccccatcttagagggaccgtgcttgcccctgtgtcctcaggaggtggaaccctgtaccgtactgaggtcctagggaccttgctctgtctgacccatcccgagctgaccactgggtgagagaggctccactgtgccctgc

SEQ ID NO: 639589 - DNA, 1486 bp, Homo sapiens
  misc_feature (400)..(400): n is a, c, g, or t
gtggttcgtgcctacacttgctcagctactgttcgtcccgggtgtcgtgtatatttttctcttttgcgtgtcgtgtgagtggtgcctgccttcctcgccagctcggtgggtgcttctttctcgtcttttgttgatgtgcgtggcccctgctctttgttctgtggcgcgttttgtctttgctcgctctgtcttgcttgtgtgtgttgacgctcgctctgttgtgttgagaggaccacctggggtgtgggggccttctgtcccttatttctgctgtgtgagcagacgttgtgattttctttcgtgcgctcgctacttgtccacaccacctcgtgtttgcttccaagggggggggaacccccccaccgtgcggtccccgctgccatcttgttcttgtgatccnatcgcggttgttgcacaaacaccgattcgcggggctcccgggggtaatccgactccccggggcccctgtgctttgggaggcgccccctgtgaccaccctgcttgtccggtgcacgataatgtgtagtgtgggcctccttttgaaacccgtgtggtcgcgacacaatagagaaagggcccaacgattccttgtggtgaaccgccgccttggtaatttctcatggtgtcactcatgtccccgtcccgttggcttgtctggggaagactttgggggcgcccttaatctggtgtgggcttaccttcctaatcgtgttggcgccatgggccacgcctgcgtggtcaacccagggggcgaggcttctatcagccctttcgagattctacccccgatctgttcccgcccactcaccccccttcggtatgtttggattttctcctggcgctgtaagggacccaaggtcacccctcttgtggttgtgagcgcttcccacggagcacttcattcgccccaccctgtaagtaaagaagtatgtaatgtgtgaacacccactggaacactggttctttcctcgaaccacctggaaaggacccggtaacctgtccggaacaccgcctttttcttggaaggaaatgttggcctgccttgtcggaatggggaccacgtgctatactggctgagaccaacgtgagttctgtcccacggtgtcgcccacgaacttcctatggaccacacgtgcgcgggaacacagctgctttgaggtgcacacaccacctatcccatcgttcctggaaaaccacgggaaggtggtggacggcctcggagaaggccactttaacaagggcccacggcacacgaagcacgggccctgactgcccccccggccccccttctcgggctctttcaacccacgcctggtactgaaggtgccacagaacgtgctcctgctgagccttttgcggctccgggctgtgtcctaaaatgccaagcaccacctcggccgaggcctgcgccctgacatgctcacctctctggactgccaccctggattgttcttttttaagactccatcatgacttctttacttac

SEQ ID NO: 639590 - DNA, 139 bp, Homo sapiens
ttagatcgcacgggtaggggtgatggcccggcgacgtcagtggatgaccgccgcctccggattctgcacgaagagtccattcgcgggagtctcgcgcaagggcggcaccatggaaatggtgcagctgtgggtcaatcta

SEQ ID NO: 639591 - DNA, 128 bp, Homo sapiens
  misc_feature (116)..(116): n is a, c, g, or t
taaattagccgggggtggtgacacaaaccgggggggccagctatccaggatacagtggggaggatcactggagaccaggaagtcaaggcggcagggggccatgttcacacctctgnactcaggcctgg

SEQ ID NO: 639592 - DNA, 45 bp, Homo sapiens
ggatttgctggtgcagtacaactaggcttaatagggacatggagg

SEQ ID NO: 639593 - DNA, 213 bp, Homo sapiens
acagtactcccacatttaaactccttctcaccccagtgtctggaagagattaatcattacataatagcacccactctggctctggcactgtgtcgcactactggcagagccaaatcagcccaaattagtccctgttttcttccatcccattgcctcaaagtctcagcatgcgatacgcgcatatgcattgccatcaagcctgtcaaccagccc

SEQ ID NO: 639594 - DNA, 108 bp, Homo sapiens
ggtttttaaaaggctttattggggaaacgtagaggggtggggaggtcagggctgcagtgagctgtggcagtgcagaccagcctgggcaacagagcaagaccctgtctt

SEQ ID NO: 639595 - DNA, 953 bp, Homo sapiens
  misc_feature (953)..(953): n is a, c, g, or t
gtattctggaaagtttctctaagactagtgaagaactgaaggagtcctgcgtctttttgtggatctgcttcggtttaggaaagcgcaagattcctctgcttcataggtgtctgcgtggaaggtggtagtggaagtctgcgctgtacagcagagtgtaatgttgaagttgccttacaagaccagggtggggaggggggaagggcgttggaaaaaattagactgtggagacattttggaaaacgagacgacgtgagagtgaacgggatgatgatctggcagcaaatggtcggaggttttagaaagattgccccgcgatgtaaattgttggtgaaccagcctttgatttgttggtgcattggtggacgttgggggggtgggatcaggggcgggaaaagtccacgcatggtcgacgttgtaccctggctctgtggttcaagagcagtgtggcgaatggttctggtcttgtggaaagaaagcgggaaatagatgttgaaagaataggtttgaggggaccctattgtggggggtccattgttgtttttaaaaggacaggcatttgaaagagtggggggtggagattccccaaaacaagaccgtaagtaatacgctgaagtatggcattgttcaggctccttgaggggacgcttttgagggatggtgtgttggaataggcagaatcgttggagcacttaggtcgtgtggatctgaggtgtgggaggctagtggggaagaattcgtcactacatattatagggtatagaaaggagggatattgggcggtatggattgtgtggcctattttacaatttattgtactggggaaacagcgggcagtcccacgttggatgggttggttcacaatttggggaggttttacacacaacgtgtggagctgcgcacagattttattccccaaagggggtcggataacacaatatttcgcagacaaattn

SEQ ID NO: 639596 - DNA, 255 bp, Homo sapiens
  misc_feature (35)..(35): n is a, c, g, or t
  misc_feature (37)..(37): n is a, c, g, or t
  misc_feature (90)..(90): n is a, c, g, or t
  misc_feature (115)..(115): n is a, c, g, or t
  misc_feature (126)..(126): n is a, c, g, or t
  misc_feature (148)..(148): n is a, c, g, or t
  misc_feature (152)..(152): n is a, c, g, or t
  misc_feature (176)..(177): n is a, c, g, or t
tgcctctgagagaagtagagtaggagagggtatangnaggacgctgacaccaggctttcctgtagtacttattcacagagccaggtgctngagtactggtggtggtgtggggggnttgtccattgntcctccttgacttttgccatangagnggccttatttatgggctactggcnntctctcatttgttatgtgtttttttttcttttcatgcagtgatcagaatataatgtccaaacattcaagccgtcagga

SEQ ID NO: 639597 - DNA, 689 bp, Homo sapiens
gcaccccacaccatcacgtagcaggcgtcttccttccgaaacctgcggctccccaagaggctgcgtgtgtctacttcctggcccgcacccgactggcacagcgcctcatcatggctggcaccgtcgtctgggatggcatcctggtatacacagacccagacaggggctgcgtcaactagcctacgactgggccacggtgaacggaagcagagtcgcacatgggggtgagggagacaccaggtcctcgcatgcccgtggcgctagtggtcatggctgtccctcgccagaccaaccggaccactgccttctctcatcttcccacgctgatggcccctaagtctagcctgagaaccagagctgtcgcgcaggcgagtcacctgagcgtggaggtccagcgagaggttgtccatgactaggaccagttcccagaggtaaccgtgggggccgtgaggatgaggaactttggaggaaattgtccttccgccactggccgacgctcttcagctattacaacatcacactggccaagaggtacatcagcctgctgcccgtcatcccagtcacgctccgactgaacccgagggaggctctggagggccggcaccctcaggacgagcgcagtgcctgagccccaccggggcccatagctgctgggcactgggaagcaggaccaagggcccaggtggggt

SEQ ID NO: 639598 - DNA, 941 bp, Homo sapiens
  misc_feature (70)..(70): n is a, c, g, or t
  misc_feature (170)..(170): n is a, c, g, or t
  misc_feature (173)..(173): n is a, c, g, or t
  misc_feature (180)..(180): n is a, c, g, or t
  misc_feature (182)..(182): n is a, c, g, or t
  misc_feature (200)..(200): n is a, c, g, or t
  misc_feature (258)..(258): n is a, c, g, or t
  misc_feature (374)..(374): n is a, c, g, or t
  misc_feature (917)..(917): n is a, c, g, or t
agccactcttggtggcaacctcaaaatcccgcacaattaagaggcaggggaaacaaagacacccccctcnccaagggaggagaagaggagggagggaaccagataagcaggaaatgattgggaagcgtgtgaggagcgaggacgacgggccgttagcacggagaacattngcntgaagtngngaaagcagaaaaagtacntctacaatcacgacagatagaggtgtgacagagagagggagacatagtgacgggaatnaaagccacgacgagcacagagacatagcctcacaccgccagcacacaacccccgcgcgcgacacgcctctctacgcgcgcgcgtagcggtagcgaatatcctaccacgcgccgccntcctcgagccgaaatgttcgaagacacaacaacgtggacgttcatcatggcattctggagcatgataacagtgactcgacattaccaagctacttctatatgaaacaacacataataaaacgagaaagaaagagatagtaagagaggaggaggaaagaacgtgagagagaagaggtggcgagagattcgaaagtgtgtctgattgtggtgtctcgcgagggcagcgccccgaagcgagcacagcaaacagcaattccacataacggaaagggacgggcaaggagtagcaattagatataacgcgtgaagtcaatccgtgagaggacgtcgctcctctactctctctcctgctcagcgccccacccccaccatcccacaaccgcgcatcctgcgcccgaccacacacattacccatctcagaccatcactacaccacacaacgccctaccatctcacacttacatgattcaactcacccactaactgaagacatgttaccattcttcacaccacacccaaccgcacataacactacacttcganactcgcacctcacacacgtagcgt

SEQ ID NO: 639599 - DNA, 427 bp, Homo sapiens
agggggttggacctgtcctttttttcatgcttcaattttttggcgtgtccttttttaggggagggttttttcccccttttttgggttgtaagtggttttttcatttaatcgttatttgggtggggttatccttgtggaattcttgggaggccttcctttgtgatgggctttttttttccaaattattccaaattggttgttttttggtggatgggttatatgtttctcgccgcaaaaattttcccttggttttttgccccaggttccgccgggtgcaaatggttttccggtaaaatggttttggccgtttttccttaacaatttttgttaaaatcttgcataattttccttttaacttttggcctttttttccctaaataaaagttatgcctggtgttttgttaaagttgaaccccctttggttgga

SEQ ID NO: 639600 - DNA, 291 bp, Homo sapiens
tgaattctgtaagttgaattagagtatccccacccagtaaagattctcatcaccatacaggctgactgggccatacatatcaatagagtcccagcagccgccgctggagactctacatctcagcatgaccagcacgtcgaggccatcgaaatctgttgtgaccatggctgtgttgacatgttgatccgacatcgcccgcaatctggacaaggctgaacgcgagtccctgctgctgcgcgcgacctacctcaataagctggacagccctggctatgccgcatcaaactagta

SEQ ID NO: 639601 - DNA, 113 bp, Homo sapiens
tcttgtttcctgcacttcagtcggggtttgggttccttcagctctgctgctccagaaactgtagtcccagctacttgggaggctgaggcaggagaatcgcttgaacccgggag

SEQ ID NO: 639602 - DNA, 194 bp, Homo sapiens
tctggtagactgaattgtaggcatgtgatacatatctagccagggatactacacagtcctgtatgaagaatgcgttctggtcctgtgtaagttgctgacgatgatggtttcccgttttgggcgggtgtatgtgtcccggaatttatccatttcttctagattttctagtttacgtgcgtagaggtgtttatagt

SEQ ID NO: 639603 - DNA, 160 bp, Homo sapiens
  misc_feature (102)..(102): n is a, c, g, or t
tatatggcgaggctgcgggggtgtgtccccatcttcagcacacaacgccacttggcgaagtcagctccgtccttcttgtacttgggcacagcggctcagacnagcccatccaacccttggtgggtagtctcgccatttgtccctgccattggccagcggg

SEQ ID NO: 639604 - DNA, 969 bp, Homo sapiens
agcttactcagctatgcattgactcactcgctcaataacacattgtcttatctgagtgtcctcatgtccttagatatgccccgtatatgacattataaatctacatagaaataagtaactaatgatatgatgtgacaggctctggacataaaacactcgggctgtatgtattcctgtccttggagcgaaacgataccttgaatccgtcatcgacctctctctatgcccttagggctttcctttcatctataataggaaggatcagaaggctccatcggatcctcctacccatattagtccatgcaacattgcaacatggagtcccatgcatagggtgagtagtcatctctaatcgtaaactaaagcttgaatcttagggtatgattgaatctacagttcattgactagtacatgtcgcgcccaatgtattctcttagagaacaagtgacatgtggagtctctttgacagtgtatatgatcggaagtaagatgagctccccggaatgtgaagcaccctctatgtccgtagtaagtgagaattacgagtacgaactagatgactgtactttcgccaagggttcattcgtagccattggccctctagccatggatgggcgtctataagaacatgcatgctaagtaacccggaatgtcctaaaaacataacatctactattacaccacgcttacagcgacctgagagttttacgtacgtgtcacttggctcctggctatatctgcaggaaagcaatatcaaaagcatcacttgacgcaattcggtcctttactaatattcattgtgtcccctagaacattagtccttctgaattatacgcggcccgttatttgagccgctagtacgaagcggcacgtaataagaccacgactaatgatgcccagttaatgaaggaagtcaaattcctaaggatcaagcggccagtttgacagaaattcaccaaaagggggagg

SEQ ID NO: 639605 - DNA, 793 bp, Homo sapiens
  misc_feature (20)..(20): n is a, c, g, or t
  misc_feature (85)..(85): n is a, c, g, or t
  misc_feature (88)..(88): n is a, c, g, or t
  misc_feature (214)..(214): n is a, c, g, or t
  misc_feature (268)..(268): n is a, c, g, or t
  misc_feature (280)..(280): n is a, c, g, or t
  misc_feature (291)..(291): n is a, c, g, or t
  misc_feature (311)..(311): n is a, c, g, or t
  misc_feature (316)..(316): n is a, c, g, or t
  misc_feature (325)..(325): n is a, c, g, or t
  misc_feature (337)..(337): n is a, c, g, or t
  misc_feature (408)..(410): n is a, c, g, or t
  misc_feature (425)..(425): n is a, c, g, or t
  misc_feature (434)..(434): n is a, c, g, or t
  misc_feature (523)..(523): n is a, c, g, or t
  misc_feature (647)..(647): n is a, c, g, or t
  misc_feature (784)..(784): n is a, c, g, or t
ttacatatgatttccacatntttttcacgctaaaacaaagtacagataactctgccaacaatggcaaactgcttccctaatagcnatntgccttttcaactcaaatctcactttatattaggattaaaaaaaagtaaagatgagaaatcattagtatcctgcgcttccaaattatctaatttagccttccaccaaaactgcgtacatttttgantcggctgcacatgaaaagaatgggtgtagcaagaggtgattaaaaaaatttgcnaaaaagtaacanaaaatcacccnttaagtagttttccaaaagncaccngaggcagcngcgccagtcaanagtattagccctgaagaggtagagaatttgagcccataatacaaaaaaagccttggcccagcgcctcccgnnnaggatcaatattttnaagttaganaattttatggtaaaggaaccaggttccaccatttaaagaaaaggtgctggtcactcccatgtctcgataatttgtttattacgtgaganacagaagacggtcaaggacacacacgcacttgattttttttgtccgtctccattatcaagtttattcataagtgaatttgatattaataaatacaaaaaagcatcattcacaacaaagatatanacaaaccaaaataaaccctgcaataaaaccttctatttcagtgagtatcaagaaaaaacaggcagatgatttggtgcagctttcttaagggatcatagaagggacatggttttaaataaagatggcaagatcaatancaatagaca

SEQ ID NO: 639606 - DNA, 132 bp, Homo sapiens
caaacttcgttgaaagcggcatagtctttttcaatgtcttttaaataaatcgttaccgataagatatggctttaatctgtgcctgcatcagctaaaaattggtcaatcatgtcgaatgtttgttgggtttga

SEQ ID NO: 639607 - DNA, 147 bp, Homo sapiens
cactgaaggttataagcaaatcagaggaaatggacaaatagaatatatcaagtgttctacggtagagatttctgattcggagcaaggaatacagtagcacaggctccccttctgagggccacgatgacctccaaggccctttcccag

SEQ ID NO: 639608 - DNA, 320 bp, Homo sapiens
  misc_feature (21)..(21): n is a, c, g, or t
  misc_feature (78)..(78): n is a, c, g, or t
  misc_feature (96)..(96): n is a, c, g, or t
  misc_feature (134)..(134): n is a, c, g, or t
  misc_feature (141)..(141): n is a, c, g, or t
  misc_feature (144)..(144): n is a, c, g, or t
  misc_feature (275)..(275): n is a, c, g, or t
ccgaaaaaccgggcctaaccnaacattcaggacattggcgcctatccctcaaatttttggtcacccgatgcctggtgnatcaccgggcagacgttntttgccaacggtggctatactacccgttaatctcaagntcttctnggncgtgccgcagcctatttatcaggatggacaatcggtggataaaatagggagattacgggtgtttatccaggttgccgaggtgggcagtttcatccgtgcctcgcaaatcctgatgatgccaaaaaccacgntgtcggcggcaatacagcaactggaacatgaaatgggcgctcgtc

SEQ ID NO: 639609 - DNA, 888 bp, Homo sapiens
catggtggccaggcacctgtagccccagctactcggaaggctgaggcaggagaatggcgtgaacccaggaggcagagcttgagtgagccgagatcacacaatgcactcggcctggcaaacaagagtgagactccatctcaaaacaaaaaaaagaaaaaagaaaaaacatacaatttatgaaattgacatgacacattacagtctttatgaaccacaaaatacagttttcagatatatcatggttaatatgtatatataaaatcttaactaaatctcaaacaagggaaaaagtcaccattaattactccaagagaaagaactgttactaactactttaatgcaggagctcgtgcataaaacaagatgagtggatcacaaaacacgcacgtgagtatcacaccagatgaaaacaacacaggtatactcacattatggcattgataatcagagacagcactttagctgcttttcttcactggctagagaaatgggcaagaatcacggcattcaaaggtctacctccttccttcttcaacataaaaccaactaatcaaaaagcaggtattcaaatctttatacgatacccactgactagagtgcaaaatacctcatttgtgtctataatcattatcacgatgggggtaatgacacaaccaaatggatccggttgtaaccgttacgagatggtatcacggcttctggcgtggcacataaggctttatcacaggaccttgaatggtgtataaaacctttgttaggttacgggtcagacataaaacagtattttattcgcaaaatggaaaccgtaaaccaatagacctcccggctaacatgaaacagccagaaagacacttgacaatgacgacaacgaccaaaaggggaccaccg

SEQ ID NO: 639610 - DNA, 130 bp, Homo sapiens
gccttaaactccgggagcctcgtacctctttacgaggacagctgctctgccacagcaagctgttggggtcagctgaaaggcagcagcttccagtggcttctcccaacactcttggggacaaatatattta

SEQ ID NO: 639611 - DNA, 471 bp, Homo sapiens
ggcagaaggacaaagagaacgacaacgagacgcggttcagccttaaaggcaaaaagaaatgcactccttaatccttacacctaccatgcccttctcttacctattacagtgaaattccagcatgcaagctcagaaccaacacattactctctgtgcctaatgttcctcactgtggttgttttttattttttattgatcatacttgggtagtttctcgcagagggggataaggcagggatcataggacaatagtgaagggaaggtcagcagataaacaagtgaacaaaggtctctggttatcctaggcagagaaccctgcggacttccgcagtgtatcgtgtccctaggtccttacgatatagggagtggtgatagactcttaacgagcatgctgccttccaaagcatctgtataacaaagcacaatctagcaaccgacctataatccatttcaccctaagtggacacagca

SEQ ID NO: 639612 - DNA, 345 bp, Homo sapiens
acaatgaattcgtgtgaatgcttgcacttctcagagccacattggaaggtgaaatatttgcttttgatgtcccagaagcggtcgccatagatcaaagcctagctcctccccagtccggatgtcatcgggaactgacgaaggcgatgcgtggcaatcgcaggtcattggtgcaagcatgaaaaacccggacgggaatgatgttggggtcacacaggtggttgatgaagcggctgatgtcgacatagtaacggacatctatgcagctacacctctccatccttgtagtactaagtcgaagaggtaagcctcatcctctctcacatcagcctcaagatcagagatcag

SEQ ID NO: 639613 - DNA, 188 bp, Homo sapiens
tgtcgtctgcggtcatcgttcggctctctcctcgttccttccagcctggttctgttcgggttgtacggtagcactgctcttcttcatcctctgtgggtccttgcggcgtctgctacgcttttgcgtcgctgggtttggtttactccccctcaacacaagctgccgcgggggtcccgcgctcgcattcg

SEQ ID NO: 639614 - DNA, 332 bp, Homo sapiens
ggagttgaagatctcgtcgaggccagcggtgccgtttttcttcacgtggctcagtccgtaacccagcgctttgccttcgagcgagccatttttggtggcaagcgtttcgatttgcgcgaggtcctgggtggcgagcacggtgcggaagtctttggcgagctccgcgctctctttgcttactctgcgtaggctgaagaagcgctcgatcatgatggagatgctgattacgctcactacgcccatgaggtagaggatgccgtgagcagtggcgtccgcgaggcgaaacatagcttccattgtgtcttttctccttatgcgtcttgcaatttggg

SEQ ID NO: 639615 - DNA, 269 bp, Homo sapiens
agtaagctatagatatgcttattgtattcatccaattatgtgagggtgtgcgtgtgtgtgcgcactgtgtgtgtgccggtgggtgcttgcatgtgcaacagtagtgtgctgcccgcttgctcagccggctgagcaacgcgggcagtgaggacaaacagatgccgcggtcgacagaccaagaccagctttctcgtgtaatgcaaagtcccattaaatagacgtgcgtggctggaaagacgtaccttattcttgcataagaagacaacggc

SEQ ID NO: 639616 - DNA, 1063 bp, Homo sapiens
agcggggttcggttgcgggtcggaacggcgctgctctgcggggccggtccagtgctggcagctgccggcgcttggcggtgagtggctgggctccctgagtgggtccctccacctgaaggcggtgtggaccagctggctgagtgccagtgatgcctgtccagtgcggcagctgggggttcctcactcatcccagatgtatggtctatctttctgaagtagacttggtccatggcctgaaacatttttccgaaacatcagttttgacgcaacagactagtctggttgaaataacaatgaataaccgagattcaagcatggtttggaaaggctgaagcagaaacgttacgtaattggcaaatagtctgggtgacttacgttctctgttgactgttgatattaaccttgggccaagcattgcccattggaaattgccattcaccgggatacgcaggaaaccgtacggccagcccacgtccacggtctgcgcacgaagcacaaaggaccacctggtgacgcaacgtgggccttgggaccctcaaaaggccaagaaaagacccgtttggccgtagtcaccaagagactctgccgtttgaactaagtatacaatgtgcgcaccgggtggttggcccatccaggggagcgttgggaaagcccagagagcaggctccaatttgaagagggccacaatggcgtcggtgccacacgccaacacaattcgctttgcaccagtatatgacgggcttgactgagggaaacgaaagggacaaaacccaaagcggggagtaccaacatttcacgcggcccgtgaaaagatcgccgtgggggacgcccatgcacagaggacaaagacactggtggggactagacaggtggatacgaaagcgattcagcaacgggcaggaagaaggtcactacagggtcgacgtgatggcaacttgaccgggagagtgggagagtgctaaaccgtgggaacgtggacaaggggtggcagtggtggaggactgtcgtgtagggaccgcagtggccaaacgaaggcacgataaacctgcacacgtgaagcgaa

SEQ ID NO: 639617 - DNA, 166 bp, Homo sapiens
  misc_feature (130)..(130): n is a, c, g, or t
  misc_feature (161)..(161): n is a, c, g, or t
gatgcctctatctggtaagagcttcacagaattgcaggggttgtggttgctgggaagggttagtctgttagatcaggtgctgcagaatcgagtgtaacccttcctccctttagtcttactgtgtagcccngtgctggcctgcaacttgctatgtagacctngttga

SEQ ID NO: 639618 - DNA, 488 bp, Homo sapiens
  misc_feature (27)..(27): n is a, c, g, or t
  misc_feature (31)..(31): n is a, c, g, or t
  misc_feature (118)..(118): n is a, c, g, or t
ggtcatgagacctgccctacctggggngccntctctaggatgtctgtgacgggactggcatcgattcagaattcgctctacggagacttagtctattcagctccctttactctttgantagtggtcccttgaaattaagtttataggggcactgtgtctgttaggtttttttcaagcgtctgacattgcaggctcttattagagttagctttcgggccgggcgtggtggctcatgcctgtatcccagcactttgggaggccgagacgggtagatcactgaggtcaggagtttgagaccagcctggccaacatggtgaagccctgtctttactaaaatacaaatattagccgggcatggtggtgtgcacctgtaatcccagctattcggcaggcggcaggagaatcacttgaacccaggaggtggaggttgcagtgagccaagatcaagacatgcccctccagcctgggtgacagagcaagatccgttt

SEQ ID NO: 639619 - DNA, 535 bp, Homo sapiens
  misc_feature (42)..(42): n is a, c, g, or t
  misc_feature (59)..(59): n is a, c, g, or t
  misc_feature (63)..(63): n is a, c, g, or t
  misc_feature (65)..(65): n is a, c, g, or t
  misc_feature (71)..(71): n is a, c, g, or t
  misc_feature (79)..(79): n is a, c, g, or t
  misc_feature (310)..(310): n is a, c, g, or t
tctcagttcaggctgaaggggttgagttcgatgcgctcgatncgcgacggcaccgtggngtantnggccanctgtggtnggcaatgcgaagggcgatgccgggtaatatcagaaagcccagcaagctgtacaaagcaagggcggtcaacaaggcgcctacggcgcggatcaatcctttgggcatgggtgaacgccatctatgtcgaacgagagtgccttggagtatggcacgggaattcggtttcgaagaaccgtgggcgctgggaaacttcctacaaatgcaggatcagcgtcttcagcggaggctgtnggtctctggagggaaagtcggctccaggtgttataacctgccattcgcgcaccgggcgcccggctttttctgcgcagcgcagcacctgctcacgccagtcttccatgctgacctttgccaggttgttgcagcaaatcagcacgccattgtcggcggtggccagcagtgcgggtttgagcaggctttgatagtcgcgcaacaaatcgaccgtgccgaaggcgctct

SEQ ID NO: 639620 - DNA, 1084 bp, Homo sapiens
gctaggagcaggtgtgtgttgcatgatccgcgtaaaacgcgacgtggggacgggcgccgactcattttgacatagtcgagctagtcgcggtagggtaacggcgccgtcctgcaggtactggctcgtgtgcagtctcagtaagtgcgacgggcctccgacgatcagtagccctgaaacaatatgaagagcggagcgatgctgacagagtggagaccgggcgctcgcttctgtgtgttgtctgggttcttgcggctcttgtgcatttcgctcgtggtgtgacctggtggctcatcacccaattgaatacttctccgttgttgcctccttgttgatgactcaggcggttccctatgtgcgcattagtcattgctgtcccgccacgcggaagctctagcacgtggggttcccctttcgttggcttacctgtgccctcctcgtggctgtactgttgccccggcctgcctgcctatgtccggcgtgggtgtgtgtggggtgaaccccgtaacgccatggtgatctccattacctggtgcaggacttcagacgcacgacatggactctatactgtctgcatctgtcagttgctgtgaaacaacataataagtcggtgtgacacaaaaatggatttccctgaagacaagcctaaagttcagaacgagctctgctgaaccatgtgtcacaaggaggtccggaaactgagatttcagaaacataggtacaaaccgacacagtacatagtgccaagttgggaaggaagggggacgaggaattgtggaggcgagagcttaaaattccttgggtgcaagtgaattggaagtacccgtaggaagataaagacgtgagagcagaatgaaaagatgtccggtgcttgctgttacacaatgtaagatgaaagactagagctgggtaacggagtgtacaaaaggtgtatgggagaatgtaaatagtgagaaggtgtttaacggtggggacttgtaacataaggagtaattgaaggacaaacttggaagcatgtaggaagtagcagaaatataagaagttgaaatgatgaaagtaaaaatgatagaaatataacaaaagagta

SEQ ID NO: 639621 - DNA, 613 bp, Homo sapiens
gcgcagcggacacgtgcgtccggcctgcggcgcccggcaccggggcggacgcggaacccgaggccatgttccatgaaaagagttttttggtgtctggggacaactatcctccccccaacctggatatccgggggggcccaggccacaccagtgccacccactatgtcaggaatacgctacaccatgtgggacgtttacacaacgagaagaaatgatcaacggaatgaaaagacaaggaaaaaacagagaaaacaacaaaagaacaaagaaaacagaagaaaaaagaagaagcaaagagaaagaaaaagaagagaagagaaacacgaaaacgaagagaaacgaagcacaacgacaaacacagaaaccgaggaaacagcagcaacggaaacaagaaagaagcgacatcagaaagaccagacacaaacaagagacaagaagcgagcgagcagaagagaacaaaaagagcacagacaagagaacgagcaagagagagaaatgagagagagcgacagacgagaagaaaaagagaggacggaagaagaaagagaagaaaagagacagagggagaagaacaaagaagagaagaagagaaaaaagagaaagaagaagacac

SEQ ID NO: 639622 - DNA, 89 bp, Homo sapiens
gagacggagtcttgctctgtcacccaggctggagtgcatcatcggtgcgatatcagctgactgcaaccccccccttctgtcgtcttctc

SEQ ID NO: 639623 - DNA, 294 bp, Homo sapiens
gctcgaggtgatcagaggatcccgatagtgcactgttctagccttgggtaggagaatgagactggtcttgaaaacaaaacaaaaaacatggtatagggggcgtgtcatgtattagtacattcacttagtattcaagtgaagtattttacggtaaaagggtgtccgaagatcaggaaaccgaaagcactggtgggcgttgcccaatgaactctgaatgaagctctactgacgcctgtggtttcgtgtgctagcgaccagtatataatatgtagttaggagggttggtgatggcag

SEQ ID NO: 639624 - DNA, 244 bp, Homo sapiens
ccggatccttcccgactagcccgacagccctggctggtggttatcagcgtggcagccttgcctgagacaggaggcgcaaactccctctgggccattgatggtgcttcagcccgaagtcttgcacctggcagtaccatctgcatgttgacgtgctgtggagttacgacatggtggacagatagctgaggccagtgtccgtggtgcgtacacacctgtcgggctagtcgggggggtaccgagctcg

SEQ ID NO: 639625 - DNA, 370 bp, Homo sapiens
tgcgaggtgatctacggatcttcaaacaccgcaatctgtacagtcaaatgcttcatggaaaaaaaatctctctaaagcatctgaaatacttaaaaatgtttaaccttcaaatgcctagtgatcaggaaaggaatacttaggccagagaagcaggtgaaatcccccgttcacatgaagcatcccccatcgattcttaaaggctatgtaaaggaggacttaattgggtcccaaacccccagaataatataccactggctaagggggtattgtataaataatcaggggaaaatctattccttgcctagtttggtacagctaaattctttaccgtacacaaaaaccctttataatgtagagattgcggtgtaag

SEQ ID NO: 639626 - DNA, 136 bp, Homo sapiens
gaaaaaaacggtacttaaacagcagatgaagacattcaaggaacccagaacctgctaacttcgattgagtctgaaacagcagcttctgaggaaaccttgttcaagcgcgtcccagcgcatcagagacgaggctgca

SEQ ID NO: 639627 - DNA, 315 bp, Homo sapiens
aacctaaactacaaagggggaactgaggagggaactcaggagaaaggaactaactgcggagcttaatcttggcccagtgttcagccactcggaggtgcgggggctgaggcacatcagaagctgctggtggctgtagtggggtgggatgacctggccagagccaacgaggatactggagccaaagtcaagttagagacagctggaacgtgaatggggctcttgattttcttatcaaaacaccactcctccagctggactaaatattctttctagcaagcagctttgtgagctcctgaagccaaggaaacccttcgg

SEQ ID NO: 639628 - DNA, 469 bp, Homo sapiens
  misc_feature (32)..(32): n is a, c, g, or t
  misc_feature (56)..(56): n is a, c, g, or t
ggctcactgcagcctcaaactcctgggctcangcgatcctcccacctcagcctccnaagtctttgggattataggcgtgacaccgtgctggcttgcctttggttctctgaactactccagttctttccactaaatccacccccctcttttttcccctttggttaatcagaatccatatcttttgctccagatcaaagaaccctacccgatgatcccttctccattcacaaaatcaataacatactcaaaatcaataaacagctgaccgagcgcagtggctcacgcctgtaatcccagcactttcggaggcagaggtgggcggatcacaaggtcaggagttcgagtccagactgaccaacatggtgaaaccccgtctctacttaaaaaatacaaaaattagctgggcgtggtggtgtgcacctgtagtcccagctacttgggaggctgaggcgggagaatggcttgaacc

SEQ ID NO: 639629 - DNA, 1334 bp, Homo sapiens
aaagaatattgagattgtctgaagtatcttcccagtattacgatattgaggagtgcaagaaggtaagattagtgatagatctccatgggttatagtaaagtgaaaacggagatatcgggagaatccgctatgatgacatccactgagatgagctgagagtatgggtaggacttagcactacatgcttctgctacatatatacctgatagacataattgtataactacaggatgctatgtataatgatgatattaaagacataggaattatacaaaacacaaggaaaatgctgtaaagtattagacatatggtgatgctatcttggacacaaaaggattacaaagataatatagacaaaaagataggtaatgaaacacgaagatttataatagatcaaagatagaaaacgagaatacagaaacatacaatggacatgtgttaatatacatcaatatttagaatatgtactaggtttagaggagaaatcgagatggagagatggaaagtatcagataaaggcgtatgacaaaaataaggaataacgaacagagagacaatataatagacaactaaaaatatgaaacagccacgatcatgaacaccgtagggaaatagaacgtcaccagggagcacaaaggaagcacgaaaagaaccataagagtaacaaccagatacccataaagactgcgaaacaacgttaccacagacgtgcgaatagaaacattgggggacacagatcaagcatcaaagccgtacatcatagtgggccgtcaaaaactaccatacacaacatagacaaaatgaacggaaataaagaacagtacagaggcaaggaaaccataaccctcagaccgggcaacgatagaacaaggaaatgaaacggaagaacggcaatgctgaacaaggcgaacctcgcaaacactgcaaaaaagcacaaatgaaacaacgcacagacattagaaacagacaactaggtcaagcacagaagaagacaaaagcaagcacaaaggaacaaccagcagaggaaacacgacggacgcacagccgagctgaacacagcaaacagcaagcagaacaccagacagaaacagcgcaaaaacgaaaaaaaaagaggccagagaaaacacaagggaaagacaagacaagcaccacaagagcgccaaaaggcgccaacacagagcagagcctagcaaccgaaggacccagagcaaatcaagaaacagcaagaaacaaaaaacacgacccagacaaacggcgaccgcggaggaaaaaaagaaaaaaaagtagaaaagacagacaaccaacacgacgacgcaaaaggacaacaacacaaa

SEQ ID NO: 639630 - DNA, 453 bp, Homo sapiens
  misc_feature (32)..(32): n is a, c, g, or t
  misc_feature (56)..(56): n is a, c, g, or t
ggctcactgcagcctcaaactcctgggctcangcgatcctcccacctcagcctccnaagtctttgggattataggcgtgacaccgtgctggcttgcctttggttctctgaactactccagttctttccactaaatccacccccctcttttttcccctttggttaatcagaatccatatcttttgctccagatcaaagaaccctacccgatgatcccttctccattcacaaaatcaataacatactcaaaatcaataaacagctgaccgagccaccatgcctggccaagaaacatgggttctaatcccaatgcccccgcttcctagctatgggaccttgattgagtcctgtaccgtgcctcagtttccccacttataaaaagaggttactaaaaaggatgcttcactcaagggtgtgaagacccagtgaatgaagtgttaataagaaaaaaaaa

SEQ ID NO: 639631 - DNA, 146 bp, Homo sapiens
aattcacggccgccggatgaagaagctgggaaagtgagcacatttgggagctggagaacagggttatcctacccctgtgactctgttacagcttacataggttccttactatactctagcatccatcatgacactggagtttcatg

SEQ ID NO: 639632 - DNA, 258 bp, Homo sapiens
ttttttttttttaggggggcccccccattaattttgtttactgggccccccggttaaaaattttttggggttttgtggaacttggacccctgaaaacttttttttatttataaaaaagctttggaagcctgttttgggtcgcccgtaaatttaggggcttttttagataacttcccccttaaaaaaacgggggggtttcccggcgggtttttttttttttttataaaattttccccccttgttttttttcccccgtta

SEQ ID NO: 639633 - DNA, 220 bp, Homo sapiens
gctccaccttaccaccagacaaccttgagccacaccatttacccaacataaagtataggcgatagatattgaaacctggcgcaattagatatagtacccaagggaaagatgaaaaattattacccaggcattatataggcaggactaacccctattacctctgcatatatgaattaactagagaatatactcttgtcaaggagagaccacagactataga

SEQ ID NO: 639634 - DNA, 323 bp, Homo sapiens
gaaatggagttttgctcttgctccccaggctggagtacagtggcacaatctcagcttacagcaacctctgcctcccgggttcaagtgattttcctgcctcagcctcctgagtagttgagattacaggtgcacgccaccatgcccagctaattttttgtatttttagtagagacagggtttcatcatgttggctggtctcaaactcctgacctcaggtgatccacccacctcagcccccaaaagtgcagggattacaaggtgtgagccactgcatctggcccaggttaagtaaacttttaaatccctcgtcgacgcggccggaa

SEQ ID NO: 639635 - DNA, 1009 bp, Homo sapiens
gggcaagaggagaggaaggggagccggaccggactagccagacaagagccggtgaatgggtttgtggtgacccgagaggagaagctcaacctggactcgatacatacgggcgcctgctggagatgcagctcgcggcctggaagaatagtacagctgacagagaacgagatccgcggtactagtgcctagaaatccccgggagatattttctagagcccagccccatatcgttctaggatgctaggagagcaccccctacagagatactgctggtagacataaacacgtgcaagtactaacagacctatctagcgacatatattgagtaatgggcggttatccctacccagaggagacaagctagcctctattctaaagggagaactactgtagcgacacgtgggtcaacgccagatcctatgcgagaacacatactagtcctagcatgcttagtgcctaagtaacgatacaaggctacgccgcggaagagacattctatacctagctacccgtaggtgacacccacggagctagtgcccaagcatacagaccggcagtctataggctttctcacgcatagacgtgcacagagaacgctatcaaccatcagaagctgtgggaaagaaccttccactagactgctatcaagctggctagcccatacgcggccatagttgggaccgaaaagattcttctagctgccacgggagggctagtccccggagctgcagtctatggagccagaattcggcgggatcatgcgggccgacagatgtgcctgaccaggttccttgctgtgtgacctgctgtggtctgcctgacgaggacctgcagcgctgcggcgaggacgaccgaggcgcctcttacctatggagccgagctgtggccggtcctcacgcaggccgatttgacccttgcgagacgccgctcgcacagaggcacggtcctggcacgcgcggccgggccctccccccttctgcgcagcagactcgtgccagtcttgcaccca

SEQ ID NO: 639636 - DNA, 954 bp, Homo sapiens
ggctcaccgaaatggccgcgtccagtcgaggaaatttggagcggaaatacgagtcagctggaccttgcgaaatttgctaagaagcagccatggtggcgtaagctgtccgaggcacgccgaatcatggaccttcacgtaggaagaagtagtaggcgtgccaaacccagcctgttcattgggaggctgtgaactgggagtggtgcacagggtctcagtattccaggaaggttgcgaacgttggctgcacatcaggctgtgggaggctgagatatttctctcctctcagtttgcagaaagcattacttggtacatcaaacgttgactgtcaacgaagtggccgcaaggacgtgcacatgaatgcgccagagaggcggctgatgatcgcgtaagtagcatagtcgatgatatccttacgtgacggtctgtgagcaacacggctagtgggaggtgcgatgctccttcgggaggaaagaagtgtctaagtaaccgtgggggatttccggaggcttctgcttggcaatggcatccctaagggaagatgacctcatgttcatggtccctggttttttccagccagcagctctacactccaatcataggaccatcgagtccctcctcctcttctcccatgcctttcttgccctgccatgcaaatctagagggcttcttcttaagcatctggtggtaccaagtcaatgtgggaccatgagcttcatggtggcggaagagacatagtcctagctctcctccaagtaacccctgtggcccagttgtgccaacaagaagttcttaccccatggaagacactttggaccttcacgatggtgccggcggactggctgaagttgcccctgctttggaaaaatgccagatacttggggggagagggactgtttgggaaaaaaaaaaagggggcgccaaaacttgggggaaaatcatgtgtaaaccgaacga

SEQ ID NO: 639637 - DNA, 1311 bp, Homo sapiens
  misc_feature (288)..(288): n is a, c, g, or t
  misc_feature (304)..(304): n is a, c, g, or t
  misc_feature (339)..(339): n is a, c, g, or t
  misc_feature (348)..(349): n is a, c, g, or t
  misc_feature (355)..(356): n is a, c, g, or t
  misc_feature (360)..(360): n is a, c, g, or t
  misc_feature (400)..(400): n is a, c, g, or t
  misc_feature (469)..(469): n is a, c, g, or t
  misc_feature (818)..(818): n is a, c, g, or t
  misc_feature (825)..(825): n is a, c, g, or t
tgtccccttggtgccccttggtggggggggtccttttgggtctcgtgatttgtggtctgttgcccccctttaaccgggattacgcggcgtttcccctacgtgggctcctgttgtgtctgtccttgtgcacatcacgttttgcgctcttaagtgcatcgtccattagtggtcccccagttgattccggttattcgcgtaaggttggttataattaaatgtcggtttgtgcacatgctttgggactctgtgtatgagtacgactaatatcttctatttactaagaagatnaagaggtcgataaatnaggaggtcaagcccgttttgcaaggtcacacaggnaagaagcannccacgnnatgnacttcggctgtcacctgcggtgggcgcactagaggtcttntgaactccttcggctaccgtcgccgcgttctcgctgtgcactcttattctgcgcctgcgcgcggctacngcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtntgtcacntgacttgtgttcctgaactatgacacatgaatatgtgggctaaggagaataagttccatcattgagtaaactaaacaattgtaacacaagtaagaaacatgagagaaatcacacacacacataaccactgaaggaccaaggataaccacgtatcaccactgaagccaattcatacaaatagacgaaggaggcacagccggctataacaccccgaagagattccaggacaccgagaaagaacgctgagaaagagtgagagggacaaaaaaacaagaaaaaagcgcgaaagaataccaaaatatgccaaaaaacgaaaaaaggaaaaaaagagacaaaaaaatacggcaaggcgagcactatatacaggggacgaaaaaaacgaaagttgtccagaaaagaaaaagacaacgacccaggggagggacaaaaaagcttaaagacgagtcagcgagagaacacagaggacgcacgaagaagacgcacaca

SEQ ID NO: 639638 - DNA, 1631 bp, Homo sapiens
  misc_feature (288)..(288): n is a, c, g, or t
  misc_feature (304)..(304): n is a, c, g, or t
  misc_feature (339)..(339): n is a, c, g, or t
  misc_feature (348)..(349): n is a, c, g, or t
  misc_feature (355)..(356): n is a, c, g, or t
  misc_feature (360)..(360): n is a, c, g, or t
  misc_feature (400)..(400): n is a, c, g, or t
  misc_feature (469)..(469): n is a, c, g, or t
  misc_feature (1138)..(1138): n is a, c, g, or t
  misc_feature (1145)..(1145): n is a, c, g, or t
tgtccccttggtgccccttggtggggggggtccttttgggtctcgtgatttgtggtctgttgcccccctttaaccgggattacgcggcgtttcccctacgtgggctcctgttgtgtctgtccttgtgcacatcacgttttgcgctcttaagtgcatcgtccattagtggtcccccagttgattccggttattcgcgtaaggttggttataattaaatgtcggtttgtgcacatgctttgggactctgtgtatgagtacgactaatatcttctatttactaagaagatnaagaggtcgataaatnaggaggtcaagcccgttttgcaaggtcacacaggnaagaagcannccacgnnatgnacttcggctgtcacctgcggtgggcgcactagaggtcttntgaactccttcggctaccgtcgccgcgttctcgctgtgcactcttattctgcgcctgcgcgcggctacngcacggttcgtttttcctttagtcaggaaggacgttggtgttgaggtgagtccggtcccttttgcatccctaccccgacactgcgggttgtcacaacggcaccctcccgctttctctctgcctcggatttagtcgtgactgtgtgtctccgccgtggtgcagcttcaggcctctcccgcatctactctctcacgcttccgctgcggcctgagggagggcggcgggcggaccacggaccggggtgggttgcgacggccccaccgaagccgggtgggctgcgggaccctcgagaacccagctggcttcggagtgagctggcccggggctggtacccgctgcgctttttcacagccattgtgaccttggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtntgtcacntgacttgtgttcctgaactatgacacatgaatatgtgggctaaggagaataagttccatcattgagtaaactaaacaattgtaacacaagtaagaaacatgagagaaatcacacacacacataaccactgaaggaccaaggataaccacgtatcaccactgaagccaattcatacaaatagacgaaggaggcacagccggctataacaccccgaagagattccaggacaccgagaaagaacgctgagaaagagtgagagggacaaaaaaacaagaaaaaagcgcgaaagaataccaaaatatgccaaaaaacgaaaaaaggaaaaaaagagacaaaaaaatacggcaaggcgagcactatatacaggggacgaaaaaaacgaaagttgtccagaaaagaaaaagacaacgacccaggggagggacaaaaaagcttaaagacgagtcagcgagagaacacagaggacgcacgaagaagacgcacaca

SEQ ID NO: 639639 - DNA, 384 bp, Homo sapiens
  misc_feature (1)..(1): n is a, c, g, or t
  misc_feature (324)..(324): n is a, c, g, or t
  misc_feature (326)..(326): n is a, c, g, or t
  misc_feature (335)..(335): n is a, c, g, or t
  misc_feature (362)..(362): n is a, c, g, or t
  misc_feature (367)..(367): n is a, c, g, or t
ntttttttaaatgaagcatagtaagtacataaaccaataacatagtcactcactatgactatgaagtattatgtactgtatgtaattgtacgtgctgtgcatttatacagctggcagcacaataggtttgtgtacaccaagcatcaccacaaagatttgggtaatgcattccattgccctaacgggcttacaacatcactagggcaatagggaatctttcagggtccgttgttgtcttctggggacttctgtcatatatgtggggtctgcctttggacccaaaatgttgttatggcagtgcgtggactataccccactatatgntncaagttctnaatggggatctggggggagcttgattnaaggnggaaaataatgtgtagg

SEQ ID NO: 639640 - DNA, 1577 bp, Homo sapiens
  misc_feature (288)..(288): n is a, c, g, or t
  misc_feature (304)..(304): n is a, c, g, or t
  misc_feature (339)..(339): n is a, c, g, or t
  misc_feature (348)..(349): n is a, c, g, or t
  misc_feature (355)..(356): n is a, c, g, or t
  misc_feature (360)..(360): n is a, c, g, or t
  misc_feature (400)..(400): n is a, c, g, or t
  misc_feature (469)..(469): n is a, c, g, or t
  misc_feature (1084)..(1084): n is a, c, g, or t
  misc_feature (1091)..(1091): n is a, c, g, or t
tgtccccttggtgccccttggtggggggggtccttttgggtctcgtgatttgtggtctgttgcccccctttaaccgggattacgcggcgtttcccctacgtgggctcctgttgtgtctgtccttgtgcacatcacgttttgcgctcttaagtgcatcgtccattagtggtcccccagttgattccggttattcgcgtaaggttggttataattaaatgtcggtttgtgcacatgctttgggactctgtgtatgagtacgactaatatcttctatttactaagaagatnaagaggtcgataaatnaggaggtcaagcccgttttgcaaggtcacacaggnaagaagcannccacgnnatgnacttcggctgtcacctgcggtgggcgcactagaggtcttntgaactccttcggctaccgtcgccgcgttctcgctgtgcactcttattctgcgcctgcgcgcggctacngcacggttcgtttttcctttagtcaggaaggacgttggtgttgaggtgagtccggtcccttttgcatccctaccccgacactgcgggttgtcacaacggcaccctcccgctttctctctgcctcggatttagtcgtgactgtgtgtctccgccgtggtgcagcttcaggcctctcccgcatctactctctcacgcttccgctgcggcctgagggagggcggcgggcggaccacggaccggggtgggttgcgacggccccaccgaagccgggtgggctgcgggaccctcgagaacccagctggcttcggagtgagctggcccggggctggtacccgctgcgctttttcacagccattgtgaccttggttagcatacgtatcaaggacagtaactaccatggctcccgaagttttgccagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtntgtcacntgacttgtgttcctgaactatgacacatgaatatgtgggctaaggagaataagttccatcattgagtaaactaaacaattgtaacacaagtaagaaacatgagagaaatcacacacacacataaccactgaaggaccaaggataaccacgtatcaccactgaagccaattcatacaaatagacgaaggaggcacagccggctataacaccccgaagagattccaggacaccgagaaagaacgctgagaaagagtgagagggacaaaaaaacaagaaaaaagcgcgaaagaataccaaaatatgccaaaaaacgaaaaaaggaaaaaaagagacaaaaaaatacggcaaggcgagcactatatacaggggacgaaaaaaacgaaagttgtccagaaaagaaaaagacaacgacccaggggagggacaaaaaagcttaaagacgagtcagcgagagaacacagaggacgcacgaagaagacgcacaca

SEQ ID NO: 639641 - DNA, 474 bp, Homo sapiens
aaagccctcaaggaagcaaagggacccagctcctccagcagttgctctggatccaggtgggtccattggatatccggggcggccgggcaggtaggcggagcccctttggatgttggcctccctcccagaagcagtcgaggggggtgaggatcacgcagggaaacagtttctcaatcatccgctcaatcattccatttacaagaagggggaactcttgactggtagcagatttggttcaaatcccaggacttcccatagagtgatactgggacttgactggcagtgagggctgcctggaggtggaggccaagtgctgcgggtgtgaggatgtcctctccctcggggggggcggtctgtatcagcatcggagaggtgtatgcagcctcctccccaagtttctcctgggtgtaatgcagttcttgggctcagcgggctggccatttctacccagagctggtcccagtttgctcagag

SEQ ID NO: 639642 - DNA, 797 bp, Homo sapiens
aaagctataaggaactctacacgttatcatgcagtggttaacgtgataatctgacactatggacttcagacatgcagggttgacaggtgaatgagcagcaataaagaaggcgctgcaggacggtggaagacgaaaatcagtgagacataagccagcaagagaaaccatctactgaccaccccctcctccacgcatcccacccttctgtgaaaatctcgccctattagtcactgtagaaccacacaatatcatgactataatacatctcagggctcagtagataagatggttcctggctgctgttgggcattcagtcagggacagtggttagctgtggaaagaaatgtatgactgggagaaatgaagaaatatacggggataataatgggagaacgagattatacgcgatactaatagactggtaagcagatcatgcctagccgtgtttagcccacatggatctacaggagtatacaacgaggcggagattgcttgggatagattgatcttggaaggatgtggaggtgaaacatttgactgacccatctagtgatccagggcgagacagagcatgatgatccatgtgagtgatggtcaccaggaccagcggcatctaggagaacgatgcaacaaaacactacatgagcaaaacatgcgagttgtaatcctatgcgtgtcgcaaagctttaggttgcagatctgaagaggcaatgagtgatgcgccgtgaaagggattctcttgcctcggatgaggcgtcaattttgatctcccgccgcgaaattcccccagaatccgg

SEQ ID NO: 639643 - DNA, 1250 bp, Homo sapiens
  misc_feature (377)..(377): n is a, c, g, or t
tggggacatatgaaaccctttaggggggcccggggggtgtgtggggggtgagtgtggccaaaaggggccgctcggtgttataaaacccggggagttcccaggggaacacccgggggtgggggccacgcgggggtggggacaccatgtgagaccccaaagaagtgcaccccggagggatttggggagaatatgtctcgcgggacacgtatgcgcggaaagaggccgcgggggccgcaaatcccagaggggagcgagaggggtgccaccaccactagaagagagaacacaccctaccgtcacacgcagaggccccccacacgagtggacacgcgacaacaggcgggggacacacatgtgtgagacacaccacttcgtgngtgtataaaacaaaagtggggcgcgttgtctaggtcggaaaccccaaggaacgagacccacccttctcagacacacagttggtgtgtgggcgaacccgcggggccacaaatatcaaggagggggggccccaaagtgtggtgacacaccaaaaatctccttccacacgagagtactcgcgtgtgtggagagagccccgaatttctcgcacctaccgagagcgaaaaaagagacccacgagggggggtgtgacaaccacaagagaggggcgggggaaacaaaaaaggctatacgaaggtggtgtcaccccgccaggttattgaaagccccgggagacaaggggactggaggagtagtatagcccatccccggagggaggcggccccacgccaagctgggagtcacaaaccaacagaccttgcgaaatagggcaccccccttggggaggaaaaagccgggcgcagacaccaaccacgattacgacagcccagagaactacaccaaagaggaggggcagagagatatgtctttctacaccacaacagacacgcgccgtccccttccgagaagagacacattagtcaccataagagacaaaacaggggcaccacctgtcgacaacagggcgctccaacacaagagaacaccaccccaggggaatcttcgggggggacaccacacattgtgcgggggaaacaacaaccgagtacgaggcggcccgacaaaaaaaaaaaaatacaccgacgagggagggcgaccaaagattcaagcgtatccccacggtctcttctgtggaccaaggtcggcggccccatataaggggctggattataaacacaagaaccagggcgacggaacaacacagtcgagatgag

SEQ ID NO: 639644 - DNA, 866 bp, Homo sapiens
tggggggaaataaaaagttctttttgggggcccaaaccaggattccggggttttggaggcccctggtgttttggaattttttcttccccagttttttctcgggcgggtcccgaaccccacagaaggggtgttctatctgccggggtaggggagttcctgggggtttttctaccttttccttcttcttctctccagcgggtgggtctcgccacgggcgctggtgtatttatccacgccaatccttgtgtagacgcccagggcgcgccccattataggcggcaacttttttctgggtaggggctcacaagacggccaaagactctttggggggcagcaaggaaacccaccatcccgggttttctttgtggtcgaagggggggggggagattgcccgcaaaacactctggaggacggggccagaaggggcgcggggcgccctccgtgggagtttggggggagcgaagagaaaatacctcagcaggggtccccgccacaaaaaaatggcggcgtgggggccccagaaaagtggggaagggccctcggagaaaagggcgtgggtggtaccacaccggtggagcgggggcagaaacggcagggaacctccacttcggccgcttggaaaaattgcggcgcaaaaatgtggtggacagtcgcctacacaacaggcggtaacagaccaaccacttttgggggcccaagaatgacccgtgtttacccacaagggcgcccacgggcggcgccaaaaaaaatggcgtctcaaccaaaacaacgcaccaggacctggacctcccgcaattcggggaaaagcaaaacggaaggcgcggaaaaaaaaccccggggccaagatagcgaccacgtttggccag

SEQ ID NO: 639645 - DNA, 494 bp, Homo sapiens
  misc_feature (295)..(295): n is a, c, g, or t
  misc_feature (303)..(303): n is a, c, g, or t
  misc_feature (378)..(378): n is a, c, g, or t
  misc_feature (400)..(400): n is a, c, g, or t
  misc_feature (451)..(451): n is a, c, g, or t
  misc_feature (485)..(485): n is a, c, g, or t
aagcagggtatcaacgcaagagtgcccagttactggccggaggtgacgttccggattctctggtcagatcgtcggatgcgatagcgaccaagtaggagtgttcagacctgcgttagagaccgtagcgtaagcggatgccctatttagtcactaggcaatcttgatgtcttcgaagctcgttcgtggtcgagtgaattcgtgtaccagttgtaggtatgagcaagatacaagttcaagcatgacggtagaacagacgccagatggttcgcatccatgtataaagacccttgttacnaggcacanaccaagacaggaccatggtggacgaacgtatgcggaaggagggccgcgttgctcgaatgccatttctgatacacnctagggacgtccaagcccagcntacggccttatggatggattggacttaacccgattgtttctgcaacgactntgcgtgcgcaacacactgcaggcggtcacggatntacagatgg

SEQ ID NO: 639646 - DNA, 247 bp, Homo sapiens
gatctctagcaggatcccctcactgctgactttattccaatatttggatgagtaagttatagggtagaatttgtacagttggatttaatcttttgaaaagtaaattccttgtttactgatttgccttactaaaccagcaattaataagagtttcagtttccctatattctcatcagttggttggtgttgtcagtgcttcggagtttgcccattctaataagtgtgtagtagtattctttatcactag

SEQ ID NO: 639647 - DNA, 902 bp, Homo sapiens
  misc_feature (412)..(412): n is a, c, g, or t
  misc_feature (449)..(449): n is a, c, g, or t
gtcatggctgcgactgtggcgacggcggcagctgtggccccggcgccagtcgcccggtccggactgcgcctcttcggtgcactggttccgtgaaggtctgcgattccacgacatccctggcgttgctggcggccgtgcgcggggcgcgctgcgtatcgctgtcgtttacattctcgacccgtggttacgcgcgcctcctcctcacgtcgggatctaaaccgtatgcgaggtttcctactatcaggtactcatggaagtattatggacacctacatgtttaagcgaaacttgaattctcccagcctggtttgtagtcctggggcacagcacagcacgactgatgttcccaaagtgcttgttccaagggaatgcggcgagttgaccccgctttaaccgtttgaactcatgactnctgaacccatttgcggacaagaagcggagatgctagnccaatcatgcaaggatggaccaaggagggcgtaggatgctgtgatagtcgtgacggtagaagttctcaatactcctctatgaccttggacaggaatcatttgagctgattgggcatgatgccacccacttacataacaagcgctttcaggcgcatcaatcagcccgctttggcagcttgccctaagcaagcccacgtgggcttggtagagcgagcccagcagatggagcagcttgccagggacccgatgatccaaggatgaaccacgaacgagagctaacggacgttgccctcccttggtaggcagctgggggttcctccactagaaagggacttgagtcctagtctgtcttggcaagaggagcgacgtagactcgaaacctcttgggccggcttggactaaagcactttggtaactggaagggtctgggtttggccaactattgagagaacc

SEQ ID NO: 639648 - DNA, 819 bp, Homo sapiens
  misc_feature (144)..(144): n is a, c, g, or t
  misc_feature (147)..(147): n is a, c, g, or t
  misc_feature (159)..(159): n is a, c, g, or t
acttcagaagagcttgagtaggccaaatgtgaagttaagttttccaataatgtgacttcttaaaagttttattaaaggggaggggcaaatatggaattagtggagtggctgttacggttgggatggggggtgggttaggtaatngtntagtttatgatngcagataaactcatgccagagaacttaaagtcttagaatggacaaagtaaagaaatatcaattccaagttgcaagtaactcccaatgatttagtttttttccccccagttgaatgggaagctgggggaagttaaatatgagccactgggtgtaccagttgcatgaatttgggcacggaacgtgtcatactttgatactgtatctgtttccttcaaagtatagagcttttggggacggaaagtattgaactggggtggtctggcctactgggctgacattaagtacaaattatgggaaatgcaaaagttgttgcatatggtagttgtgtggtctctttagcaattgaaggtgattcactaataatttaaacatactatagaactgagagaaggaagggttaatgatcctgaggattcttctgatgggaagctttgtgctcatcaaagtaagattctattacacgtgtgttgtagcaagtttctagtgtcggcacattctttccattgttactgcaaaacagagtaagggtttgctcaacattggtactgtattaacctttggtggtaatggactgcacaatgcaaaacatgagtctaaaggagaatggagaggcggacattagtgacgtgaaaattgcacacgcgatgaagaaactggaga

SEQ ID NO: 639649 - DNA, 466 bp, Homo sapiens
  misc_feature (144)..(144): n is a, c, g, or t
  misc_feature (147)..(147): n is a, c, g, or t
  misc_feature (159)..(159): n is a, c, g, or t
  misc_feature (302)..(302): n is a, c, g, or t
  misc_feature (382)..(383): n is a, c, g, or t
acttcagaagagcttgagtaggccaaatgtgaagttaagttttccaataatgtgacttcttaaaagttttattaaaggggaggggcaaatatggaattagtggagtggctgttacggttgggatggggggtgggttaggtaatngtntagtttatgatngcagataaactcatgccagagaacttaaagtcttagaatggacaaagtaaagaaatatcaattccaagttgcaagtaactcccaatgatttagtttttttccccccagttgaatgggaagctgggggaagttaaatatgaagnccaacttggggctggtaccagctgcatttaactttgggggcaagcgaaagtgtcataaattgtgattactgctaatctgnnttttacctttcaaagctaatagcagccttttgggggcgaaggcacaagctaatgggacacctgggggggcttggggctcctta

SEQ ID NO: 639650 - DNA, 624 bp, Homo sapiens
tggaaaaagtcagggaggccagggggtgggcttgaaaccagcttgggggggtccgattccttcctttttggtctaaatttatgtatacgggtcctctcgaatgtgtggtaggggggggggcatccatatagtcactccagggtttagtggagggttcttctactattaggacttttcgcttcgaagcgaaggcttctcaaatcatgaaaattattaatatctacggcgtgttagagaaagtgaagtgagcctacagatgataggatgtcacagtggtgggtgtatgcatcggggtagtccgagtaacgtcggggcatcccggatcaggccgagaaaagtgtcggggggaagaaagtcagatcctacgccgatgacatatgatcagtgaaagggatcagggcgtacgtcggcgctagggggtacgccggagaataggggaaaccagtgaatgacagcctcctagtgagggcaaatacaggtccaatggatacggacactaggggaagggagcaacaaggctacctacgtagtcagcgtcagcgacgaggccgcaccgagcgtcgcacgcgtgagagctctcccgccgcaaacgccgcacgcaactgccccaacgccgcccccaag

SEQ ID NO: 639651 - DNA, 125 bp, Homo sapiens
  misc_feature (85)..(86): n is a, c, g, or t
gtagtgcctgaggaggagctcaggccttagcgtaggcggcccacattgcagccagcccctctctccatgctcccggcttggctgnntgccgaggctgggccgtgtcataaagagttttgcagtgt

SEQ ID NO: 639652 - DNA, 120 bp, Homo sapiens
gggggccccccccccttgggggcccccggggttttttttttcccccccccccccccccccccggggtttttttttggttatgtgggggggggaggatttaataaaggggtttttttccca

SEQ ID NO: 639653 - DNA, 179 bp, Homo sapiens
gagttgaagtggcatgcgcccggcagggtattaggtttttaaaagctttttagtttccatgaaatcagagagcgagattctgcagtgttggtttctctcgaagttctaaccttggtgtagtttcttcatgtgtaagaggtggcatgagaaaaagggatcaccaatagcagatgagggtt

SEQ ID NO: 639654 - DNA, 431 bp, Homo sapiens
gcacgagagctactcatgttaaaaagaatcatagattgcttttggcaatgagaggaaatcatttaattcaagacagggtggttcctctaggttactcactgatgagacaacaacaatggaaaaatttgcatcattgctctctttcctctctgttaaattgtgaacaagttctttctgtgatcctgtttttgtgttgtgtctcacaaattcaaaacattctggactcttccttttttcagtggctgttcttagtgatgacatcagttgtctacaagaaaatatttgcacttgtgttctaacaacagtcactgtttgttatagtctctggttttattttcagatattgttccaggatttctttattttgttatttataatatgaaatccatgtttatgaaaaaaacatgaataaaagtcattcttattttcta

SEQ ID NO: 639655 - DNA, 499 bp, Homo sapiens
gggagacactggacccagcagggtcacgcgggaggagactcgggacaccactcgctggctgccaccgggagcagaggggggctcgtgccgcccctcccacatcagtctccagacccttggggcttcagaggcctgctcctagtgctcctcggaggaggctgctgggtttcttcttttccggagagcaaactttcctcggagatgcctggcaggatgagccgtggccccggagaggacgggaccagcctctgatcgccgctgcgtgccctgcatgcccatggccaggaggccccagggaacggacagcctgaactcttagtgcgcctgggaccctcacggctccagatcaagtggccgaggcacccagagtttgaaacactcaggctctggagttcacgcagcaaccagcagcatgtgacaaaaacctgcccatggatcacgcagcgtgaccggaaaacatacgccacgtcttcgcccggaacgccacataaatcgcagg

SEQ ID NO: 639656 - DNA, 260 bp, Homo sapiens
aacggggtgcttgtgctggccgggatgcatgctacgtggctacgctcacgccaaccttctacatccccgtatggggctgcgccacggctctcgcctggtcaaccacctgattggcaacatacacactcacttggggcactaccgcgtagacctggatgtgagcaagtgcaccaagaacagcttccagacactgcagatgaagctagaaaacatcaccaacccctggagcccgagacaccgcgtggtccagccaactctgg

SEQ ID NO: 639657 - DNA, 282 bp, Homo sapiens
gaatcccctagcaaaaatacatacaataatcctgggctgggcagttgctcatgcctgtaatcccttgggaggctgaggcaggcagattgtttgagcccaggagttaaagaccagcctgggcaacacggtaaaaccccatctctacaacaaatacaaaacttagtgcacgcctataatcccagcactttgggaggccgaagcagatggatcacctaaggtcaggagttcaagaccagcctgactaacatggtgaaatccctactaaatacaaaaaaaatcagc

SEQ ID NO: 639658 - DNA, 178 bp, Homo sapiens
aaggtcattaggaaccattttcgacgaagaggcgcagatggagttggtgttaggtgcatggcctgctgcgtgtatgatgtttctgtactctggtagttgaggaagagcagatgactctatcatgacagctcggatagtttcacaaagaagaactctgccctgatctacgtagtcttgg

SEQ ID NO: 639659 - DNA, 206 bp, Homo sapiens
acgatccttatttgcggtgcctttcccaaacatctcacgtagttgaatctgaaagatgtgtttccatgtacatatcttgaagatcagaaggcagtttccttatttcaggttaaagcacagataattgtgccttagaaatggcacccatcaaaatgtctacaaatgcagcagaacatgagagggaatctctaccaggagaacatctt

SEQ ID NO: 639660 - DNA, 476 bp, Homo sapiens
tggggggctaggggggggcaggggccccttttccccccggttcccggggggcccaaggggggccggtgtcccccacccttggggtggtccaaaccctttggcggggggtttggggcccccccccccggggggggggaaaaccgggggggggggccccctaaacccccccccccctgggggccccccccccctggggggggggggggtttttccccccccgcccgggggggggcggtttgcccccggaaaagcccccccccccctttttttttggggttttggtaacccccggggggggggggggttaatttttttggggggacccccccaacggggtttttggggggggggggccccctttcggcctcccaacccccgttgggaacccccgggttgggaaaccgggtttccggtttcctttcgccccccccgcccggggattttggggtttgggaaaaaatctcttccccttttta

SEQ ID NO: 639661 - DNA, 904 bp, Homo sapiens
tgctggcgtgctgccatgagcttgctttgatgctgctctgtgtgtgtcccctgtgtgctgggctgtgcttgtgcttgtgctgcatgagtgaggtgatgtgcagtgctggctgtgcccctgtgtgtggctcccccccgtgactgtgtgctgctgtgccctgtgccctgtctcggctgaactctgctggtgtgtctgctgctgtgccctgctgcttgcttcctgtacccctggtgtgcccctcctgccgcctgccatgtgctctgtgcctgctttagttgcccatgctctgctagaatgtgctgcttgcttgctttggagctcgaatggtgtgcttgcaagtggaagatgcctggtcaggagtggattcctgcggtgacacttgggttgtgactgatgtgtgcggatcctatacaacttggtgatgtgttggccatcttcgggcccccgcaacaccctactacgagggcgggctacttcaaggcgcgcctcaagttccccatcgactacccatactctccaccagcctttcgtgttcctgaccaagatgttggcaccctaacatctacgagacgggggacgtgtgtatctccatcctccacccgccggtggacgagccccagagctgggggagcttgcctcagagaggtggaaaccccacgcagaagcgtcaggaccattctcctgagtgtgatctccctcctaacgagcgcaaacctctctcgcccgcaacgtgacgcctcgtgatttccggacagtggcggagagcagggaaggatcggagttccagacgtcatcggaaggcggtctggaccaaggtgcgcggagcgtgacgggtaggtccccagctggcgggactgcttagacaggccggccgagaggctaaccttcgggaacagaggggggg

SEQ ID NO: 639662 - DNA, 596 bp, Homo sapiens
  misc_feature (362)..(362): n is a, c, g, or t
  misc_feature (432)..(432): n is a, c, g, or t
  misc_feature (449)..(449): n is a, c, g, or t
  misc_feature (455)..(455): n is a, c, g, or t
tccggaaagctgtccctggtgagtgagggtctccagtgccccagcctgggggatgccccctagaatcactgatggggccttgggagtgggcagagaaaagaagaagcaaagaaggccaaaaaaggggtgccacctcttacaccagcgctgtgggcttcctctctcccaccacccttaaaaagtcacctcgggtcacatttactattcatgtagtcaacgagcgcttcttgaatgcttactgaccccagccggtgacccttacctgctccccacacaggccctggtggctggggttccccaaggtcttggacgtcgagtgttttgctttggagacccccagtagcttcagcctttcttcttgntttcttttttctctttttttttttggatatggagtctcgctctgtcactcaggctggagtgcagtgtgcnatctcgactcactgcancctccncttcccggatttaagtgattctcctgcctcagcctcccaagtagatgggattacaggcgcccgccaccacactcagctaatttttttttttttttttgagacggagtttcgttcttgatgcccaggctggggtgcaatgga

SEQ ID NO: 639663 - DNA, 338 bp, Homo sapiens
accacactcatctgcgacatcatcacctcatcactcatctgctggtggcctttgcggaaaacgaagcccttgacaaatttctaagcaacagtgaagtctgttgaggaaattctaaaatgtcttcaggccataaagggtataaggttagtcaactgcctcaacagagtttgactaaactattgaatttgcgagttactggaattggatatgtaaaaacagggtggtaggttgggtcatgcttacaatggtctcaagttcaaataagctactgtgacaatacaccacttcacaggtcacacgcatttccaggggcttatcctttccctcagtaagtgctg

SEQ ID NO: 639664 - DNA, 687 bp, Homo sapiens
  misc_feature (30)..(30): n is a, c, g, or t
  misc_feature (669)..(669): n is a, c, g, or t
gagctggggcccagcatggccccggaggancattaccgccggcttgtgtcagcactgagcgaggccagcacctttgaggaccctcagcgcctctaccacctgggcctccccagccacggtgaggacccaccctggcatgatccccctcatcacctccccagccacgatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgttcgcccggcagcaggagctcctgcggaagcagaacctggcccggctggagctgcccgacgactcctgcggcagaaggagctggagagcgcgcgcccacagctgctggcgcccgagaccgcctgcgccccaacgacggcgccgaggagctgcagcggcgcggggcctgtggtgctgaaccacgggcggngccactgctggccctggc

SEQ ID NO: 639665 - DNA, 1014 bp, Homo sapiens
ctggccacgtcggacggcgcgaatggcggtggttgccgccgagacccccgaagtccttcgggaatgctggtgtgcgagggcatccggatctgtctagatactgcgagtcggtagctggcggtgagtgacccggccctgggacactgcccccagcgaaaacataccgtttcatttactgctcccgacaccggatgggccgtggggcacatgaaggagtcttggactttgtagggctgggccttcccgcattcccaggagtagcatgctgatccgaggacttctgtgaccccggtgcaggacatgaagccgtagtagtgagcgggtcattggaccgtgaccccctgcgtaagctctcccgagtcctggacggatggattgctaggtctatggcccccaaaggcaaactttttggaaacagaagctaaatgaacgaggtgcttctgtgggctcccccagcttcttgtcggggaggtggtgcgcgctggattgcgtgcctctaacccggggtctggaaggtgcttccaggccctgtccgacgcagttgccagccttggactacttgcctcgagctgcgtgctctagccatttgacctcaccaacttggaaccgaaggcctttggttgtgtggaggatgctgtctgttcagcctcaacttctgttccccccaccgtgctgtccatgtgtcgggaggccgcccgggagcctgctcctctgctcgcgcccgtcggctgccgggaggccttgggtgggacagcgtggattaagcacccagcggggtcggtgctaaggccaaggagggtggaggtggggcatcccctttaacccggcccggtcctggtggtctcacccggggcggccggccaggtgggaacattgcatcaaccggagacacattcaaggcgcccgcgttgcgaatccgggacgggcaatggccggagagggcaaaggccgaagtgcggtcccctcccgaacacggaaacgccgcacaaatcggaaaaagaagccgcccgggaa

SEQ ID NO: 639666 - DNA, 383 bp, Homo sapiens
  misc_feature (31)..(31): n is a, c, g, or t
  misc_feature (46)..(46): n is a, c, g, or t
  misc_feature (61)..(61): n is a, c, g, or t
  misc_feature (67)..(67): n is a, c, g, or t
  misc_feature (380)..(380): n is a, c, g, or t
ccaacccccctgagcaacaagtgagttggantagtctgttatgatnttaaagtaaattacnaaaccntatataaataaggaagtacctttatgggaaaagccataggtgtagattttcacagggcctatttgtctttcagattagggcagtttcatttagttgtagagcaagaaaaattcctccacttaagataatttttttttttggtagaattctggttacatgtgcctttatgtatatatttgtttttttagcccatcaaaatttacttttctcacaatattttgaagatatatggtgtttatattgttgaaaagttttgtgttctttgcattgtctcatggccgtggagttaatacaagatgcactgtaccataantcc

SEQ ID NO: 639667 - DNA, 437 bp, Homo sapiens
  misc_feature (272)..(272): n is a, c, g, or t
ctggtgatgatgtgtctgggatatgtggatgtgggtgggggctgtgtgctgattgagtgtatgcctatgtgtgtatgtatatacgtgaaatgtgagtgatatgttttggaagtgtgttgggtgtgtgcctaagggtctaggagtggacagggagggcagctctatctctcagcactcaagtctccgagcagcttggtcatgtgagtaaccacaggagggaggggggaagaggaggcttggtgggaggcctggatggaggccaaggggactgngatcagcgtgctacgcctgctcacaggagtaatagcccacgtcagcgttgactgtcaagcgggcgatgtcaaaagtctcaatgacgttgctgtcccatttcttgcggtactcaatgtcgtgtaggacgtcgtagagtgtctcggctggcacatcacagcactcca

SEQ ID NO: 639668 - DNA, 222 bp, Homo sapiens
tctactctatagtctgccataattctcagccatagagcatgcaaggtgtgttatgttgcagtatgtgttactgtctaagagagcatatattcttctgtcctgcagcaataaagaagcaatatataaaaagaagcctaaatatctattagagccacaggtattgccaagtatatagggggtggaaatctccaaagtaatgagaaaattatgttagaattatga

SEQ ID NO: 639669 - DNA, 322 bp, Homo sapiens
cccttggatctcccccccccctttttaccccggggtggtcccgccctccccaggggtgtttttgcattgtgcctttaaggttgttaatgtaaatccgggctccgcctgcccatccgcctttcccccttctaaaagaaaaggtagtctttccccgccccttttgtttttccttttggggcgggggcatttttgagccttcagttttggttctgggcctttttgtcctccccccggtgccccgtcatttggtccccctctttttcccccccttaaaaatttggctgttttccaccacaataaaataacacgagtttgggcccga

SEQ ID NO: 639670 - DNA, 163 bp, Homo sapiens
gatctgaagttgtaccacggcggggggctgccctccttgcacgacgccaagctcatcgacagttgctacaccaaccctgctgacagggcctactcctgtgtaccagcatacagcgagcccatggagaccccagttgctctgaactatagcttctatcaggtga

SEQ ID NO: 639671 - DNA, 437 bp, Homo sapiens
gtttgctgaattcacgcatatgactttgtacttaacatacagatcttttcttaatatggagtactttggttttgctagctacataccacaaacctaaacctgtattatgaattacatattacaaagtcataaatgtgccatatggatatacagtacattctaattggaatcgtttactctgctagaatttaggtgtgacattttttgtttcccaggtataccacgcttatgtttggtggcattaaataggtttctttaaaatgctacgggggcactgtttgaaacagattgcttctagattgttacaaaccaagcctaaaacacatctgtgaatacttagatttgtagcttaatcacattctacacttgcgagttgaatgacaaagcagctgaacaaaaattatggcatttaagaatttaacatgtcttaactgtaa

SEQ ID NO: 639672 - DNA, 700 bp, Homo sapiens
  misc_feature (51)..(51): n is a, c, g, or t
  misc_feature (53)..(53): n is a, c, g, or t
  misc_feature (55)..(57): n is a, c, g, or t
  misc_feature (64)..(65): n is a, c, g, or t
  misc_feature (68)..(68): n is a, c, g, or t
  misc_feature (73)..(73): n is a, c, g, or t
gtactatttaaaatcagatgtatctacgtgagctagtaattaagagaatangntnnnctgatcnnccntgccncaaggaataacatgaactagcttatgtttcatgatcatcttccaagtgctgtggcaactgatttggccacttcttgttggcagttcttggcaccagtacaattctaggttctgaacttgcaccatactcttatcgtcatccaaattgcagtgttttggttcagttggaaaatcaaggttacagtttgcgttcacagaatgaaatttcccagcagtgttctgtgattgtcagagtgatgtaatttgatatattaaaaatcaacaattttttcctcagctttgttttttagactgaaaatgatttggagttttggtgaacctttatattttgacactacaggagccagccacaaggccaaatgtgtcagctgccagtgtttgcttgacatacaggagaacattaaggaactctcaggttgggaggagggaagtgttggccaggacatcagacggaggtttcttgtatatgtttttttaaacactatttttaaactcttcagtagagggactattttaatattctaggtatagaaataatagcttttataacagtcttagttctaaatgaagcagacccgtcttgtaaacctgagactagacctgaatgtcaagccggacaagatagcca

SEQ ID NO: 639673 - DNA, 259 bp, Homo sapiens
  misc_feature (31)..(31): n is a, c, g, or t
  misc_feature (112)..(112): n is a, c, g, or t
  misc_feature (114)..(114): n is a, c, g, or t
  misc_feature (156)..(156): n is a, c, g, or t
  misc_feature (205)..(205): n is a, c, g, or t
  misc_feature (216)..(216): n is a, c, g, or t
aacctggccaagctgaaggcctacctggctnccctcacccagtccgggctctggtctactacgccaaggcctgctggttaccaatcggccgggggtactcttctttgagggngncgagggctcaccgccgacttctccgggagtatgtcacgctgnataagggatgcttctatggccgctgcctgggcttccaggtcaggccctncatccggccantcctgcagaccatctccatggggctggtgtcttcggggagcac

SEQ ID NO: 639674 - DNA, 358 bp, Homo sapiens
ctcaacgctttatacttctgttaaaaaaaaaaaaaaaattcccacccccacacacacacaaacaaaatccaggcatacagggaaatacggcataggaaagaggtagtattccaaatcaggggggaaataaatgactactaaataaatactggagaccctaaataaaggctttctagataaggagagatgcttctaaataaggagagcaaaaaaactagcatccctatctttcacccatatacacacaaaagaaatccccttatgcaacaagtgcactaaagatcaaagcagaaacctttaaacttttatcaaattataggagactataatcacgagatcagggacgtataaagcgtgg

SEQ ID NO: 639675 - DNA, 1642 bp, Homo sapiens
  misc_feature (1253)..(1253): n is a, c, g, or t
gggctcgtctgtattgcagcgccgcgagaccagctggcgaccccggccaccccaccaccgcagagccgcggctcatggcagcgcataccttgttccgcgcgcatcactacttccgcggccagacgccaggccgcaggagcgtcctagtcgccccatactgttgcgagaatcattggtagcacacacgatacgcgatgtgcgtcgattgcctgcctaccgctagatgtgtcgaggggcgcgtccgacgcggcagcactcgccagaggccgtacgcaggcacgcaacgagaatagctgaacctaaggatccaacccgcaaccataccagtacttcgatgggctacgcatggagccaccggtaacagctgcggcatctctctgagtcctcaatggcccgcatccgtgcagccggtgtccgtcaccgccgcatcgcatcttgtgctgtggcagccgtgactggacccgggcagttggctctcgtgttggccgggctccctcgtctggccctgcggagccgggatgtctcttccgactagggttctgcacaggcacaaccctagagggaaaacctcacagtttcgataggtagaaccagcacacgcgagcgcaacaccttgaggaagaccgagtggcgtaagtcctaggctacgaggaacggccttggtacactatgagaccccggacattctacagcaacaaaacctcattttacttccagaagatttaccgcgttagtcaggcatatgcacgtcgaggaccgctagggggaggaccattttcccagaaacccctcgtagactttggcgtggctggacggcgtccttcagtgccaagttcccacaagaggggggacccaagattgggccgagaaggattcccgcaagtccaatgggggacgagggaccccctctttaccgggaacattggaagcgggaggcattggttcagcgtttatgcttttcgaattccccgagtccaatttgttgagcgccaacatccggggttaagaccccacccaaaggcaaaccctataggagcgcagcacgggcgtcctaaggcaaagtctgtggcccggaaggttagaagaacccggtagagagcatcgtttggggacacgagtttaggtccgcttcgaccttctgcgccgtgggacattgcaaacacttccggctcccgaaactgagggtgtctgacccacagcgcgggccgcacgagacacggcgaggcacactttagaccgcgtgggacaattantcaatcgagcagaaccaacagaggtctgtagtgaaacagcagctccgagatgaatctcagtataatggtgcataggtcactgtttgtgttgtgaccccatcgatcggaaaggcccatcatcgggggaaaccgtgaaaatcgccctagtctgaaagggaagaaaccccagagaattgtagaggaaaccccgagggcgttgactgcacacaaaatcatcgaagaggcactcttccaccagtaaatgtgcgtttaacccacgatcagcactccaccacgggctggcagatagaatcagacctcttaccacatagagaagttgcagagaccaagacaccagattgaggcgacaagtcagataacaacgtcatctgacacgagacacagcgact

SEQ ID NO: 639676 - DNA, 264 bp, Homo sapiens
ctccacccgacggggtggctgggattacagacatgtgccaccactcccagctaattttgtatttttagtagagatagggtttctccatgttggtcaggctggttttgaactcccgacctcaggtgatccgcccgcctcggcctcccaaagtgttgggattacaggcgtgagccaccgtgcccagccaagatctacactattatgtcaccccagaaagtgaactctcactcttcccaccccgtcgggtggagcgctcacccgtcg

SEQ ID NO: 639677 - DNA, 317 bp, Homo sapiens
aaagaagccattatgtgaacaagacacatgcacacacatagttatagtaacacaatttgcaattgcaaaaatatgaaaccaacataaatgcccatcaaccaacaagtggaaaaagtcctatatatatacaccatggaatactactgagccataaaacaaaatgaaataatggcctttgagcaacttggatggagctaaaggccattactctaggtaaataactcaggaatggaaaccagattattgtatgtctcactataagtggagctagatatagatgcaagcatagattatatatgggcggtcagtgctatgct

SEQ ID NO: 639678 - DNA, 294 bp, Homo sapiens
  misc_feature (34)..(34): n is a, c, g, or t
  misc_feature (173)..(173): n is a, c, g, or t
  misc_feature (181)..(181): n is a, c, g, or t
  misc_feature (186)..(187): n is a, c, g, or t
  misc_feature (198)..(198): n is a, c, g, or t
  misc_feature (219)..(219): n is a, c, g, or t
  misc_feature (221)..(221): n is a, c, g, or t
  misc_feature (224)..(224): n is a, c, g, or t
  misc_feature (233)..(233): n is a, c, g, or t
gcaaatcatttcaaattgggaatcaacatctcgnagtccagtggctgaccatcatcttcccatgtcatctgacaggaccgatacgatgtcacttagtcccaactggatcctttacttccaccaccaaaattccatcatgacagagggcttcagacaaatctttgatttcccgncatctggnagttnntactttcgggnaagcttcttgagataaaaccngnctnatccattcnggtccggtttgtgctttatcagagccagccttcgaggtcttaatatgatgtcttcaggggg

SEQ ID NO: 639679 - DNA, 1785 bp, Homo sapiens
  misc_feature (873)..(873): n is a, c, g, or t
  misc_feature (876)..(876): n is a, c, g, or t
  misc_feature (1785)..(1785): n is a, c, g, or t
gggtgtacaggcgcttcgtgcagcggttgggcgtggtggactatatctccttctggtagcctacatgcactggaagaattgtgacagcgattgtatcatgtgattgagtcacgaacttaggggctccgtgtctgatggacgcttgcatcttcaagctcaggagacaggtgcgcattgtccgttcgcaccagttgcagtgaccgcctctacattgagtttctactacctcacagttgtccgacatagtttgcccatcctagaatagctatgctcacgtgagccaagtactcttgcgactgtgaccagggccgatgcatcagtgccattgtaagcaaaaagattggagagcacgtctgcacactgattggggcgacactgcacacggatctagccagtcactttggcacgaaagaaagggcagaaagaactcacacgtaactgaacaagtactacacagtggcagtgcggcgcattgacaaggtctgaactgtggacagggtccagatgcgacagagaatgggatgcggaacaatagggcagagttacatttccaaaccgaaacactagagtagggtatcaaaaaggagaccgttcggtctcagcactaccaagtgggcaggccattctgtgctcctgtgggacgaccccgccattacattgtcgccgcccaactacgcaatacggctcactgcgatgcagccacaactccatagcgggtggtaatcgtacggcctatggaagttgcctttgccgatcacactggcgttcgtcgttggacatagccccattgtcgcatagggcactaagagctatggtcgaaacaaaaaaggctattgagcaccaattccacaacaggaaatatactaccgtacnatnctagcccacacagatagctcggtcagtgcacacgttgtgtacaaaccagcaaggcggcgcaattatcccataggtcatcgtcaaagacaagaacgggccttattatggcggtcgagccaccacagagggtacacaaagtgcaccgaatagagagggcacacacgtaataggcggtctagtccggctcgttagacattctcgaatcttacatagtggtacaccgaacaaagggggtgcccaaatgacactagagttctaccaccattgtgcccaacaccgcaaaaagagagcagaaccgttggctgttcacaataggaggccgacccagttcctctgggtgggagacagcaacagtggtactggagttaagatggttagttgtgacaccttccacgtacaagggtataccggttcacactagtagaaatgggaggttcccgatatctcgcctttgggaccgcctttcggtaatctgtaggcagctagagccattagtcgcactacaaagtaggagaactatgatttggtgctcccaaaacagcagtctctaattaccaccattgaggggcctctttcgaccatccgtgaagtaacataggagttgctcacacctatcggaactaatatgcgggcgctcttatcaagcggttggttagtccgccataccgtggtgcgcctaagcagagcatagtcaccagccagcagtcatggtaagacacgatagagagacttggggctcaagattcatcatgaagccagagagcagcatcatgccataacaagatcagattgcgcttgcagtcctctcatcaacgcaaaacgtgatgcaagatactcagaccagcggcgtggtacgatagcaggaaagctagagctctcagtccgtactagtgcggagagagatctccn

SEQ ID NO: 639680 - DNA, 542 bp, Homo sapiens
  misc_feature (534)..(534): n is a, c, g, or t
tctgatctggatttcatttattttcatgagaggggaggtgtgagtcctcattgttttcgactcattaaaaatattgctttgattttttaaaaatacaaaagttatttttttaaaaagaagaaaagtcacagaagttaaactttctttaaagcgggactctggacttttgaaaacaagtgttgctgttacgaacaaagactagaagtgtacccagattttctcccccccggggatcatttctcttccaatcaacaaacaaatcccccagtatttcctaccgaaagggaagggaagttttccagggagagtctcctcctgggtttggtggtaactgcgactcagtcttttttggacacaatgtttctgctgactcctgaaaattttccacttgaatgtgcaatgaacggcggcggcagcagaggctcggctcggctcaggcggcgcgcgcggcgcgagcgatgctaagaatgttcggaatgaggacaggaatgaaatgacgccaggaccgactcgctccggaggggtgggcctcgngacccgct

SEQ ID NO: 639681 - DNA, 926 bp, Homo sapiens
  misc_feature (48)..(48): n is a, c, g, or t
  misc_feature (120)..(120): n is a, c, g, or t
  misc_feature (918)..(918): n is a, c, g, or t
tcctaagtttgatgtatctggctatcaaatcattcctaccatacattntgccttcgtctgataagatgattttccctcctcccacatggtggatagatagccagggcctcctgaaagctntgctcgatgtcggggctccagaccccttctgcatcattgtcaattggcttatctgcagagtcactcatcctttccatgttttcggcagggctctcactgccgctccagctgctgggctcaattttggcggtgggattttccaagccgaagcctggagccttttcaagaaaataaaccgaaagggaagggaagttttccagggagagtctcctcctgggtttggtggtaactgcgactcagtcttttttggacacaatgtttctgctgactcctgaaaattttccacttgaatgtgcaatgaagcggcggcggcagcggcagcaacagtcctcggcccagggagccaccgcagcgcccggcgagtccgaggcaaacttcggcgccgcttcccccgccctctgctcggtgcccggctccctccccggctcccggtccctgggcccggccaccccacccctgcctagcaccgctcctgccccggggccggctggcgcgctgggctgctgcccgcgctccgggcaaaggtggaggggtgggggggcgtcactgcatggcctgtgcctggacgcggccgccccgggcccgggccccgccgcgcggaatggcccgcagggtggaagcgagtctgcaaagtgcttggtgggcgcccgcggcgggcggcggggccgcggcggcggcagcagaggctcggctcggctcaggcggcgcgcgcggcgcgagcgatgctaagaatgttcggaatgaggacaggaatgaaatgacgccaggaccgactcgctccggaggggtgggcctcgngacccgct

SEQ ID NO: 639682 - DNA, 908 bp, Homo sapiens
  misc_feature (900)..(900): n is a, c, g, or t
tctgatctggatttcatttattttcatgagaggggaggtgtgagtcctcattgttttcgactcattaaaaatattgctttgattttttaaaaatacaaaagttatttttttaaaaagaagaaaagtcacagaagttaaactttctttaaagcgggactctggacttttgaaaacaagtgttgctgttacgaacaaagactagaagtgtacccagattttctcccccccggggatcatttctcttccaatcaacaaacaaatcccccagtatttcctaccgaaagggaagggaagttttccagggagagtctcctcctgggtttggtggtaactgcgactcagtcttttttggacacaatgtttctgctgactcctgaaaattttccacttgaatgtgcaatgaagcggcggcggcagcggcagcaacagtcctcggcccagggagccaccgcagcgcccggcgagtccgaggcaaacttcggcgccgcttcccccgccctctgctcggtgcccggctccctccccggctcccggtccctgggcccggccaccccacccctgcctagcaccgctcctgccccggggccggctggcgcgctgggctgctgcccgcgctccgggcaaaggtggaggggtgggggggcgtcactgcatggcctgtgcctggacgcggccgccccgggcccgggccccgccgcgcggaatggcccgcagggtggaagcgagtctgcaaagtgcttggtgggcgcccgcggcgggcggcggggccgcggcggcggcagcagaggctcggctcggctcaggcggcgcgcgcggcgcgagcgatgctaagaatgttcggaatgaggacaggaatgaaatgacgccaggaccgactcgctccggaggggtgggcctcgngacccgct

SEQ ID NO: 639683 - DNA, 836 bp, Homo sapiens
cggcggagcttaactgccgcggcgtatgggatgtaactgtgagtggtgaaggctgcgggtatctggtggagagctaccacactagtttgcaacgaaacggagcgggacgaagaggcggtatccgtatagtcaggctgagactctcagagcacgacgggcacacgccctccttaggctcgctcgcgcgggcggcggcttgccccgcttagtgtgcctagcctccgagcattgcctctggtcttcaaacagctggcggcgccatgagtccttaaggtgcggtccaacgcctcccgtatcccttggtcccagacctcgggcccaccatggatgcctgggtctccgactgatttccgtacgcgcgcacctggagtgcccggtgttctgagcctagctgggccgagttcctgagaccctcttgtgctacatcgcgaaaatcaggcccatcgcagagaaatcgggcatttgcaagatcctgccacccgcggactggcagccaccctttgcgtgtggaagtggacaagcttcaggtttaccccccgaatccagaggctgaatgagctagaggcccagacgagagtgaaactgaactacttggaccagattgccaaattctgggaaatccagggctcctccttaaagattcccaagtgtagaacggtggatcttggacctctacagtctcagcaaaattgtggtggaggaaggtgggttatgaagctatctgcaaggaccgtcggtgggctcgggtagccaggcctcaatatccacaggcaaaatattgcgtccttgtacgctcccactaacgaacgcattgtttatccctatgaaatgtccag

SEQ ID NO: 639684 - DNA, 230 bp, Homo sapiens
cttaagaaatctttccctacctggggggtacaaaggcattatcctgtattcccaggtcgtaactttctgcctttgacatccaaccttgagtccacccgcaagtgtaactgcggcagaaggcaggggcctgccgtcatcctcgctacaccgtgacgagagagcacctctgccgaccgcgatgcacacgtcatctgagcaagaaataaacttcgactgtgcgaagaaaaaac

SEQ ID NO: 639685 - DNA, 772 bp, Homo sapiens
  misc_feature (48)..(48): n is a, c, g, or t
  misc_feature (120)..(120): n is a, c, g, or t
  misc_feature (764)..(764): n is a, c, g, or t
tcctaagtttgatgtatctggctatcaaatcattcctaccatacattntgccttcgtctgataagatgattttccctcctcccacatggtggatagatagccagggcctcctgaaagctntgctcgatgtcggggctccagaccccttctgcatcattgtcaattggcttatctgcagagtcactcatcctttccatgttttcggcagggctctcactgccgctccagctgctgggctcaattttggcggtgggattttccaagccgaagcctggagccttttcaagaaaataacctcggcccagggagccaccgcagcgcccggcgagtccgaggcaaacttcggcgccgcttcccccgccctctgctcggtgcccggctccctccccggctcccggtccctgggcccggccaccccacccctgcctagcaccgctcctgccccggggccggctggcgcgctgggctgctgcccgcgctccgggcaaaggtggaggggtgggggggcgtcactgcatggcctgtgcctggacgcggccgccccgggcccgggccccgccgcgcggaatggcccgcagggtggaagcgagtctgcaaagtgcttggtgggcgcccgcggcgggcggcggggccgcggcggcggcagcagaggctcggctcggctcaggcggcgcgcgcggcgcgagcgatgctaagaatgttcggaatgaggacaggaatgaaatgacgccaggaccgactcgctccggaggggtgggcctcgngacccgct

SEQ ID NO: 639686 - DNA, 190 bp, Homo sapiens
cggcggtctcgtatctagtctagcatgctttggcaggcacactctagtcatagggctagagatcgacactggttagttaccagacgtaggcctagacaataaacatgctagctcgttattccagatatgctagccataaaagatataaacctctacggtaccacagcaaggctgccatacaagctattta

SEQ ID NO: 639687 - DNA, 1308 bp, Homo sapiens
  misc_feature (219)..(219): n is a, c, g, or t
  misc_feature (621)..(621): n is a, c, g, or t
ctttcattatgtgtatatcgtcttaggtttctaaatcgcatgttagtagagctcgttttaacttccgacgagcctcccttccggaatggtggtgtttctagtctccccacagaagggtaaatatacgtgtgtcgtgagccggcgcacttaattttttgggggagtccatatagactacagagcccctcctaattgtgcgggcgccaaagcttctcacanccccttgggcggccccgattattacaaggcgggtctccttggcaaatttttggccccatccaccgggggcccaattccggcccaggaattggggggtcaccgggggtcccttcgccaaggagggagcaacttggccaaaggtccaatgagagggccccacggtgggacccccccgggatgaaagcacgggtctcgcaccacatgcctggaagatatccccggagtcgccgtggttcccgaaacacgccgcgtttggcaccccgggggccccaactaaagggggccaagggttccgaaagagaagggaaggggggaataaaaggggggaagcaaggagcgcccctcgaggattctcgggcgcactaagggcacccgcactattctgatatctcggagcacaanaattctggtgacctagcaccgcgatatctccacgcccccgaaagcccacaggggcccaatgtccacagcacaggcgccccacaccacatgggagaaatctcaagattcacccgcaccccacagccacgcacagagaatggggagcactttcttgagcacatctgccacagccgaacgccccctgagagatcttctggggcacagcacccacaaccgcgtggcctcgtgttggcgggaactcggaggggcaccacgttgaaggaataggaagggttggttaaagaaaaaacacatggggggcccttctatcgctgtgcccctctgcccacgggcaacttgcaattccagcctcgctgcacatttgctcttttcgagttcccctttcctcctcaactgcctcccaaagcgccacccctaactcccaaaataaatgggtcacacattgaatattggaaacataattcaagcagttaaagtaaatgagatcccaccctttactaaaacacctctttctctgaaaccccccttgcccctcactgattcttgctttttccctggttctcacagcacgttgtgggtcaaaattgtgggtgaatcgctaattgtactgattgtttaagtgtgcattagttgtgtctccccaggctagattgtaagctcctgccgcggacagggaccacctctaca

SEQ ID NO: 639688 - DNA, 1094 bp, Homo sapiens
  misc_feature (841)..(843): n is a, c, g, or t
  misc_feature (859)..(860): n is a, c, g, or t
  misc_feature (868)..(868): n is a, c, g, or t
  misc_feature (872)..(872): n is a, c, g, or t
agcggggggttgcggaacggcggcgcggctgtctaggaaaccgcggcgtcggctggcaggggctggcggcctgagctgggcagggggcggaggcgggggctcggctgtctccggggctgccacgcagagcgggcttcgtggcgtggacataactgttcgtttctaacgtggctgtagttggcattctctctcataccaagataccttttgagactaaaagtgaatcagaaaaataaagaaccagcatcaaatttgaagtggccacaaattctattaaagcagaagaaatagtggtgaaccataaaagagaaccagtttcctctctattctgcaatttagaggaaaaattttcatccaaggacagatcaggtggtggacctagatgggaaacccaaattataatcaagagatttcttggtactgtttttcaaccctactctcttgaccaagaatgaaactatttacaaattaagatgccaacagatcacgaagagccctgtggtcccagtcacaagtcgtttgcctgaatggggggcttgttatgtgatacctactattcccagcccatttgtaggtgcgttgaaaactatacaggagctcgttgtgaagaggtttttctcccaggctccagcatccaaactaaaagtaacctgtttgaagctttgtggcatggcggtcctagtaacacttatcatggagccttctacttcctttgcaggaaaggccactttcagagagccagttcagtccagtatgatatcaactggtagagacgagcagtaccagtgcccaccacagtcatgaacaacactgaagaaacgtcaagtgaaccaaatcttgnnnttatttaccaaagcgnnaaatgaanaccnctaagtcaaagaattacacaatctaatccttttatttcttgaataaaacgcttgtgtaactcgtttcatgaaccagaaaaaaaaaaaaaaacacttttgtggggcgggccaggaaaaatttaacactcgtgggccgcccctgtggcaaggccaccggccgagaccggcccgggggttcccaaaaaccgggcgggctgcaaccaggtgggcggtacaggccgc

SEQ ID NO: 639689 - DNA, 376 bp, Homo sapiens
  misc_feature (57)..(57): n is a, c, g, or t
  misc_feature (69)..(69): n is a, c, g, or t
cgggggatccggggacatgcttatccttttcactttgtgagttgaagaactactggnaaaggaatcagnagcacctccagccatcagccagtggagaaaccaagccctttaattcaacattccctttaagaagagaatctggcaccaacccaggtaggttggaaacagattattccccaacccagcgcttagaagaaacacccgccctgggtggcaccttgacttccttctgggagagaccctgaaacaaaagacccatctagggtatggcgattcctgacccatggaaacccctgccataataaaaaaggatggtggtttaaactactaaatttgtgggaatctgttatgcaacaataaataactattgtaccct

SEQ ID NO: 639690 - DNA, 81 bp, Homo sapiens
ctcctcagtgactctggcttctatctctgtgcctggagtgtatacggtgttaaaacagggatgaacactgaagctttcttt

SEQ ID NO: 639691 - DNA, 959 bp, Homo sapiens
ggcaagctcggtgattctcggctcacgcgggaggggagtacagggtgggggtccgggcctgtagttcagtgggtgcagcctgcttgcgatgctgagggccagacatggctggcggcgcctacggacggaaacgaaacaaggttgattacaaacgggaccatattttgcttcgaaatggatccagcagttaacgagccaatgagagaccaagtcggacgggactcatttgagagaggagacgtccctaatagtgaagtgctgacatagaaaaggtttagcagaatcaggtcatagagatgcacagtgatctgagggttctggatttcctggggcatgacatggtggagtcagttgctggtcaagaggatatgctgtcaatgtatttgatatccagcaagggtttgataatccggctcgaggtgcggttctttctgggtgagctctgcagacgagcagtgatcgtgtacccagttctggacaggtgtaaacgcagtttgcccacttgttgggtcacccccaacatccagtaacaaggaaggagctctttgtagtagagtgaattactgtggcaccactgaatgtcattgaagacttgtaagaggcgtggggttcagaaactcactttgaaccagtgaggtgccagctgtcagtcttctgagggcgtcgattttcaatgaatgggaactgaaggacgttcctatgcatggaaaacgcagttgactactacgcaagtagactaagatcttacggagagggcgttcttgggcgcaacgagtcctgagaaggaattcttaaacaaaggcatccggcctcatgggtttttgggcccaggacccggcggggccattctctttaggggccgaaacggaaagtaatgggttgatgggagactgtgggcgtcccctgttggaatgtcgcaactgtgggcgagacgtccacacacgggggagtccacctga

SEQ ID NO: 639692 - DNA, 781 bp, Homo sapiens
  misc_feature (528)..(530): n is a, c, g, or t
  misc_feature (546)..(547): n is a, c, g, or t
  misc_feature (555)..(555): n is a, c, g, or t
  misc_feature (559)..(559): n is a, c, g, or t
cagattttgacatgttataaaatgcaagtcacagctgctgtgtctgcggtattcaaaaacttttgaaacactgcatgtccaacaaaatttatttttgtgtgaatgtactgtttttcaaccctactctcttgaccaagaatgaaactatttacaaattaagatgccaacagatcacgaagagccctgtggtcccagtcacaagtcgtttgcctgaatggggggcttgttatgtgatacctactattcccagcccatttgtaggtgcgttgaaaactatacaggagctcgttgtgaagaggtttttctcccaggctccagcatccaaactaaaagtaacctgtttgaagctttgtggcatggcggtcctagtaacacttatcatggagccttctacttcctttgcaggaaaggccactttcagagagccagttcagtccagtatgatatcaactggtagagacgagcagtaccagtgcccaccacagtcatgaacaacactgaagaaacgtcaagtgaaccaaatcttgnnnttatttaccaaagcgnnaaatgaanaccnctaagtcaaagaattacacaatctaatccttttatttcttgaataaaacgcttgtgtaactcgtttcatgaaccagaaaaaaaaaaaaaaacacttttgtggggcgggccaggaaaaatttaacactcgtgggccgcccctgtggcaaggccaccggccgagaccggcccgggggttcccaaaaaccgggcgggctgcaaccaggtgggcggtacaggccgc

SEQ ID NO: 639693 - DNA, 346 bp, Homo sapiens
cactagttgtacccgtcgcatctgatactgtgacaaaagccatttcttcaccctttttggtacgggttgtgcgcacttggtcaatgagggcaataacggtcaccggttgctttttatcagtcttttcagtcaaatcagcaatctcttggtaattgtgatcagcaattaagctggcatacccatccagtggatagcccgataaattcaccccgatggcctcttttttcataggctaacttctccgtcaaatcccaattccggcattttttttaaattttggtttcgtttaaaattaaggcgccaaagctagccgcttcaatcaaatcatcttaagcggtaacaaggt

SEQ ID NO: 639694 - DNA, 1359 bp, Homo sapiens
gcgttgatggggatgggcgtgtgacacatgttgtttcttactggcagtaatcagataacagatgtgtattggctcgttttcaggtgtggtcgcgatcatattctcttggtgaaattgatgtagaactgataaactgatacactggaaatgaattagtttaggggtggtttcattattatagcacaactcgtaatatgtcatcattgaagacttgcaatattgaagcggcatgtccctctgaagagattatgattgggaacggcaccctattactgtgatcatgtgagttagggtattagaagctttaacagagcgaataagatactaatatttgaatattctagaccaatgtagatacgagaattgatccatactctaacaataacccaagagggagaagcatgtcgagggcttgcaaacttatgtgactcgccgcactagagagaggacgattagaatctgaaatattccagaggaatatataccagacctgtcggctacagtatatattacagatgatgtcaaagaaatgagtactacacactattaacaggttgactacacagacataggtttcaagagattattcagagaagaaaggtcttgatgcacataaagaatcacgggtacttttagtcgcggaaaggcctcgcccggtacttatctgcctaggagggcaacacacagggggtgaacgagaccaatagtggcggttacagatggatattaataacgtgggtctcactatgtctatggctttatggaaaggagggcgacattgttgcgcgtaacctatttgcggaacaaaggagttggcattgcccaatatagagaaaaactcggtgcggtggtttcacacaccaaatgtataccatctatgccatggattgcgcttattttgtaaaggcggattgacccaattcttgggtgaattcaccttattggttaacaaccttgacattaggacgttatcattatttttagtttatttataatgcaagggaataaaagtggtaacagacatattgaaacatttgtaaacgagaggacttgggtttcataaaattgaagaaaattcttaattcgcaacaggttctagttaggggcacgaggttcctataatgctgttaacgctatcattcgagaacattttttttttaccagtggcactggctatggcatgcacatttggattattttcttccacgctggctttgatagagactctctctcaataaggggtggagcatcttgtggaatgtggtaaacgtggttcattgatgttaacagtctttgaagtaggaataacaatttacggtgagcatgtgtgataaatggtatttatatatggtagaattt

SEQ ID NO: 639695 - DNA, 756 bp, Homo sapiens
tgaaaccgaacctcgacacaccttcttcgaccccgccggaggaggagaccccagttctagtaccaaacacctattctgagtttgtgtcggtcaccctgaagtttatagttcttatcctaccaggcttcggaataatctcccatgatgtaacttgaacgttactccggactaccaagaaccgatttggatacataggtatggtctgagctatgatatcaaggttggcttcctagggttgatcgtgtgagcgcaccatattttacagtaggaatagaggtatgatacagtgagcatttttcatcctccgactaccataaatcatcggctatggcccaccggacgtcgaagtattgaggctgactcgtgccatactccacggaagtcaagtatgaaatgagtctgcgtgcagatgctctgagccctaggagttcatctttctttctcaccggtaggtggcctgactggcagttgtattagctaagctcatcacgtagacatcgtactagacgagaccgtactacgttgtagctcacttccactatgtgctatcaactaggagctgtgatttgccgatccataggaggcttcattcactgattgtcccctatgctcaggctgacatccctgaaccaataccgtacggcgaaaatccattttcgactatcgatattcgatcggggtaaatctaaacgttgtctttccaacaatatttctcggcgtatccggaatgccccgacgtgactcggacttaccccg

SEQ ID NO: 639696 - DNA, 289 bp, Homo sapiens
ctgatccgtttagcacgaggtcaggagtacgagaccggcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaccaagaagaaaaggagtgaattagaacttcttctgctgggacttaagc

SEQ ID NO: 639697 - DNA, 342 bp, Homo sapiens
aaaaatgacccccatttgtgtgtcttcattgagacccattccctgaatgagcaggtgaaacccatcaaagaattgggtgaccacgtgaccaacttgcgcaaaatgggagcgcccgaatttggcttgggggaaaatttttttgacaagccccccttgggagccagtgataatgaaagttaagcctggggttaatttccccaaacccgtggggtgatttccctggtccccaagccagggcaggcatgttggggtttcctttcccttttctataagtggtaccaaaacacccacttaagttttttgattggccccattccttcaaataaagaaattgggtcccca

SEQ ID NO: 639698 - DNA, 130 bp, Homo sapiens
gatggtatttctgaatgttgacgttccagtgggatgtgagtccttcatttttcctgtcttcctgtccctttggtacagttgttactgtcaacacttatcattcgtgtgtgagattgtttatccaaaagaa

SEQ ID NO: 639699 - DNA, 532 bp, Homo sapiens
gactctctcatgcaacattgtgtctttttgtttcttttttttttagtttaggaattgttcaattcttttcatctccataatacatagtcttactaagaagacaattctggaatctgaaagctttcaaagccacttgtggctactcttaaattactttctgcaggtttaaattaactgtgtgtttgtaaaccaggtgcttttcaagagttagatcccctaacagtcattcgtttttttttctatgtgagaaaatgcattattgtgaaggttcagagacataaagatggcactagagaactaggatgatgctttcacctccataaaaggagaagtataaaagagaactgcccaaggaaactccaatattcagttgcatgtcagcaaatgggggaaacgttctaaaatgccctacctttatacatttaaaaagatgaaagattaagtttcaaggaactcacagcaaaaaaaagagaaaacaccccaaacagtactttgactacctccagaggaataaagggctatattcccatga

SEQ ID NO: 639700 - DNA, 666 bp, Homo sapiens
ggggtcgctaatccgaactctgcttcggagcctacgatatcgtggcttctctggcgtggccagtcagccacagggaactattaaaaaacagaaaaagaaaaaatagatagtgaaagaggggtgtagtctagttgcaaaggagaggagagaggagacgtagagtcgccctgtgttgcccaggcatggtcttgaacgtcctaggctcgaagagatcctctctgcctcaggctcccaaagtgctgggattacatggcaactctggtagctctctctttggtctggtttagttattggaatgataagaaagagtcagagaaggataataaggttgagtaaatcatgtcggagtaactgtgacctttctatttctgtctgtaggaggacacaggtactttgattgctcagtgttgctacagcgagatgaagaggtccggaaaggagatgagacaaggattacggcgactagagagaatgagcttgactgggatgatagcagaaggacaagggggcaagtagggggcagccataacatgttacgatgtgactcgagagcctgctggccccaggtagcaccaaggaggaagtcccttggggcacgggggttatggcaggggtcccccaaggaaagcccaaattcaccctatggtccggtgggctaaggtaact

SEQ ID NO: 639701 - DNA, 161 bp, Homo sapiens
  misc_feature (110)..(110): n is a, c, g, or t
acccctgaatttaagccagctgatagtactccggaggaggcagagttcacaacagcatcatatgcgaggtgcagcccttaaccacagcgccagagtcaaacagtgcgcanaggctgtgtactcctctgggggttcagactctgggcactgtttggactctg

SEQ ID NO: 639702 - DNA, 124 bp, Homo sapiens
ttaagccaagccatacgtttaacttctagttaggtctacctggacgacaacacataatgacccaccatcatagccaccatcaccctccttaagctctacttctacctgggttaggtctacctgg

SEQ ID NO: 639703 - DNA, 540 bp, Homo sapiens
  misc_feature (18)..(18): n is a, c, g, or t
  misc_feature (222)..(222): n is a, c, g, or t
  misc_feature (267)..(268): n is a, c, g, or t
  misc_feature (389)..(390): n is a, c, g, or t
  misc_feature (395)..(395): n is a, c, g, or t
  misc_feature (406)..(406): n is a, c, g, or t
  misc_feature (409)..(410): n is a, c, g, or t
  misc_feature (412)..(412): n is a, c, g, or t
  misc_feature (419)..(419): n is a, c, g, or t
  misc_feature (432)..(432): n is a, c, g, or t
  misc_feature (439)..(439): n is a, c, g, or t
  misc_feature (472)..(472): n is a, c, g, or t
gtcagctgacccaagggncttcgaggtgccttagccgcttgcttgctcctcagaatcgctgccgcatggctagtcagtctcaggggattcagcagctgctgcaggccgagaagcgggcagccgagaaggtgtccgaggcccgcaaaagaaagaaccggaggctgaagcaggccaaagaagaagctcaggctgacaattgaacagtaccggcctgcagagggnagaaagaattcaaggccaaggaagctgcggcattgggatcccgtnncagtgtgcagcactgaagtggagaaggagacccaggagaagatgaccatcctccagacatacttccggcagaaccagggatgaagtcttggacaacctcttggcttttgtctgtgacattnnggcanaaatccatganaanntncgcatanatggatagaaganagaagcncctgtgctgtggagtgcattttagatgccctcngaatatgaagttagcacagtctagttaccttgctatgatatggcattaaattatttccatttattaaa

SEQ ID NO: 639704 - DNA, 433 bp, Homo sapiens
gtagagacggggtttcaccgtgttagccaggatggtcttgatctcctgacctcgtgatccgcccgcctcggcctcccaaagtgctgggattataggcatgagccactgtgcctggccacatctggcttttgttatatgatcagaacaaagggcccactctagttctctacatgtcaatcaatcaagcatgttgaataagggacatagaggatttaacttttgttaacgtaaatggaacttgcaggccttttttgaggaccctattgaggattacctatccaatcattgggataaaaacttacctcattgttaatagaatgggcaaatgttcctaaactgctgaagctacatgtgttttgttccgtttaacaaagtcaggtgtttgagagttcgtttccactctactactactcatagagctggtttattcttt

SEQ ID NO: 639705 - DNA, 761 bp, Homo sapiens
cattcagtcggtgctcgggccctagtacggtaagtggaagttgcacatagcatgtcagttaggcagcatcctggtgcatagatattgagccttgagagtactacaccatgtgatgtgaacgcccggtggtcaccgatatgtcctgacgcggactccgagaataggtcttctgtaggctcgcttgactgccatggctatccatttaggagttccagagcgcagctcggatgaatccccattatgccaccggtcatgtatggcacaacgtttcaagtacacaggggtccagaaacttgcagaattcgcacacatacagaaatactgctgcccacaccaaataacttcgacgcctgtgcaagaccctcacacttggtccagttgcggcacggtgcgagccttacacttcaacatccacgttacgtctaagcaccttggtcagcttgcccaaaatctacacaacagttacacgctgacacctctatagcattctgcctgcgtataacatgccttacatcgcaagcgatgcaggaactgcttgacaaggctccctgccgcactatttacgagcatccacggacagacacgaaccttgatccctgcaacgaagtgaccagcatccagctcggtcgcatactactccttgacattactcctcttgtacctaaacaaacctttacaagagtaccaggtggatacactgaccaaccgcgcacccacaatcaactctaagaacggccaacagaccttcgcagcgcgaacct

SEQ ID NO: 639706 - DNA, 83 bp, Homo sapiens
gggggggttttcccccccccaccaaattgggggggaattgggtgaaacccaaacccttagtttcccccggggtgtttttttta

SEQ ID NO: 639707 - DNA, 411 bp, Homo sapiens
cacgaggagagagagagagagagagagagagagagagagagagagagagagagagagagagagagcgagagagactcataccgagttagatacatactgacacacaccttgatcttgctttgcccctccttctcccatcattccttcattcctccctgttctcccatgcctctcttctgctttattccttctccttcattgctcctattgtatattatttaccccttcgtcacttgtcttgttccactttctttttctttctttctgtccctttccctctctctctttttcgctcttttactgttttttcctctttgtatcgtctcttctttctttttttattccccttcttctctctttctgtttttcttttttctttctcttccttctctccttccttttctcttttcc

SEQ ID NO: 639708 - DNA, 537 bp, Homo sapiens
atcaaacaagcgcttgtgatgggttatgttgaagtcagtgccttgggggaccatttgcctatggacttgatcatcataacattcatggggaccaggagcactgtggcatgtgacaggattggagcttcaagaaagaggatgacgacttctacttctggttctaaaggggcaataggggctggaatcaccctcccattataaaaatctaaaaaaccaaaacacggttgtgaatttagacaacaggccgagcaggactgtggtcccaagaaaatggaagctgatgggcacgccctatgctcacccaaactttctgtctggaggtggcttccggactgcaacacaggccagaagaggcaaaggggctcagcaggttaaatgccaaatcaggagaaggttgaaaacaacacaggtaagactggcagtcaagacaacagcaaatggacaagctgtagagaaaagcaatgacatcaaaggtgttttatttaagatgattaataaaatggaataaccttggatggactgattaagaaaacaaaa

SEQ ID NO: 639709 - DNA, 820 bp, Homo sapiens
tcaatgggcaacacaaattatattggggaaaaagactctggggagaaggggtgtaccagctagtgccaaagcccccttcccgtctttacggggtgtggcccagtttacagtctcccgggcaggaagaggctcgtgggcactgtgctgtggtgaaacagtgggcggtggtgggacggatgtgcttgggcgtgcgtgcataatgtgaagggaaatttagtgtgacacgcccagggtgtttagggccgtgggcaccttgcctgggacgaggaagtggtttcctcacaggctctcgaggcccgtgggtggaaatttgtctccactctcgtgacccagtgttggctcacaacgtggctagggggctcgtgcaacaatatagtgtgccacgcttggggggccataaccgatctctcttatatgttgctctatcaccttataggttatataacaacacatgggcgcaacaaccgggggccgtctcgatgtggatctcccaactctgtgggacacgtgacatatcactgtgcgcgtggcaacatagcgggggcagtctgtgcgtgcactctaacggggccgcagtgggggttaacccgtggggaacgcaccttctcaccggcacagtgtggatttctccccgctgcgtgatgagagggccctacgttggggtttatctttacaccacgctgtgttgttcaccacaaagccggcgtgttgcacacaacttacttacttttatactacccacgtgggttgtataccacctgcggccgatgtgcccttctgcccccgtgggacatacaacaccaaattttaccaagccccc

SEQ ID NO: 639710 - DNA, 119 bp, Homo sapiens
tctcgactctcttgagcgagggtcatggggcgttggcactgtcatctcctttctcctttcttcccctttctctgccgcctttcccatcctgcgtagacttcttgatgtcgagcatgtcg

SEQ ID NO: 639711 - DNA, 335 bp, Homo sapiens
  misc_feature (11)..(11): n is a, c, g, or t
  misc_feature (327)..(327): n is a, c, g, or t
tagtttgctcnagcatgcctggacagaactagacaagccccagcccatagtgcatgccattccttatttggagatgcttccttaactatccctgggcaacttccttttctttctttcttctattccccttacctaattaagaaagttttaaactaacagccaatcgggtaaagtgtaaaatgggaggtcctattccagccaatggaaactggacacagcagtagggtaaacacgtcaggttataagtaactctgtctcctttgtttggtgtgctcttgtagctggacagctattgagtagcaccctttgtgcagaaaaataaagctngccttgct

SEQ ID NO: 639712 - DNA, 861 bp, Homo sapiens
ggacttgggctgggcctggtggagggggctgcagcgaggctctcggactgggcgctggcctgctttggcgccctgcgtctcaccctgggagtggggggctgcgggggagacgtcctccaaagcgccgcccccttccccagctctgaacgagcccaccatggactacggattccagaggctacagaaagtcattcccagcgtgttctccttctcgcctgtcaaacatgatctccgccgtcaaacagaggagcggccttggccccccgtggtggccccccaaagtgtccaacacaggctgccccagagccccaccggagaggggttcccggaccagtcttggtgaggattctgacaagtttcactgctccagccgggggcattcagaggcctggaatactcctaattacggtctgcagctgttcccatggagcccggactgcaggttccctctgggattcacagccaaacccggatggtggcaccagaacagatgcagggtccgggccattgggcggacctcatccgtgagtctgacgggggaggaggcttgaaccaatgatcaagcgtcccgtaagcagcccacgaggttactgtacgcctccccgggtaaggggtagtaagaagcccagcatgtgcggatggctcatggcaggacagccatcgcagggacgttgcgggatcaggccaacgggggggctggaccacgaacaatggctgggcgaccagctgtgaagagggacatgcatggaacgtgggaccgagagccgggcaggccgaagccggtggctgccaccaggccagccaccttgtacaggggccagatgaacacacgcgaggccaagtggcggccacctgagaccg

SEQ ID NO: 639713 - DNA, 958 bp, Homo sapiens
  misc_feature (113)..(115): n is a, c, g, or t
  misc_feature (118)..(118): n is a, c, g, or t
  misc_feature (121)..(121): n is a, c, g, or t
  misc_feature (123)..(123): n is a, c, g, or t
  misc_feature (126)..(127): n is a, c, g, or t
  misc_feature (129)..(131): n is a, c, g, or t
  misc_feature (133)..(135): n is a, c, g, or t
  misc_feature (137)..(137): n is a, c, g, or t
  misc_feature (142)..(142): n is a, c, g, or t
  misc_feature (153)..(153): n is a, c, g, or t
  misc_feature (178)..(178): n is a, c, g, or t
  misc_feature (184)..(185): n is a, c, g, or t
  misc_feature (187)..(187): n is a, c, g, or t
  misc_feature (191)..(191): n is a, c, g, or t
  misc_feature (195)..(195): n is a, c, g, or t
  misc_feature (201)..(201): n is a, c, g, or t
  misc_feature (207)..(207): n is a, c, g, or t
  misc_feature (457)..(457): n is a, c, g, or t
  misc_feature (540)..(540): n is a, c, g, or t
  misc_feature (546)..(546): n is a, c, g, or t
  misc_feature (592)..(592): n is a, c, g, or t
  misc_feature (633)..(633): n is a, c, g, or t
  misc_feature (657)..(657): n is a, c, g, or t
  misc_feature (752)..(752): n is a, c, g, or t
  misc_feature (760)..(760): n is a, c, g, or t
  misc_feature (765)..(765): n is a, c, g, or t
  misc_feature (772)..(772): n is a, c, g, or t
  misc_feature (803)..(803): n is a, c, g, or t
  misc_feature (810)..(810): n is a, c, g, or t
  misc_feature (846)..(846): n is a, c, g, or t
  misc_feature (861)..(861): n is a, c, g, or t
  misc_feature (887)..(887): n is a, c, g, or t
  misc_feature (955)..(955): n is a, c, g, or t
gcagcgagtgacaggacgtctggaccggcgcgccgctagcagctctgccgggccgcggcggtgatcgatggggagcggctggagcggacccagcgagtgagggcgcacagccnnnacnccnangcnncnnncnnnanacccncaccagcgcancggccctcggcgggacgtgacgcancgcccnngncgcnggtntatttnatatantgtttgcaacaaattcgacccaggtgatcaaaatgattctcaactcttctactgaagatggtattaaaagaatccaagatgattgtcccaaagctgcgaaggcataattacatatttgtcatgattcctactttatacagtatcatctttgtggtgggaatatttggaaacagcttggtggtgatagtcatttacttttatatgaagctgcaagactgtggccagtgtttttcttttgaatttagcactngctgacttatgcctttttactgcactttgccactatgcgcgctgtctacacagctatgcgcaataccgctgcgccccttgtgncaaatntaccctatgctaagcattgctttcagcccagcgctcagttttcaancctgctacgcctagtgctgctttctacctcacgctgctctncagccattgcatcgcataccctgncctatttgcttcaccccaaatgcaagctcccgccctttcgcacgccacaaatgccttgctagcccaaagctcaccctgccatccatacattttgncctgcctncccangccttgncccagctttgcccagcctataaatcccatcncaaatgntattttttcattgcagaaacaccaaatatttacagntttgtgcttttccanttatgcagttccaaaaattcaacccntccgcatagggcctgggcctgaaccaaaaatatactggggtttcctgttttccttttctgcattattntta

SEQ ID NO: 639714 - DNA, 371 bp, Homo sapiens
accccacagactttggtttcccggtaatgctgcccggtgtgctcatgggtctacgccgcccgcatcgcctgctcggcactcgtttattgtcgtgaaccacgacggtctctgatcgtcttcgaccctcctactttcgttcttcattattgaacacattcttggcacatgctttcgctctgtctccgtcttgcgccgtgctccaagaatttcacctcttgcgtcgcaatacgaatgcccccggtccgttccctcattattcttgactgcagataacccaaaaccgaaaaaatagaaccgcggaccctattccattattcctagctgcggtatccaggcggctcgggcctgctattgaaacttctaaaactagg

SEQ ID NO: 639715 - DNA, 279 bp, Homo sapiens
cccctattaaattttttaatgaagattttttttttaattgggccttgtccttcctaggttttttattgagatgagaaagccccattatgttgcccttttcccccccccattaaatagttaaaaaggatgcagcctggagccaaaaagcaaaaagttggggtggttttgaagctttttccatacttaagttgcccccaaccagtttgtgaaagtatcagtttttggtttcctggggattgattcccctaatataaaaatttttgggtcatgaccctttta

SEQ ID NO: 639716 - DNA, 450 bp, Homo sapiens
ctattcgcagtgtaggtattccatcagctgcagcttcggccatcacacacatttccacggtatcattacggcgctttatagcagcatcatcagcatcggttgtgagaccttccatcatgtaagagcctcctctaggttcagccagtttggtaatcccagatttctattgaatgatgatctgcgtgttactgcctacttgagcactgttcgcagttagcgcactccaaagcttcatctatagaattggtgttctctgtctgagtccctcctaatgctgctgccattgattctatatgcagtacgattccataatactgtagggctcatgctcagtaagtgaccatccacatgtgcaacagtgtgctattataattatagatactaagtcgtgaggctcatacacactctagattaagtgagcccagagtcttctaacagctctcatctgag

SEQ ID NO: 639717 - DNA, 1498 bp, Homo sapiens
  misc_feature (16)..(16): n is a, c, g, or t
  misc_feature (91)..(91): n is a, c, g, or t
  misc_feature (104)..(104): n is a, c, g, or t
  misc_feature (109)..(109): n is a, c, g, or t
  misc_feature (119)..(119): n is a, c, g, or t
  misc_feature (136)..(136): n is a, c, g, or t
  misc_feature (139)..(139): n is a, c, g, or t
  misc_feature (148)..(148): n is a, c, g, or t
  misc_feature (156)..(156): n is a, c, g, or t
  misc_feature (196)..(197): n is a, c, g, or t
  misc_feature (211)..(211): n is a, c, g, or t
  misc_feature (246)..(246): n is a, c, g, or t
  misc_feature (263)..(263): n is a, c, g, or t
  misc_feature (315)..(315): n is a, c, g, or t
  misc_feature (334)..(334): n is a, c, g, or t
  misc_feature (386)..(386): n is a, c, g, or t
  misc_feature (443)..(443): n is a, c, g, or t
  misc_feature (484)..(484): n is a, c, g, or t
  misc_feature (492)..(492): n is a, c, g, or t
  misc_feature (502)..(502): n is a, c, g, or t
  misc_feature (511)..(511): n is a, c, g, or t
  misc_feature (514)..(514): n is a, c, g, or t
  misc_feature (543)..(543): n is a, c, g, or t
  misc_feature (711)..(711): n is a, c, g, or t
  misc_feature (751)..(751): n is a, c, g, or t
  misc_feature (754)..(754): n is a, c, g, or t
  misc_feature (782)..(783): n is a, c, g, or t
  misc_feature (788)..(788): n is a, c, g, or t
  misc_feature (792)..(792): n is a, c, g, or t
  misc_feature (799)..(800): n is a, c, g, or t
  misc_feature (840)..(840): n is a, c, g, or t
  misc_feature (843)..(843): n is a, c, g, or t
  misc_feature (845)..(845): n is a, c, g, or t
atttacttcttctggnacggaaccttgtacctggagaccatttacttctgccatgaccacttcgggtggtacctgggctggggccactgtntctggctgccttntcttnacacgctgcngggtctgtacttgtgtnccnccccgtgcngctgtccnccccggcccccgtggcgtcctgctgctgggcctggtggcnnccacatcttccggnaaaaaaccaccagaaggacctgttccgccgcacgnatgggggctgcctcatntggggcaggaagcccaaggtcatcgagtgctcctacacatccgccgacgggnagaggcaccacagcaagcngctggtttcgggcttttggggcgtggcccgccacttcaactacgtcggcganctaatgggcaacctggcctactacctggcatgtggcggtggccacctgctgcccaanttctacatcatctacatggccatcctgctgacccaccgctncctccggnacgagcaccntgcgccagnaanaacggccggaactgggagcgctacaccgncgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcanttggcaggtgtccagtacctaatcacgctctgttccttgnttntgccttcaagggaattccgagtgtccannactgncgantgccagnncagacggattttctctaatcagtgtccctggggcaggagnatnanccagtcacctttactagtcctgtggagacaatttacctgtattaggagcccaggccacgctagactctgcccacactggtgagcaggaggtcttcccacgccctgtcattaggctgcatttactctctgctaaaattataaagtgggagtggggcgtgcgcgtatccatgtattgcctttcaggtctagatccccctcccctggctgctctgcagtcgtgggtggggcccgtgcgcgtttctccttgggtagcgtgcacggtgttgagctgggacactggggagaaaggggcttccatgtcgtttccttcctgctcctgtgcacagctgcaggagtgctctgctggagtctgagactcagagaggtcacagcactggctgtggctttcagtgtaggcaggtgggctctgttcccgattcctgtgaggccagcctctcgaagatttactgttgcctgtgatgtgagatcctggtcgagcaaccgggaatcacctcgggctccaaactctcagggagagttcagccagctggaaggacccctttagggttgccgaggttttcccaccaggggtgacatttaccaggcaacaacttataaccggaaaaaaaacggtttggggaagaagagtcatccatgagaagcttatagaaata

SEQ ID NO: 639718 - DNA, 104 bp, Homo sapiens
aagtattgagtctgaatgtcgggcggagtagcgtatgatgggcagtgaggggtgcgatatgatctaggctattatattcggagtatagtagcggtaagttaaaa

SEQ ID NO: 639719 - DNA, 236 bp, Homo sapiens
tgtaggtcgaattagagtatcccgaatcgatcacattcttccttcgccgttgacgaagatcagtgccacgccggtagattcgccagcgatagtgctgaccggctcgacttcgatattatctgcttaccagtttgcttacgggatacgctcatcctgtgtcatcatgcgctcggtacaggcatataagtgcgatgctgtgcaccgctgtcgcccggcgtgctaccgcgctggtgtcg

SEQ ID NO: 639720 - DNA, 326 bp, Homo sapiens
catcatacctgtcatgccattatgtatgtcttactacgcgagaaatgtctattcaaatcttttattaattttaaattggattattagatttatttcctattgagttgtatgagactccttatatttttttgtgaattatactttgtcagatggaaaacttgcagatatatattattcttccactctgtaggttgtctcttcactttgtagattgtttcctttgctgtgtagaagcgtattaacttgatgtgatcccatttgtccatttatgctttggttccctgtgcttgtagggtattactcgagaaatctttacccagtgcaat

SEQ ID NO: 639721 - DNA, 264 bp, Homo sapiens
  misc_feature (1)..(1): n is a, c, g, or t
nggagataccttaagcctggctgttgtgggcgggcagcacagagccatatttctcttctttcaaaagaaaataggagacatattgctgaattctttttctcagcaaggaacaagcctgaggaagagaatgcgctcctaggggtaggcctctaaacctggcttgctctggggggaccggaatgtccttttacacgttgtagataagggatgacataagccccggactcctgttgtgctccctaagccctactccctaagaacctt

SEQ ID NO: 639722 - DNA, 105 bp, Homo sapiens
  misc_feature (30)..(30): n is a, c, g, or t
gggaattgggaactgtaatgagatctcttngaacagaattcccacagaaggcagagttacaggacatgatttaatgaagtagatgcttgattggtaattggcaca

SEQ ID NO: 639723 - DNA, 1417 bp, Homo sapiens
cactcaggctgacccagtgcattacctgttcctacacaggcaagctcagcgactgctctactccgcgtggagcggggcttcatctatcgtccacaatgccacctgtgcacatccggctttcgactgaagatctcctttgtcaactttgctcgtggtaccactactactcgttcctttgactccgacattgatgacccaatgccacgcggcactccacgctatacccttcagccacgcatccgcacgcagcgcgagcgacgctccggcgcaaacctgctctctgactctcgctcacacgcctacccaacacgctcaaccatcaacaacacccgacggcatcgcacaacgacggcgcactgaaaccccaacgcctaccgcatgcacactcatgcctgcacctctgcactgcaccgcaccccaagcactgcactcgccctaacctctggacccaggcgcactgcacacgggcaccgacacgcgccaccgaatcccgagcgcacccaagcacatcgcccaacctgaaccacgcccagccgcactgcaccccgcacgcgcagcaaagcaaacaccccgactgccacgctcaatcccagacccccaacgcgctgcaaccgcaggcacggccaacgactgctgcgccaccagccgaacccccgcacaagcccaaaccgtccccttcttgccccagcccatcccatccccagcatcacattgcacgcggactgcaacaaggctgaaccccgccgccactgcaccaaccgcaacacccgcgcacacaccagccttcacacaacaacgcccccaacgaattggcgcccgaaacgcgacctcgccaacagcgacgcccgccaccgtcaagcgccccctggctgaccagcgattcatcaccaacgggcgaccacacgcacaccccacaactggccccccccaaacaaaggcccccatgcacctgccattaccactgcctggtccccatcacactggcccagcccggaccacacaacaaccaaacgtccagaacccaccccctgagccactcagcccaacacacgcggcatccttaccccaccccaatcgccccccctacccccttccaaaccccactgtccccccacaccaccaaccactatctcccccccctccctgccctaccccactcccctccccaccctcccccacaacccccctcaaccacctcctaccgcctccatcaccacctcccccatcctcacctccctcctcaccatccacccccccctcccctccctccacctcccctcacactctcatcatctcctcactcctaccactccccacccccccacttcccctctcaccctctgcactcttctcctccaccacacctccacatcactcccctcccccctccactcacccactacgctttcactctccc

SEQ ID NO: 639724 - DNA, 392 bp, Homo sapiens
ttccctgtgcttactgaaggctggtgctgtgttttgtcgggttaccatcgctcactgttatctcctttctgctccggtctcaggtcacatctagggacctttctatagttgagctggtagcgtgcggacgtggtatcggacgtctgtattcgacttcgtcgaacagcctgattcatgacaggggctttaaattgatgactaccttagatttatgaactaagagtcatacactatgaacttttgttcattggtgctcagtcctagacccttttcacctctctattctcttctggtgtcatctcatcctttcccatctttataccagtggcttccaatttatgtttttattgtagaattctcatctgagtgccactctcaaatacctggttacc

SEQ ID NO: 639725 - DNA, 659 bp, Homo sapiens
catctctacaaaaaataaaaaattaggccaggctcagtggctcatgcctgtaatcccagcacttctggaggcccaggcgagcggatcacctgaggtcaggagtttgagaccagcctggcgaacatggtgaaaccctgtctctactaaaaatacaaaaaaattagccaggtgtgatggcgtgtgcctgtaatcccagccagtcaggaggctgaggcaggagaatcgcctcagcctcagagctcgggaggtggaagttgcagtgagccaagattgcaccactgcattccagcctgggtgatagagcaagactctgtcttaaaaaaaaaaaacgtttgtcctaaatgccactggattatgggggttggttttcttgtcgtcgtacggttttttgttcttcgacgacagagtctttctgtccgctctgtcacccaggctggcagtgcacatggcatgatcataacccactatagcctgaaactcctgggcacaagtaatcctcccacctcagcctccaaagtgctgggattacagcgcatgagcgccattgcacccagcggccactgacttgttcattctcacaatggttaatcccggctggcgcacagagttccagtatggaatgatgatgacgtcctgcaggtggatgttggtgatgcttg

SEQ ID NO: 639726 - DNA, 292 bp, Homo sapiens
  misc_feature (224)..(225): n is a, c, g, or t
  misc_feature (277)..(277): n is a, c, g, or t
ggacttcgcgctcataattgtacaaccctatcagataggtactatttttaccacttacagaggagaaactgaggcacagaatttaagtgatttggccgggtgcggtggtcacacctgtaatcccagcactttggaggcaaggcgggtggatcatttgaggtcaggggttcgagaccagcctgggcaagatggccagacgccatctctaatttaaaaaaaagaannaacaagactcctatagtggtgaagaacagacattccgaaaacagactgtgcnttatgataccgcgaa

SEQ ID NO: 639727 - DNA, 908 bp, Homo sapiens
gggaggccgaggcgggcagatcacttgaagtcaggagttcaagaccagcctggccaacatggttgaaaccccgtctctactcaaaatacaaaaaaaatttagccgggcgtggtggcattcgcctctagtcccagccactcgggtggctgaggcaggagaattgcttgaacctgggaggtggaagcggtttcattgagcccagatggcacctctgcagtgcagcgtgggccacagagtcagaccctgtgtctcaaaaaataaaaaagaaaagaatttattcttactaaaattagtaaacctaatcattaataagtgaaattgatctagtaaataattgatcagaggcatgtggtactaagcttttaaggagtgatgagactatcatagacattctacttaactaatactttcgattaggggttagtaactgtggctgtggaccaaatccagcctgctgcctgtttttgtaaataaagctttgttggaatgcagccatactcatttatgtaagtgtctatggctactttctcactataggcaaagttgatagttttgacagactgtagggtccacaaaggcctgaaataatttactatctggtcctgtacaggagataaatgtgtgacccatgtgtacagatttgagacttatacattgtaagatcagaggtaccggaaggtggttcatgagggtgcaataaattccaaggaaaagtaggatgtcacgtcagttttaaaacatacgaagggtgccaaggtaatgtggttaggaatcttaaaggaaggaaagtgttagtcatagcaaaagaggagacgcatgtcaagatcgacaaagatgatgcttaattaaggcagactggtgaatagaagattcatgagcttagagagaccaagatgggaaacatgacg

SEQ ID NO: 639728 - DNA, 871 bp, Homo sapiens
cctccactacctcactggtcccccaaaaagagccctctcttatttccgcggcgttaatatattccctcccttgttgatttcttcccctcccggagaaagttttctttcttttcttttcccacacagggagttttttttttggaggtgccccctttcttaccacacacatgtccgccaccgcttttggcccgctttttcccccccccctcttttttagggagggggcagcccccttgggcgcgcccccctacatcagcagagtgtgattcttacccccgccggttattatcaccccccccttagagagagtctgcgccacacccctctttcagcagaacaccccgcgcgtcattatttacgtcgccgcatcacgcggggggtttctcacttacccctgcggggtctcacccctatgtttgttgttggatgtgtgtagaacgcacacctcgctagacctcccacacatatatattgcacataaaccacctgctgtctcttttacacatctttttcgtggcggtgtttttttttttctgtatcccccctcttacacttgcccttgccggggtggctctctggtagttctcctctctccaccattttcccggccggcgatgttactggcggccggtacacattgtttgttgtgcgcacgcgaggcttccccggacgttcctccgtcttaattttggctgtcccatcttcttccccaatttgctgtcgatcatcccaccgtattttttcctcccttctcaacagcgcacaccatctcactgtgggcttctggcagacccccccccgtaatatggccttttttaaatattggttttttatttttttttttttcccatttttgagagaggggttttta

SEQ ID NO: 639729 - DNA, 391 bp, Homo sapiens
  misc_feature (213)..(213): n is a, c, g, or t
gaagccccccctgggccatgttcctgaataactggttcctcctgctttccgggggctgggacgccctcccaaaaaggggaaaaagctgttttccttttgtaggaaggccaaaagagcaaagtcccagaaccccctgggcaggtttaagcccaaaggaaagaaatttagacccccagcccagccctccttaggttggtggggcctttttggagntgagcacattgtggggcacagggttaccccctttgtgggcaggggagggtttgggggtttttgcccagcctgaacagacagttttggggccggcaggggtgggccctttaggtccttgggccttccaaggggggtttttgccccttggcaacaaaataaaaatttttggtgcccccga

SEQ ID NO: 639730 - DNA, 517 bp, Homo sapiens
  misc_feature (517)..(517): n is a, c, g, or t
tccatttaaaagcctgttattgtgcaaaagtttctctatagatttattttaagccatggatacaaaaaataaacggtggaaacttacaaaaaggaatatttgcggcacttcgaattttgcaccaggagcttattcttagccttcatactactttggaacacatgtttaccatataccgcagcctttgattgattactctaggctcgctaatactataaagcaattaaccatgccttgaactataagacacatgtcgtaacatgacactttaactctgggagctcaaggcctaggattatgcccgtgattactcaacggctcttttacaacacacggcaaggctatagctactgttgagagatctgaaaaggtgaggatttctgctagctcttttggggcccaggcggctaggatcttatgtattactcagagcagccatagtcctgttcatcttttttgacgataaccagacctgagaccgctcatataccttccacgaatgaaccgccaactgatn

SEQ ID NO: 639731 - DNA, 202 bp, Homo sapiens
ttagtgatatgaaacagtcctatgtggatggcagtagatacacaaattccacacattatgatgaaatagaactatacacattgcttggtatccgtggcaaaaatcccttggtttcctggcattggatagttccattagatgtgtataagttacccattgggcaaggaaatttaaaggaccacatgtgcattccatgtgttgg

SEQ ID NO: 639732 - DNA, 421 bp, Homo sapiens
  misc_feature (8)..(8): n is a, c, g, or t
  misc_feature (17)..(17): n is a, c, g, or t
  misc_feature (35)..(35): n is a, c, g, or t
  misc_feature (43)..(43): n is a, c, g, or t
  misc_feature (200)..(200): n is a, c, g, or t
  misc_feature (256)..(256): n is a, c, g, or t
  misc_feature (316)..(316): n is a, c, g, or t
  misc_feature (347)..(347): n is a, c, g, or t
  misc_feature (419)..(419): n is a, c, g, or t
aaaaattnggggaaccnggtaccccctaaaaagtngccctaancctgtagttaccttttaaaaagtatattaagaatattcaaataaaaatgtgttatgctgaaacaaaaagacacatgaaactgccttgaaaacttccattgatatggttaggctttatgtctccaccccacatctcatcttgaattataattcgcagntgttgagggaaagacctggtgggaggtgattggattcatgggggcagtttcccccntgctgttctcatgatagtgagttctcacgagatctgatggttttataagcatctggtatntcccttgcttgcacttctctctcttgctgcnatgtaaagaaggtccttgcttcccctttgccttccatcatgactaagtttcctgaggcctccccagccatgnca

SEQ ID NO: 639733 - DNA, 431 bp, Homo sapiens
gggcgggtcagaaaacacagaaatgctaacttacatttgcttagtttattaataaaggatatcataaaggatacagaagaaccagccagatggagagattcaaggaacgtgggagggggcacggagctttcatgccctctccaggcacgctaccctccaggaacctccaaacggttcagctgtctggaagctctctgaaccttgtcattttggagttttatggaagcttttttatgcagtcatgattgattacatcaccagcccttggtgatcagcttaaccttcagcttcggtctcctccctggagggatggtgtcccaccccgctaatcctgccttggtctttctggtgaccagccccttttctgaagccatctaaggcccccagccgccactcatctcattagcaaacaaaagataccacggctcaaa

SEQ ID NO: 639734 - DNA, 320 bp, Homo sapiens
  misc_feature (1)..(1): n is a, c, g, or t
ncttggcggaacttattttattttctacaaaggcgtgaccatttaatagaaatgattgattatataaaattgtttacacatgtataaaaactaggaacacgtatgtaggtaacgcaatcaaaatcatgctttctgttagaaaagctaacaccttctgcgaatagactgcatgacttcctttcaccccggatgcctgcgccggaccccggagacgctgaagaaaggaaaaaattcttctccgccgctccccccctccctcgcggggacgtgtctggatacccatcttctcccctctccgtccccctcttctctctcttcct

SEQ ID NO: 639735 - DNA, 431 bp, Homo sapiens
tcctaacccaaaaaaataattttattccaaaataacaaaataaataatctactgtccccaatctgaaaaaaaagaccctttaactgctaaaataggtgctgcggtccaacccccagttggaggaaaccctgagtccaacccaggccttccgagggggccagtgaagggatcccacacccaccgcccttatgtagggcggggaaaaaatggcaaaggacttgggggataaatgggaatgggagggcaaactgtaacacttgttaaattaattaaagaaacacaccagatgcacaaaaacggggaaggtgaggggataaggatcagttcctgtgttccctggcccccaattgtggtggcaaaatgtcgctacttaaactggactctccccgggaagcccactttttggccttgtagaaaataaggcctactgt

SEQ ID NO: 639736 - DNA, 433 bp, Homo sapiens
  misc_feature (433)..(433): n is a, c, g, or t
ggcgatctagaggatccctgcaggaagagagaactgaaaaacatagcacgagaaatcagagaagcatacagaagtatcaatagctcaatcgatcaagcggaagaaaggataccacagattgaagatcaccttgctgaaataaggtgtgaagacaagattagagaaaaaagaatgaaaaggaatgaacaaagcctccaagaaatatgggactatgtgaaaagaccaaacctacaattgattagtgtaactgaaagtgacggggagaatggaaccaagttggaaaacacacttcagagagacgtgaactctcaggagaacttcctcaacctagttcaggaaaacctccccaacctagtaagacaggccaacattcccattcaggaaatacacagaccaccactaagatactccatgagaagatcaaccccaagan

SEQ ID NO: 639737 - DNA, 184 bp, Homo sapiens
atcgccaggagggggtagagggtagaagcagcggtccagctgtgaagtagcttgggcaggagaggggatacttccacgtggtgatactagtagtacacacaggggggcctacctaagagcctagagacggggctagggccagccttcagcttctatggtagctgaagggacctagctacgtagg

SEQ ID NO: 639738 - DNA, 769 bp, Homo sapiens
  misc_feature (129)..(129): n is a, c, g, or t
actataggcgcacacccccacacccagctaatttttttatgtttttgtaaagacggggtttcgctgtgttccccaagctggtcgcttgaactcctaggttcaaacgatccacctgcctctgcctcccangatgctgggattacagagagccacggtgcctggcccaacattacttttaaaattaattctctagtttgacttcacatttagttcttcagtccaactggagttcacatttgtaattaatgttaggtagaaatctggttttatcttctccagatgtagcagattttatgtgcatcagtttctgccttcactgttggattttttgggggaaagcaaagtgattataattttaaccttggtaagtgatcaagatggtttcgtagcagggcttgacctgaatattttaatattctttagctgaagaggaggcaaatgaagaagatgtactgggagatgaaacagaggaagaagaaacaaagcccattgagctccctgtcaaagaggaagaaccccctgaaaaaactgttgatgtgtaattatcccttttttataatctgagtacagagcaggcagctcttttcttaatgtatttaatgtttaacctttgttttacctcttacatgttcccattggccttttccttttctgattagggtcatctttgtttcagaagggactacttcaaagtacttggtccagtgaagttaaagcaaatggtctctgagtatgtaattaggtaatgagggccaggtgattccagaaa

SEQ ID NO: 639739 - DNA, 1096 bp, Homo sapiens
  misc_feature (14)..(14): n is a, c, g, or t
  misc_feature (476)..(476): n is a, c, g, or t
acgaatggcaggangaggcgggggttaatcggccgaggggggtacaagatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctagggtttgggatttcttcagttccaacaaaaggtctgtcatctgataacaaanctatggttaacttggataagctgaaggaaagagctcaaagattcggtttgaatgtctcttcaatctccagaaagtctgaagatgatgagaaactgacgaaagaggaaggagcgatctgggattgtcacaagttcagctggaactggaaccacagaggatacagagggcaaagaagcaggcaaacgagcagagcgctttgggattgcttgatgatcagtccctgatactgtctgttctccagtgatcccatgtctctccttcttctggtcacatatatgcgtaaatgcacagtcatgtgctacgtctggctccgcaaggagggaacattgaccccaggtacatccatgaaacgcgcggaacaagacgactatggaggtcaagataaaggaggaggaacagaggacggagaaaaggtacaaggtcactaaaaacagacaacacagagggcggggcactacagaaagacccaaggggaccaagatcagatcaccaatctgacaacagggtcacagagagagacaaaagacaacagcacacctaaaacgacgatagaaaggagacgaggaaacaacccaggaactgagcagacaaaaaacaaacgaatacaaaagagtgcaacc

SEQ ID NO: 639740 - DNA, 455 bp, Homo sapiens
atccccggctatcacattatctagcacccatcacactgtagtacactgcaaacgtacagtgacaattcgtctacacagaactatattcgatatatcttgaactgccgagagaaatcaagacaattccaaaaagtgattgcagggttgatttttttctccgaaacacttgagaaacagtacagctatttcaacaaaagtctggtcttggattgtcaagagttgaaattcacatttcaattaaaagagatccaaatcaagatcctcactaccccctacccctcaactatgccccctttagggccacagttttcttcttgctcctgagataaaaatttggaatttcgaatattctcggggatctgtgcacaccttgaattgggcaaatgtgttcagctcagccagcattttctgtagacctcatcaatagcaggcacttagggtgataatgtgactag

SEQ ID NO: 639741 - DNA, 1105 bp, Homo sapiens
  misc_feature (485)..(485): n is a, c, g, or t
gaggaccacagatgatgtatgagctgcggcccggttggtaattttcgtcacaggacgatggcgaccgagacggtggagctccataagctaaagcttgccgaactaaagcaagaatgtcttgctcgtggtttggagaccaagggaataaagcaagatcttatccacagactccaggcatatcttgaagaacatgctgaagaggaggcaaatgaagaagatgtactgggagatgaaacagaggaagaagaaacaaagcccattgagctccctgtcaaagaggaagaaccccctgaaaaaactgttgatgtggcagcagagaagaaagtggtgaaaattacatctgaaataccacagactgagagaatgcagaagagggctgaacgattcaatgtacctgtgagcttggagagtaagaaagctgctcgggcagctagggtttgggatttcttcagttccaacaaaaggtctgtcatctgataacaaanctatggttaacttggataagctgaaggaaagagctcaaagattcggtttgaatgtctcttcaatctccagaaagtctgaagatgatgagaaactgacgaaagaggaaggagcgatctgggattgtcacaagttcagctggaactggaaccacagaggatacagagggcaaagaagcaggcaaacgagcagagcgctttgggattgcttgatgatcagtccctgatactgtctgttctccagtgatcccatgtctctccttcttctggtcacatatatgcgtaaatgcacagtcatgtgctacgtctggctccgcaaggagggaacattgaccccaggtacatccatgaaacgcgcggaacaagacgactatggaggtcaagataaaggaggaggaacagaggacggagaaaaggtacaaggtcactaaaaacagacaacacagagggcggggcactacagaaagacccaaggggaccaagatcagatcaccaatctgacaacagggtcacagagagagacaaaagacaacagcacacctaaaacgacgatagaaaggagacgaggaaacaacccaggaactgagcagacaaaaaacaaacgaatacaaaagagtgcaacc

SEQ ID NO: 639742 - DNA, 201 bp, Homo sapiens
ttgaaaaacaccaatatcatgaccattaatcataatggaacatcatttagaagactggagattgatatgtttttattactcagaaatttgagggatgtgaattaaacatagcatcattcatcaaatcaaattggtaattcttagcttttgtaaattgatggttcagttccattcttaagagcatattttctagagtagccc

SEQ ID NO: 639743 - DNA, 145 bp, Homo sapiens
  misc_feature (71)..(71): n is a, c, g, or t
  misc_feature (97)..(97): n is a, c, g, or t
  misc_feature (110)..(110): n is a, c, g, or t
  misc_feature (128)..(128): n is a, c, g, or t
catgttttggatattaaccccttatcagacatatagtttgtcaaatatattctcccattgtcataggttgntctcttcactcagtttatgtttttanatcttttaatttntaggtttccactgtcatnttttttcatccctggga

SEQ ID NO: 639744 - DNA, 148 bp, Homo sapiens
gaccgcgcctcgagctgggcatacgagctagactccgtctcataaaaaactaagtctgccatggcaccccatagcatttagacacccagctattcacctactagtcccaactacacacctaccagttcttattggcccaggctgtagt

SEQ ID NO: 639745 - DNA, 226 bp, Homo sapiens
gcagcagacacgcagcacagacagacaggcaaaatgaggccactaaagaaagcactgtctggccagtgtgcggtgtgctcacacctgtaatcccagcactttgggaggccgaggtgggtggagcacctgaggtcaggagttcgagacgcagcctgaccaacaaggtgaaaccccgtctctactaaaaatacaagaattagccaggcgtggtaggagcctgtgcaag

SEQ ID NO: 639746 - DNA, 1070 bp, Homo sapiens
  misc_feature (1070)..(1070): n is a, c, g, or t
ggttgggagcggacgcgtcggacgtggggtggaggtgcgcggcagtaagagagtcgggacgcggggtgcccggcgcgtggtgggggtcccctggcgcctgcccccacggtgacccaagaagtgcctggccagggtaccctcctgcgggtagcccggtgggatggggtgtggcgcagtggcgccaggcggccgtggatgtggcccgggtggaccccacagcgggctggagctggtgtgccgtgccgcgacgggaccggatgctcgccttgatggggtcggctgggtagagctaacgtcgcgtggggcccaagtatcctcgaacgtgtaccatgtggcgacggttccaggtgctagtgttcagcatatctcagtggagtggcatctagccctttgcaaacgtcggtattgccggccggccatagcatagggctcgccggacggggaagcaggggggacttggccttggcttgcgttgccttgtgggcccaaggggtggggccgatcggggggttttgttggtccaaaacacggtcgttcggtatgggggctttacggatgagcgcctgagcgctagcagcccgggcgagaggcgttagccttgcagcacgccggcgatatgctagggctcctagttggccagagtgggccgtaggggaatcctttggtgttccagaggcgagccccggatcgttgacggttcgctgtggccttggtacccgttttcccggcccgttttccgagtcgtattcaggagccactcttgccctttgggcgcctaaggtcggaggggcacgtaggccagccgtaccacccgtagaaaggtaaggggggcattggccacaatttcgctttctataaagttaccagggggccgcgggtgtcgatttcggatagagaatcttttacccaagggatttgaggggcattggggtggacgtatccatgaaacacaagaagttcataccgcagagggcatccaagggcccttcaagatcccctcgggaagaggccttcgaggtcaagagcgcaaaatcgggaagcccacattgagacgaagacgaggctcggan

SEQ ID NO: 639747 - DNA, 524 bp, Homo sapiens
agttcgaggagactctcccgcctcagctccgagtagctgggattacaggtgtgtgccaccatgcccggctaatttttgcatctctagcagagatggggtttcaccatgttggccaggttggtctcaaactcccgaccttgtgatccacccccctcagactcacaaatcgctgggattacaggtgtgagccaccgtgcccggccttatctttttttttctttgaagagacagagtcttgctctgtcacctaggctggagtgcagtggtgcaatcttagctctctgcagcttcaaactcctgggcttaagcaatcctcccgcctcagcctcccaagtagctggaactacagttgcgcctggctaatttttcttattttttggtcgagatgggatttcacagtttgtccagactgctctcgaactcctgggctcaagcaatcctcctgcctcgacttcccaaagtgctgggattacagccatgaagccactgcagccaggagttcgagagtctccgtcgaactgggt

SEQ ID NO: 639748 - DNA, 114 bp, Homo sapiens
tctctctcggggatcttcacagactagcccaagtatgaagtatcctaagtgtggccataatcatctaacaggatgtttatccggtttcagatctcggatagacggatgttctca

SEQ ID NO: 639749 - DNA, 323 bp, Homo sapiens
gtctatttctactcagaaaaaaattaagagtacatagatgctgggccaggcgcggtagctcacgcctataatcccatcctattgagaggctgaggcaggcagatctctttaggtcaggagttcaagaccagtctggccaatacaacgaaaccctatctttaccaaaaaaatacaaaaaattagctcaggatggtggcacatgcctggagtcctagctacttgggaggctgaggcctgagaacccaggaagcataggtttcagtgagccaagatcacacccctgcactccagcctgggcaccagtgagatcctgtttggaaaaa

SEQ ID NO: 639750 - DNA, 327 bp, Homo sapiens
gggtaaaaaaaaaggggggggggggccccccccccaaaaaaaacccattccggggtttggccgcccaaaaaaaaaaaatttaaatggccccggtttttttttggaaagggggaaccctcccattttttttaaccgggaaagaaggaaaaacaggggctttgggccttttaaaaaattggggttctttttttccccaaggtcaaccttttgccccgggggggtttttcaaaaggaccccggttctgggcccccccaagggtaaaaaaaacggggttttaagttttggggggcaaaaccaaaaggaaaaaactttaattgggcccccca

SEQ ID NO: 639751 - DNA, 798 bp, Homo sapiens
  misc_feature (509)..(510): n is a, c, g, or t
  misc_feature (512)..(512): n is a, c, g, or t
  misc_feature (514)..(514): n is a, c, g, or t
  misc_feature (532)..(532): n is a, c, g, or t
  misc_feature (542)..(542): n is a, c, g, or t
  misc_feature (544)..(544): n is a, c, g, or t
  misc_feature (546)..(546): n is a, c, g, or t
  misc_feature (579)..(579): n is a, c, g, or t
  misc_feature (618)..(618): n is a, c, g, or t
  misc_feature (641)..(641): n is a, c, g, or t
  misc_feature (680)..(680): n is a, c, g, or t
  misc_feature (684)..(684): n is a, c, g, or t
gcacagatggcccgagactcttcacgtttgaagttcgtgactgatgggaagtgaacgaggaaatggagttcccctcagttgatgaagatgcgcgacttggaagtatcaaaggcactaggacatgagtgtcgtggggccctatacatactacgatccaaagctcttctgatccggatcaccgagcggaggaatgatgatgaatgactcatctgacgggagtccatcaaagacgacagtgctgtcgcaacagcgtgtacatccagccaacagaacgacaccatgattcaataccgtcaaggcgggtgcctagaatactgcaggggaactgatggtatagccactgactgccatcctggccacgctgaatgaagcgtgtgcccggctcaggggtattcctgggatattgtcgtccagagagttgggtccaaactctatcttttgacgagagagaacaacatcatgaactgttgacctccatgacagtagagatgagactgccaatgagcccnntnangatgaaggtaattccttnaattcacccngnancctggccatggaggcaacctacatcaaccacantttctcccagcagtgcttgagaatggggaaggaaagatncaacttccccaaccaaaccgttngtggaggacgacatggataagaatgaaatcgcctctgtngcgnaccgttaccgcaggtggaagcttgaagatgatattgaccttattgtccgttgtgagcacaatgtcgtcttgactggagccaacggggaagtgtccttcatcaacatcaagacac

SEQ ID NO: 639752 - DNA, 232 bp, Homo sapiens
gttgccccccgtgggtttccaggcctgcccaaataatcccttcaggcctctgtccctgggggccatcctcaggcggattttgaccaccaaagaaagacttttcttacccccttcaaaataaatttttcagtgggccaaaaaggagagttaaaaaccctttttttaaagggggtaacatctgccccccaaagggaatgggtctgttttatgcaaaataaaagtttttccaata

SEQ ID NO: 639753 - DNA, 111 bp, Homo sapiens
gaaactagaaatctagatagcatataaagatcaagttgagaaatcacatttgtatttttattatatgagaccgggtttcgctcttatctcccagggcttcactgcctgacc

SEQ ID NO: 639754 - DNA, 1128 bp, Homo sapiens
taggaaattccccagaatttttttgcaacccgggggttaggcaaaaagcaaagcagtccctgccttttcttcagccgggcaggtcgtcctgaagctggtgggtggaatacgttcttcaggggttctcgtctcaaactctatttgccaaaggaaactgtgcctttatcaccttctgtgcttgcaggctttgaatgtgccccagaggagcccgaaacctcccaggcttggtgcaggaaggaagagcccttcagcgagaaagctacatttttacaccagggaactggtgctgcagcaaaatggtcggagtgtgagagtgtgagaaagcttggacaaggccggaaactttaccggttggttgcacattcgactggtgccaacctgtccgaccgtgcatgggtggagacacgcgcatctccaagggttccatttccaccgccgaaaggcagctcctatatacaagttcccgtgcgtgttctgaccaagaaggccgaaaagacagaagaaagacgaaggctcggggcccatatattaaggaagcaagccacgtagagcaggcagggagaatgcccagagcgcttggaacgcgaaaaacgcgacgcagacacaggcaaacctcaacaaagccccggtgattctgaggacacgggaagaaccaccgtgcgatgaaccgggagaatacacaaaggagtccacagagaatgtcgtggagaacccgcgacacccaagataatggaagaaactcgtggacgtggacaaaacttggcgccattagaagatttggcccagatagaccaccccttgttgagaggggcccctgaaatggcccccccgacaggagagaagaatatcatgaattagcgccaacaaacgttgcgataacgtcgggaccaaatgcggtaccccggggcccacggagtgtagggagaaaaagagtaggaagaatcacaccacgtggccgaaaaaaacacagtagtcactccaaacacatgtggaagcacaccggggacaacaaacagaggcatccgtgccaacaccacacgcgacgcgtggggaaccccattaacaaccggtgctatcgaacacacctggggtgagagtgccaagcctaaacacccggggaaaagcgca

SEQ ID NO: 639755 - DNA, 121 bp, Homo sapiens
tgactccggggcccaggaacttcccggaaggagtcttgacactcaactccgccccatacccaaggaacgacagcggctcccggagcctgccaccctgggcttctcgggacgggggcagggg

SEQ ID NO: 639756 - DNA, 107 bp, Homo sapiens
tcccaagaatgagaaactgatactttttatttatttatttttttaaaagagatagagtccaattcctcatcctttcacatcacatgtctatcctaaatctatacatt

SEQ ID NO: 639757 - DNA, 268 bp, Homo sapiens
atgatgacacacacggtgtatcttctgatggttctgggcaaagtctactgaaaaccttctggtaaggttcatcatttctagatcctttaaagaatcatctgtaattcatatgaagtctaatttatccacattcaacaggagttcgggagaagctgattcaatccttcatggataaaccccgttgtagtggttctcaagatttctgtgggaggaaatcactgcatatctggaaatacctagaccactagaatgagcacagtggagcgtg

SEQ ID NO: 639758 - DNA, 111 bp, Homo sapiens
agcctttaaaaaaactaatggggggtaaaccctaatgccatgtgaaataattttagtgttgaaaccggatggggattttttttttaataaacctttgtggtcccgatttga

SEQ ID NO: 639759 - DNA, 855 bp, Homo sapiens
ctgttacagtgcgaattaccccagcggctcctagaaatggcatgtggagacccccagccaaactgtgaaggaggctgccctcattgccctccggatgcctgtcaactaggagcctaggtcgatccactcagtgtacgtggtgtcccgtgggttgccagtgagaaactatccttgctctctctggggaatcagtcactgccacactagctagtcgctagagccgtgccttctgccaaacgactgcaggaaactcattcacctccgtgaggccatgcccatatcatgtgattccacgattcctgctggtccagtcctccaagctttggttgccatgttctttcttacttctagcgtacacaagccgccaactcaactgaggagctaatagagagctagaaggagaagataaggctgccaactcagagctgagaacaagagactagcaggagatttagtatataaagcattcgttccttctcccagatgcgggatgttctcaaccagtaaatgtgattgctgtcggtgccagagtaagagtcctttctatctctacatccagggcctttactccaatagatgtgcctttaaactctagggacctgtctcacggagccttagggaaaaatgctcaacctgcaaagatctcttcctttctggagctcctttaatcttcccagcaggtttatgccttagacgtgctggccccaggacagtgatgaagacagagcctgtctcagctctaggctgtggggatcattgccatcagtccctgttattgagggattatcccttagccaacgattcctatctgtgggtgggcgtgcaagtgtctcttttatggggtgtgtgtgtata

SEQ ID NO: 639760 - DNA, 87 bp, Homo sapiens
aaaaagttaaaattgtttttaccaaaagtttatgtggggcttgattcccccttcatccattgggtggaaaatggattggggatttga

SEQ ID NO: 639761 - DNA, 119 bp, Homo sapiens
gctcgagtttgtatctctcgagtgtctctcgttcccttgtgtgaaattgtgctccggaaataatcatatctgatatcttcttcgaaatcacacttatccccaccttggtccttatcgag

SEQ ID NO: 639762 - DNA, 595 bp, Homo sapiens
tgttccgaggtgacacagtgttgctgaatggaaagatgagacgagaagctgtttgcactcgtcgctttctgatgatacttgtactgatgagaagattcggagtgaagtagacgttgttcgtgaataagccttcgtgatacgcctagagggatgtcatcaagcagtccgaggccagtgcgccatagatgtggaagtactggcagaacgtctccatgtgcgtgcccattgatgacacagtggaaggcattcactggtaatctcttcgaggtataccttaatgccgtacttcctggaagcgtatcgacccatccggaaaggagacattttacttgtccgtggctgggatgcgtgctgtggagtacaaagtggtggaaacagatcctagcccttattgcattgttgctccagacacagtgatccactgcgaaggggagcctatcaaacgagaggatgaggaacgagtccttgaactgaagtagggtatgatgacattcggtggctgcaggaagcagctagctcagataaaggacgctggtggaactgcccctgagacatgctgccctctttaaagggccacattgggtggttgaaagcc

SEQ ID NO: 639763 - DNA, 831 bp, Homo sapiens
  misc_feature (238)..(238): n is a, c, g, or t
cccgggggccgactctatgggagggccgccccactctataggggaaatagggaacatacccctcccatttatacacagggccccgcaaaagagttttcgggccccaaagggagtccctcacaggagtccacgggattattctaccctcgagagctctcttgggtctcacagatgtaataacacgcgttttcttgggccccggaagtgacccccaaactgtcgcaccaaatgttcaganaccacggtctttcgtttgaaaagaaggttgttttaatgaggtttcgccaccccataccggccgcccttctctgtgccccctctttcccgcgagtgagtttcccgcgagaagattgaaggcttttcctcggccgccggagaaacccatgatcggccgctggtttgttgggggaaccactataactgaatgaatgttgcgcggttcacagcgagggtataccccacacctgaaagggtaatgttgcacctgcgcgtgtagaccacaaccgggcccgccaacccgcatctcctccagaggccagaggggccaaaataccctccacatttctgacccagacgtggcccctggacatccccctaagaggcctgtggccacatgtccctgctcttctccggtcctctgcaagaggccggagaggtgtaccggcaattcggcaaggcccccagggaccccgcacagccaccacccaaaccctacgtccgctccaagggcccggaagttcgagcgtgcccgaggcccgaccgggccaaccgaggcgtaccaaaaactaaacctggatcctacttttttatttaaaagatttttgctgacca

SEQ ID NO: 639764 - DNA, 315 bp, Homo sapiens
tcgctctgtaaccgaagacgtaatattttaatctttaaactttaccatcaaatctccttttaaagtgaattataaaactctcctttggtgtacctattggatggcacttttatagccaggtttaataggttaaggaaaaatacagtttcttagtcttcatgtcaactgaagatcaatttctttaagttccaaattataacgatatgacagaaaggctgtagatgaagtttattagggaaaatcacattcaaatagaatagggattacaaaaaaaatcagcgtaatgtgataggtatcaattggtcctgggcgatg

SEQ ID NO: 639765 - DNA, 341 bp, Homo sapiens
  misc_feature (29)..(29): n is a, c, g, or t
  misc_feature (44)..(44): n is a, c, g, or t
  misc_feature (56)..(56): n is a, c, g, or t
  misc_feature (123)..(123): n is a, c, g, or t
  misc_feature (126)..(126): n is a, c, g, or t
  misc_feature (131)..(131): n is a, c, g, or t
  misc_feature (139)..(139): n is a, c, g, or t
  misc_feature (147)..(147): n is a, c, g, or t
  misc_feature (149)..(149): n is a, c, g, or t
  misc_feature (156)..(156): n is a, c, g, or t
  misc_feature (159)..(159): n is a, c, g, or t
  misc_feature (179)..(179): n is a, c, g, or t
  misc_feature (190)..(190): n is a, c, g, or t
  misc_feature (206)..(206): n is a, c, g, or t
  misc_feature (228)..(229): n is a, c, g, or t
  misc_feature (238)..(238): n is a, c, g, or t
  misc_feature (241)..(242): n is a, c, g, or t
  misc_feature (248)..(248): n is a, c, g, or t
  misc_feature (264)..(264): n is a, c, g, or t
  misc_feature (266)..(266): n is a, c, g, or t
  misc_feature (272)..(272): n is a, c, g, or t
  misc_feature (293)..(294): n is a, c, g, or t
  misc_feature (302)..(302): n is a, c, g, or t
  misc_feature (304)..(304): n is a, c, g, or t
  misc_feature (335)..(335): n is a, c, g, or t
ggtacggtggggagggatggaggaaggtnagtttcagagcccgnaggacatggctnccggggagaaggattatgaggaggttggtgtggattcggttgaaggagagggtgaggaagaaggagnggnatacnaaagttanaacgtcgngnaggtgcngcntttacggggaagcgtattcngttttaaacgntgaaaagttgtggtcngatcggttaatttgtatgtagnngtgtatgcncgnntatacnattactgaccgatgcncnaaaacntgaatgctttgttacagaccnnagctgtcngnttctgtgatgggttttgaataaagtattccnggtcgt

SEQ ID NO: 639766 - DNA, 100 bp, Homo sapiens
aaggagagtaaaataattaatgagtcaaggtctcaggagagacagaaggctgtactaaagggagcacattgttgagaaggaccggttgcaaatttccaaa

SEQ ID NO: 639767 - DNA, 516 bp, Homo sapiens
ttcaggaacgcttccttcaccacttttcctggtacgctagtatttctcaaggagcagtaagagggctagtgagattgtcaccattatcacccacctcccaaatcagggctttttgacctcgaaagggtctgagattcggactctgtcggtctggtctgggaatctacactctaagttaaagtgtcccaatggattctgctgcaggggtccctgtttgacttgattccttcttcctgctcgcccctagcctgtttccctaccaccagccctgttcagtgaaagaagaacttgctttcttcataggtagagtaataaagatcagtattgttataactgaggcatgcgcggtgctctacaatttgcaaatcccttttatattgatgtatgggtcaacaaacatttattgagtgcccatacatgcctgtccctgtgctagaccctgaatgtggctgcaatttgtcctaaaaatgttcacacttaaataaaatatacttacaattgaaaaagtaaaaaaaa

SEQ ID NO: 639768 - DNA, 923 bp, Homo sapiens
tgcagctggtggtggtcaatcgtctgaccgaagaactcggctgtgatgagataattgcagtagagagtagcttagagtgctgttaagagagagggggagaactacttgaggagggacccaacgtttccgtatatcttatgggttcgagtacgaaatagttatggtgccatggatagagaacttgaccctatcattggaaaatttgttgttcacgaagtagaatcgacaataggagagtgtactgcagcagctgtgcaatcaatggaagagaaatgcagttcacaaggaaaaagacacataagagatatttgatgactcgtgtgaaatcaggttgattgaagaacgtgctaataacagctatgggttttgtactttggggaattggagtccagattgattttccgtatggcaatggaggaaaatatctttcatatcttgtttggggtgtacaaagatggttatgcaagagtaagtgcatgatcaatgaaacaaaactgcaattataaaaagcgcactgatactaatgatataatgagaaagcgaaatgtgtaccaaggtaggagacctatctttatgagttattggagctgaaaggtgaagacggaattggagaactctatggagtgattctagtatcaaggcacaagtgatcaaggtacatgatgagtgtacgataaagcgtggagtaaagtccaactatgtttccgtgtgccaagtatatgaagaactgtccaagagcatcggcacatttgggtgtcctgatcctgataagataacaggcctgggatctttagatcagaaaatccctgccataccatgttaaagggagaacaagaggaaaaaagggcgccgtcggcctagactacacaacgggcgggcaggagaaaaaggacagtaagggagggaaggttacaaaggggcgg

SEQ ID NO: 639769 - DNA, 168 bp, Homo sapiens
tatctgaggatcctcggctcccaggggcagtcaggcggctcttcaggagtgacgtccgggacctctccccaggccctgttcatgctgtctcggcctgtctgaggagcagttctcccgccctgtgggtttgttcctgggctctgacgtccagtcgtttcgcgtggcgtt

SEQ ID NO: 639770 - DNA, 325 bp, Homo sapiens
gattaaagagacgagatgggaaagttgctgagaacataaaagcctagaactttaggctagatacaaaattcacacagtgtaaaggcacggactctgggtgagactgggaagtgtcctcagccattcagcaccatgcgtgacgagctccgccccatggtgcccgtcaccccgcacaggatatgcctcacaaactgcttcatatgttgatacaacccattgcatgtcctcactgcccatgccaccatgcatctctgtctcattctacttgaggggatccatctatgagtcagaccatgcagtgcactgcaatgcttgtgcacttggc

SEQ ID NO: 639771 - DNA, 365 bp, Homo sapiens
  misc_feature (17)..(17): n is a, c, g, or t
  misc_feature (35)..(35): n is a, c, g, or t
  misc_feature (80)..(80): n is a, c, g, or t
  misc_feature (234)..(234): n is a, c, g, or t
  misc_feature (244)..(244): n is a, c, g, or t
  misc_feature (257)..(257): n is a, c, g, or t
  misc_feature (299)..(299): n is a, c, g, or t
  misc_feature (305)..(305): n is a, c, g, or t
  misc_feature (307)..(307): n is a, c, g, or t
  misc_feature (313)..(313): n is a, c, g, or t
  misc_feature (318)..(318): n is a, c, g, or t
acattcaacattacccncccgatacacctgtgacnatttatattttataagaccctgtttataaaataatttccttcaanacagaattgtattttgaatattatttacgtcaaagttgaggacaggaatgcatttatctatggctttctgtacttcaaggttgtaagcctcacagaatgaggacaggaaagcccctgatttccagtaaacattgacttcctcttatgtgctagncctagggatngaaaggtgagggnttccacaatttagcgaggtacacaaatgaaggaggagggacnaggggngngggggngaganaaatgctaagagtgatagtagaggttgattacaagtgctaaaggact

SEQ ID NO: 639772 - DNA, 134 bp, Homo sapiens
  misc_feature (6)..(6): n is a, c, g, or t
tcaggnacagggtcggtgtcggaggcgctgtcagccttcttctgggtatgaatcttgctggatcacgagaccaccttcaactccatcatgagtgtgacgtggacatcgcaatgactgtacgccaacactggtgc

SEQ ID NO: 639773 - DNA, 370 bp, Homo sapiens
gctcgacgaatatgctcgccttccacgagaagagttgctggtggcacctcagcgctcaactcttcgccgtcacgcagcacaacgagcacacgctcgctaacgacgtccgcaccaagcgcctccatcagtgccgagtctggacgcactgcaatggcttctgcgccaccgttcagcacgtccacagcctcgtcatacgacgtcgacacgtcacattctacgatggggcggacttggcaggcacttgtgaccccatggcaccagcaatggcgccgtgcactgaatagctgaagccagctcgtccttcaccgaccaggcttcaacgtttgtatctgcactatcccaagccggaacaaaaggtgtcgattgctgc

SEQ ID NO: 639774 - DNA, 339 bp, Homo sapiens
tagtccccatttgactcttcctcttcagtagttttttgtttttgtttttgctttaataattggagatttacaggaggtttcaaagaaatgtacaagagaagtccctttcacccttctcccaatcttaatgtttcacacaattaaagtatattatcaaaaccaagaaattgacattggtacaatccatagagcttatttggagctcaccagatacacatgctggcaatatttgggtatgcgcgtgtgtacctttatgcaattttatcacatgtattccttggataactaccaccacaaccaatatccacaacaattccattatcacaacactcctttggg

SEQ ID NO: 639775 - DNA, 431 bp, Homo sapiens
  misc_feature (17)..(17): n is a, c, g, or t
  misc_feature (32)..(32): n is a, c, g, or t
  misc_feature (48)..(48): n is a, c, g, or t
  misc_feature (65)..(65): n is a, c, g, or t
  misc_feature (79)..(79): n is a, c, g, or t
  misc_feature (347)..(347): n is a, c, g, or t
ttttgccattgaacccngaaaaaggagttgancccggaagtgccaagntgagagtcttctacctngccagtaccgaccntaggagcaaatcctttttctcccattttgacctctgtttcctcatctgtaaaatgagtataaagtaatgtgtgttttccataccttataatggaggtagggaagagggagaaataagtaactcttcaggatcaaagtagataatgaattaagaaatactaagctctaaaatgtcatatacatgaaatagattgatgcaaacatttgtgcaaacacaaagaatgtcctactctcagggaatgagactgaacattgaagaggaaaccagntggcgcggtggctaatgcctgtaattccagcactttgggaggccgaggtgggcagatcacaaggtcaggagatcgagaccatcc

SEQ ID NO: 639776 - DNA, 400 bp, Homo sapiens
cctacggtcaagcatggtggtggcagagtcatgctgtggtgatgctttccagcagcagggactgggagcctgagatccttgataaaaacctgttccagagcgctcaagacctcagactaggtccaaggttcaccttccaacaggacaacaaccctaagcacacagccaagacaagtctctgaatgtcattgagtggcccagccagagcccggacttgaacctgaacaaacatctctggagagacctgaaaatagctgtgcagcaacgctccccatccaacttgatagcgcttgagaggatctgcagagaagaaaaagaatgaactctcaaaatacaggtatgccaagcttgtagcgtcatacccaagaaggcttgatgctaaaatcactgccaaaggtgc

SEQ ID NO: 639777 - DNA, 1128 bp, Homo sapiens
ggctggtgcttcctcctttgttgtctattatcctctgtggtgtctcctttcctcgtgtgtgttgatgtgggacgtactgtgtcttgtcttttctggctgtctgttttttctgtcctccttcttcctcggtagtgggccatttattggagccttcctatgtcgaattcgtgcttggtctttccttgattcctcattggtagtgggccgtgcccttgttgtcgtgctttgtctgggggtctcctctgtgctgtcttttttggtgtttccctcggctgtgaggactgtcaatcttttgcttgttcctctttgtgtcatgccctgtggatttgcgcgcgtctggcgaaaccctattgatcgcctttgtgcattatcaggatgtctttgtgtgcaggtttctctgggtccttgcaattccggtatttgttatacgtttttttcatgatatgttggggctgcttccttgcttggtttggtttgtctttttctgggattccatgtgatgtatgaatgattaccacctcttgtctcaattggtgtcatgtcatagatgtgtctcgttgcttgccaaaggccctctcttctattctcttgagatgggacgtccggtccttgccctagcccactcatccccatcgttgggcatcatttgtcttggtcctgcgttctctttgtgagcctgtgactcggctggtatgctgatggctcgtctgctgctgatgctggagtgtaggaagagctcagattatgttataaggagggagctactctcaggctgcaagcagtgacagtgcccagggctactgatatgtctctcacagcttgtaaagtgtgagacagctgccttgtgtgggactaagaggcaagatttgttctcctgcccttccctttgtgacttgaagaaccctgacttgtgtctgcaaaggcacctgcatgtgtctgtgttcttgtaggcatatgtgaggaggtggggagaccaccccacccccatgtccaccatggagccgctcggtcaggagggaggtttgtgagaccgctgacgggctaagagctctatctaccgatggaactctttgatgggccgtggcctgtcggtttaatcaatagtacgggcacctatatattaattgg

SEQ ID NO: 639778 - DNA, 474 bp, Homo sapiens
  misc_feature (7)..(7): n is a, c, g, or t
  misc_feature (30)..(30): n is a, c, g, or t
tggtganaacgcaagttttgtcttcacaantatctcccacataattttatttgacagaataataaggtgattcagagcttgggaattatataaaaaccagtttctgtatctttttagtgaagacttatctgtgaaagcatcggagtcaaggtgtgcaatttgtcagatatcaactgcagcattagtgattgatcagtctggggacatgtgaaaggagagagagagaaagcagcagccaagagcacagcagtcagagggagggtctggctacactttgcagtttcacttttgaggtaggggacaaggcagcctttggcaagggagcatgacctagggtcagtgttgccatttgagaaacaagggaacaaaagaaatatggatatatagttctttcgagaacacatctagactatctcatccagtcttggaaacgttagtgttttttagcagacaatcagttggagtgaaccagag

SEQ ID NO: 639779 - DNA, 254 bp, Homo sapiens
  misc_feature (193)..(193): n is a, c, g, or t
gataaggcgaaggacagttggcatatgccgttaccaggctcaggcagaaggaacagagagcagcgagaaacttctagtaggagatccaagctgatgttaacatatgttgacgccctcctgttccctgggcgcctttcctttacacccaaatatgttatgtggactagatctaaacattggcaaattctcagtnctgtattcagctcatccgtggacatttagtgaacattccactggctgatcctcatttccta

SEQ ID NO: 639780 - DNA, 1452 bp, Homo sapiens
ctggtttacaaactcctgtagctcaagcagtactcccaactgggcctcccaaagtgctaggattacagacatgagccagtccactctcggcacagtaagctgacttctggccccatggccacgacgtccagccagcacaggccacaaaccccagtgctggttctccatccacagcacacagcaggggcacagagcccttcccgcagtttacctgtctgctctgcagtgggctccgccactggctagcactgcattctcatcagtcttgctcctctcagcagcaagccctcaggccatggcatctctcatcagcgcacacacactttctcgcactcctgccttcggcccatttctccatcctctttcctccatcactctctaggccaccacagcagcacgtgcaatctgctgcccatcagcaggcaccagctgttcggtagtcggtctcacgtgcagctcccaccaatctgctcagcttcccattgcggagatccacggatagtacgcttccttagcccatagctctccccaaccattcaggccctgctcgctccctatacatccggcctacctgcgcactcgcaaactcctagcgggcctcttcgcgcgcgtagcgtagtcgcacacgccagtcctcgcgcgcgctaccctatcgcgacactaccattggcctcctggatcccgcgtggagtcaccccagcacccgtcctcgccgtccccaaagccgccctcacctgctgccccacgcgctgccctgacgctgccgcgcgaccaccgcgccagagacaacgaacttcaccacgcgtctgcgcacccatggtgcactaccctggctggcgaacaactcactcggcggcactacacgccacacacctgcgcgcaacacccacgcgcacccttcgcccaccaccttccactcacgcgcctacaccacttcgaagcaccccacggcccaactactaccaacatcgacacttcacacgagccgcccacacggtgcactctactctgcccgggctcacaccgcgctagcacacactcccacaacctcggccccacccccccaccctgccccacgccacaccctgtcacacactcccatagtctggccactggtcaacccacaagcgccgacctatcatacactcacacacatcactcttacacccctgggcccacacacccccacccacctctgcccccagaacaccacgtctcacttatccacagcccgcacccacgcacacgcacgccgacacaccaccgcgcccaccacctcttgacaacagccgacacaaatccggccccacatacgccacaccaccacaccaccgaccccccggaggacgccacacgccactccgtagattccaccactttcgtacactgccaccacactcccgataccccgctactcaatactcacccaagacaccacactgacgctacccc

SEQ ID NO: 639781 - DNA, 1092 bp, Homo sapiens
tctgcttcgggcttccacctcattattattcgcatattgcccacttctgatttcagccagatcgccaagaatcatgaaagtcagccagatggaagcaccgccaccgcacgccgcgggccccagctgcgcgctgaaggccggcaagacagcgagctggtgcgggcgaggtggtgcgctgtactgtcatgagcagagcgatggacatcatcgcgcatgcgccaggtgtggacagccaggggcagcggccatgacatgcaccttgctggcacagcagcagacagggtaaacgatgcatgctcatacgaccagtgaacggctgattactcaccgcctcaccggcagctgggtgcccacacctgaccccagaaacctgcaacgggtgacgcaaggtgcgagacttctcacagccacgatcatcgacctacatcaagggaaccattcagatcaggcagctgacactcgcgactccgacagtggcaccccacggaggcgccgagggctgaccggatccgggcatccgcatccagcaccctcaaacggccgagatcaagagcaccttcacggcacgaaggcgaccactgcggtacctgcaggacgaaccgcatcttgatgtccgactgaagacgcactccacccagggcacccgggcggacacccacaggcaaatccacggggggacacagacggaacttaccgtgactctgatgaggtcataccccaaaccgacgcatcgcccggactctgcagggcaaacacacgcaccgactcgggacgcgcccactggagacccctttaacctggcatcccagcccatgggaggttgcaggcctgcacggcacactgggacgaggatgaaggtgacgctccacttattcttaccacacccataacccagatcaccatgagaacctcacgcgcaggggctacggcacttcccaaccggaggttgatatcccaatcatttctggcacaacggcgagcacgttctgtccacacaaagtggaccaagggtgtgggggggatcctcaacattatctgccggacaacttgtctagggatcgggccatctcgaggggacacccatgctgacaa

SEQ ID NO: 639782 - DNA, 121 bp, Homo sapiens
  misc_feature (63)..(63): n is a, c, g, or t
aacttgggtggggtcacacgggcttattccgcgtgaagcccgggagatgtagccatgctcgtnctgccgctcctcgtgcttgcgggtgatctccacatgccatccttggtcttgaccgtca

SEQ ID NO: 639783 - DNA, 306 bp, Homo sapiens
tcgaccagtgagatatgatcacacctctgcatggcacctgggcgacagagggagtccttgtctcttaaaacaacaacagaaatgtaacaaagtatgggaagggtcaagtttttttcttcactttctttacaccaattaagaacttgatatgggccgggtgtggtggctcatgcctgtaatcccagcactttgggaggccaaggcaggtgaatcactttagcccaggagttcaagaccagcctgggcaacatagtgtaaccccgtctctactaaaatccacaaaaaaaaaaagtcgacggggccgcg

SEQ ID NO: 639784 - DNA, 105 bp, Homo sapiens
ctacaggaactactaccgaaccactgagccagagaagacagtcctaacggaatccaaggggctcaacagcataactgggcacccaaaaacctaggtccacgcccg

SEQ ID NO: 639785 - DNA, 398 bp, Homo sapiens
actctagagtatcccgtgatgttatcccaacactactaaaaatacaaaattagccaggcatggtggtgggcacctgtaataccagctacttgggaggctgaggcaagagaatcgcttgaacttaggaggcggaggttgcagtgagccgagatcacaccactgcactccagcctgtgagacagagtgagactctgtctcaaaaaataaacaaataaataaacaatatctttggggaatgttttagcctccaaattaagttcacgaactgagtgtgccaagggcgaggagagaggatcacttgaggtgaggaattcgagaccagcctgaccaacatggtgaaaccccatctctattaaaatacaaaaattagcagggtgtggtgttgggcgataacatca

SEQ ID NO: 639786 - DNA, 1140 bp, Homo sapiens
ggacatgtttattgccttttctcagctgagctagacctccgttagagatgtatctcacgcaaggaatagacagctcttaggcactggtcgactctagcagcatatgcagcgttaaggtcgcttgctggctgggccagactaggccgtggcctagtgcttgccgttagatcagtgtcccagggaccccgtgacatgggcgtagacctggtgcatctccctcggtagcgtccatcgaagatacctcgaggacctatacgacttgtgggattagtctagtttgactgtcggaggttccaggaaagtctatgttcacttagaaaccgcccgtggcatggctcattgcacccacgagtatcactggctgggccttcttttcctacgaccttgggaggtctagtgggctcctagtctctcacgaggccagcgcctgccctttggttgccctgcgcgtaaagggcgctgacgcgcattgcggtgtgcgccccagggcagaatggtcccaggggccttgcttgcgggtccctggtgctgggaagttccttggtggggcactgcgagtgggatacatgtgcaggtgttgggccgtgtcctgtggtgtacctgagggctacctcctctttggcgacctggtttggcttgtgccccctgggtgccctcgttgtgtagcccgtattaccccgttggcacccttttcttcgcctttgcgccgtgtctttgcttccccgctttttgggggcggcttagcactcgcgttatgcgtcgcgcgctttccccttgggtctctgtgggttggcacgtaagtgtttctctctttccagggggggggtgcgcgctcgttccttggtcaccgttgtgataagcttccttcggggttgtagtacgtttgtccgtcaggcgggggcatttgtcgtggaggtcgcctcaagcctcgaatagaattgggcatctgagtgcggcgataagtttccacggtcgcgatgggcgagaagtcttgttcgttccacttgtggtcgagacacgcgtgtgcggtagagtggcctatgggctgcattagggcacagttacagaggcggtttggccataacgcccttgcaagtcgcctgagcccggtttcaaggggagctgagtctggggcgatcc

SEQ ID NO: 639787 - DNA, 728 bp, Homo sapiens
  misc_feature (565)..(566): n is a, c, g, or t
  misc_feature (568)..(569): n is a, c, g, or t
  misc_feature (712)..(712): n is a, c, g, or t
ggatggagccaacctcacatggctgttataaacattgaattgacatactataaacactataaatatacatgtaaaggtcttggaacagtccttagcacataataagcattctttatgcattcgccattatactgttcctactaccaggaagggaatggatatggcccctgccttcaagtaatggagaagaaacaagcaaattcaatgcactgtaccaggagctgagctactgagtcacgaatgggggttgttccgggggcatattccatggctggttgaaaggggtggctcgggtggtttcccagaaggagacgataccttagctaataagtatatttgaattgtcactggagttagtgattccctctccccccgccaccatacttttcaaaaaatgtaagtgtggaagctttgaaaatgatttgatatgtaaatttgtgttcattttcagcaaatgcttttaggaacagatctgttaagatgaggtccatctgtatttgcccaatactgtggataacattgtttctgttatctgttcctgcgtgctatgtagcaaactgcaccnnannttcgtagcttaaaacaattatttattttgctcaggatttagtgggttccagagtctggggagggtttggcggtgcagttcctgcctgatccacatgggggcggccggagctggaggatcctcttcaaaggatggcttcttctncaacctgcttcctggc

SEQ ID NO: 639788 - DNA, 158 bp, Homo sapiens
cacctgcacatgaaaaatcataaaaaatatctaagtacactgtacaaagaaactgacaccaatatgcttacttccatagagaagtgactgcttcaacagctgtgtgtttgggtaaaagttctgaaagtatgcttatttttaaagtaattaggctttaa

SEQ ID NO: 639789 - DNA, 340 bp, Homo sapiens
cgctatcgtacggcatataggaggaaaggcgctcttagaggtacttgttggttagtgcttctgcctctggacgccgcagtgcatgtggctatccccagcacccagctcctgaagcaccaggcggatcagcagatgacctatggcaccctccagccctcagaagttgcgtaggagacacagcgcctccactgaggcacctctctgggaataacgttccccagcaccccaaatggattaccagtcaattcagaagcattttaccagtgaagccctcattattccagttcactgttaaagccagtaattctctatattaaactttccctgttcggtttatact

SEQ ID NO: 639790 - DNA, 553 bp, Homo sapiens
ctgcactgcagaattttacatctacctactggttaccaggttgtcccctgaacaaccttcctttgtgttttactgttattaaagtagtaatatttgtattcaaccatgtagtaatattttaagccactaaaggaatagttttacttatttagacaacagcaatttctactacatttttataagcttaaaacttacatgttttaaaacttaaaacgataaagacaataacaacattgatggagtatgatatgacagttcagaaagggttagctcttatcttccagtcgaggaaacctattgtatacaatagctggaggaatgtatgatcaaagaggccgggaaccgccgtgtaggatcgtacggctgtaacaggtataattgtttcattaatttgtcacagtcttactgtagaggaatgtaaaggcggaatctgcgtcattcctctggaaaccacagtgttgactctgtgaatctgtacgatatctttaaagtagtaactacgtagtcaaatgtgttcttgacgttgttcataactttgaataaaccatttttc

SEQ ID NO: 639791 - DNA, 623 bp, Homo sapiens
agctaccctaaccggccaaccaactcgtaaagccgccaaccaacgaatacctgctgttgaaaatgagctcgcactaccagtgcgacgtagctctcgtaaaggactccgccgacaaaaccggtagaaatgccgttataacgaagggaaatgaggagtaaaaagcctcggggtgtcaaagaaacacctagaaagcatggtaaaatacctagtaggactgtcggtcgtacaagtactaacgtctgttgtacctctgttaattaacctgaccctccttcgaacgccgcctaccgtagtacgaagactgcgcctttagttagtaattctatgtaatggaacaaagggaatcttgtcggtgtgactgttgccatgggcgcttagtccacgagtgatcctacgaacaactaggccaaaattagaagtactaaaagaactccgcacacttaattagcctaaaatgacaggtttccgtcgttagtctcgattcgatcgaataacatgccggccacgtattagattgacactgctcctttacctactactgattataaacggtgtaagacaaaccaagatcctacgaaaattacttagttaccttagcttccatcctagaatgggcaggtaaa

SEQ ID NO: 639792 - DNA, 754 bp, Homo sapiens
gagccccgggccccaaagctgcacaaggtcattggagcccaaggagcatccatgccaatgtgcgaactggtcttgctccacaccatgacactgcctggaccagccggggaactgatgatcagactaccctgggagacgtcaaggcgcaatggcaacgggggtttccgtggctgctggcatgggggagacgttcgtaggtgaaggggacatgggacaggacctgggggtgttgcagcgtgggatctatgtacttgctgggtcaccaggcctcgtagacagatgtccatgatcagcactgagtgtggcagctcgccaatgtgctttacgagcatggcttcgataccccggctgtatgtggcaggctggactgtcacgcgtgagccacttatatgtgatgggactggcgagctgccatgagcattgtgcagaccctgtctctaataagatgggcttattcccttggagatccgtttcctgcagaacccagacgctgcccaaggcttcgtgggctgcagcactccagtccaccatccagacgcttctacaagaacgagggaggtacatggtcagaggagaaggtgatccaggtgccccccaagaaagtgaagggctggctgctgccgaaatgccaggcctgatcaccgacatccgtgctctccctggacgaccgtttcctctacttcatgcaactgggctgcatggggacttgagggagtatgaccatctctgacccaagagaccccggttcaccaga

SEQ ID NO: 639793 - DNA, 751 bp, Homo sapiens
ctgtcgcctgggccccgccgagcggagctatgcgccgcgcgcagagcacactgctcgcgctccagctcccctccgtgcgcggttcatgactgtgtcccctgaccgcaggcctctggcgagcccccgccgcaggagcatcgggccgctccccgcctgccgcgatgggccctcgagcgaaggaaggacagggatgtgcgcgcttgtgctgcacccgttcggaggcgcctgcgtacactcctcctgtcgtcgtctgctctggtgtgcccatgcctgctgggtaccatgctgtccgcgcgctgcgcaccgcctgctctaggccccacttgactgcctgtgtgtaggtgcgggtgtcccctgcgtcggcgggccaccgtaccacaggccccaggtttctaattaacgtgaccgtgacccaaaggtgcagatgctcccactgtgtccacggacttcataccctgaaactgcatctggtgcctctgactggcgagtggtcctacgagatccatgtgtgagtaccagcgagccaagtgccgagacccggaccctgggcgtggggcatcgaggtagatgcaaacgatgctggtcgaggagcaagtgtcgccatgtgagcggtgctcagagcccttggaagcgaagccaaagaaagcctcaggaagctgaagtttgtgccccatagtgtggccgaggaatggctaccctttgacccatgtgccactgccataggttcacaactgggtactgatagagtgct

SEQ ID NO: 639794 - DNA, 270 bp, Homo sapiens
aaaaatagcggggcatgggggcatcgccggtagttccagttactcaggaggccgaggtgggagaaatcacttgagcccaggaggcgaaggtggcaacgagccgagtattatgccacgtgccctccaacgcctggcgagacagacgaaaaattccctctagaaaaaaaaacgaaaaggaaaaagaaccacataattggtcattttacttcgtgtctcctttttttttaaattaaaaaaatcaatatacatcacatgagaaaggggctttgg

SEQ ID NO: 639795 - DNA, 135 bp, Homo sapiens
cacgtggtgattacccgcttatttttttgttctggggaggacagcgcgtatgagactcctacgtctgtcagcggcaagaagagcactggcagtcctagccaggagacacaggcaccgtatatcgcgaagagggtg

SEQ ID NO: 639796 - DNA, 258 bp, Homo sapiens
attagacatagactagaatgattgcatccctgtgttccgtagacaggatctccgacattagaatcataaggctttgtttaaggatcgcttaagatgtttttcagaccacgagttccggtgaaacagtggagttcaaccagtttgaagaccccccacagaggaatgggatgagcatgagaatgtagtttcttcatctccttgtaccacgatttcaccagcactctcccaccaatcagtcaactccattacccttacaaa

SEQ ID NO: 639797 - DNA, 955 bp, Homo sapiens
gacaaaggaggccgtctgcctccttggtcctgatggggagtgagcaccttcgtcgccatgtgttcctcccccagtccaagcctctctcatctggggaatctggtcagaagtcactcgcagtcccgtcagcccagaagacgtaagagcagggctaccagcaaatttgtgagaactttgcaacaaaacagttgtgcaaggggaacagtgaggcttcctaattgtcatagcaagattgccattcacgagaagagcatttgggggggaaatcctggttgcttgttgggcctcctagaaaaactgaatgtgctgacggacatgcatcaggaacaattgtgcaagggagatgaacctctcttgaaaagttgtttcatccgaaaaatgtggcacccgggaaagaacaatctttggccacaaagttccctgtttgactgagatggtttacacccaggcgagtgaggtcccactctgtgggcccagtgccacccttgttttctggaggcttgtgtggttcacaaaattaaaaaacatgaatagcacggctcacgttggtacactctggagtgggagaccctaaggggcccagaacgagcacagaggcccggatcggtactgtgattggccttcttttatccagccaacccccaaggacttcccatggaagtagaggccttgcataacgactggcataggaacaaagtggcccaggacatcggtaatctccagataccaaaagtcctcgcggcccagggacgtaacacagggcgttcggagaaccgaacgtgaaccggaacctcgcggcagtcgacccacggacgggagggaatctaccctaagagaccgggggagcccacttgcgttatcaacttgcccggggggggaaccaggaggcgcacgttccaatgcccagtgacaaagtccgccggaagcctcaagaagggggcacaccggcgcacaa

SEQ ID NO: 639798 - DNA, 349 bp, Homo sapiens
gcttatcgataccgactacctcgcgttcttatcctttctatttacacacatattgaattctgttccagccccgaagactaggacggacctaaagttcacaaatgggaatgaagattgctaataatcaaagccattactgaagccccctcctttagcaatgaatactgaactgatttatacatatgaggcttaggaaggcggcgacaacaggaaccttggggactctgttccatggcaagagcccaagacttctaccaatttcatgctctttgcttccctgtagagagctggaacatgatgaggacagatgagagagaagagatactaagtgcaatacaggcagggaggg

SEQ ID NO: 639799 - DNA, 102 bp, Homo sapiens
gtttctgcctttccatttgttaaatgggggcccccttttccttagctctgtttttgagttactggggggaaataagcttataaatgaaaaactttttttcca

SEQ ID NO: 639800 - DNA, 225 bp, Homo sapiens
tacgcgttgctctacgaggatccccgagcgcatctgtgcctcccaggtttaagcgatcctcccgcctcagtcccctgagtagctgggactaccagcgtgtgccacacgcctgcgtaattttgtatttttacgtagcgagagggtttcacatttgtgtgggccatgtctcaacactcctggactcaacgggctccatccacctgtggcctcccagacgtgctacgg

SEQ ID NO: 639801 - DNA, 514 bp, Homo sapiens
gactccagactcattacatgccaccaagccagctattaacagctgctcctactacataagatgctctccttcccatccagtatagttttagataatagtacgcgatctcgtatgcgttttgtatactccacttgagctcttgacagaaggaggttcatggctcagtcttaggcactggttcgagaggtggagacggaggaggagagtgatgatggtgactcagcttcataagccccaggagagtctggaacgacttcatcttcactgctatcagattcaggacgttcgattcttctcctcttgttcctcatgtttgcagtttcctttgtctcatcatcagatcctgctactcgcttccccctttgttgtttccttctgcagcaccttaacaggctctgcttttcttcttctttcagtgcgggtcgtggagtcctcattgtcttaagatcattcatagcaggttttccagaaaagttgtgcgtcatattcccttacctggtgcctgttgctgctg

SEQ ID NO: 639802 - DNA, 467 bp, Homo sapiens
  misc_feature (418)..(418): n is a, c, g, or t
  misc_feature (429)..(429): n is a, c, g, or t
ccaaactaatataaatgattgaatgggaacaaatctcttgtgcagaagaatttcaaataatttatgtagatactccccacttagtggctctgcatagtgacttccttgcagagtataatatggaaaggggggaaaagagtaactttacagtggagaaatctgacagacaccagctcagccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactatcaaggccataaaaaaccaaggnaaatcctgagnccatgggtcaccagccaaggaggaggcctgggaaggcc

SEQ ID NO: 639803 - DNA, 352 bp, Homo sapiens
  misc_feature (167)..(167): n is a, c, g, or t
aaatggggttttttccggggcctgcaaaaccaaggcctccaattggaattacaatttgatacaaccaaggaaggttttttcccttccgaaaacttttccttccccctggctggttttggggcctttttcctaaggggaaaatttttttcccccttaaatgggttttntgcccaattacttgtcaagggcaaaattttggtttttttcttttgccccgtgttggggctttttttaaccaaaaataaaaggaaagggttccaaaaacgttttggggtttttttttttgggtggaaccggtttttggttcaaaaaaaaaggctatttttccattaattttttgaatttttcagga

SEQ ID NO: 639804 - DNA, 800 bp, Homo sapiens
tgctggtacgtgcaaaagtagccgacaggccagagtttccacgttttcggtggcttcgtaggcttgtagcttctgaaatccgctaagaagcggcggtctcattcatcttcaagtacctagcctgactggtagggctgctcagacacttccgaaacatttcgaacctggggagggcgggcggcggtgaaacgaactactttctgtagagagtgccccatcggcgtcgcccctgctttgaaggctttactgtattagacggaatgcctgatacatttgtgtcctacttgctgacagcgcacaggatccttctaacagtatttctcaagtacgtgtaacacaagagagatgaacacttgaagtccaagccgtgctgcgtgattccgtctcgacaggttctaaacgagcgtgtccagaaactctgtaagccttctcaaaactgtacatttcaaagatcctgtgcgtttatcttcatttggctgggcatgaaagccaagagtactggactgcctggttcagggctgaacagcctagtacacctgctaacttggagcttcagagccatggcaacgcaaggagtcaagagacgccaaagcacagttggccctctcctcatcggccaatcagagcaaggaagtgcctgaaaagccaaagtatgctctcaaatgtactcttgtgggacacacggaagcagtgtcatcagttaagtatagtcctaattggaccaatggctagcaagttcttctgctgataggctaagtcatacacttgcggaccctactgatgcgccacgtatgcagaca

SEQ ID NO: 639805 - DNA, 106 bp, Homo sapiens
tgacacccatcgaacgggtgggcctgcaaatagcatccggtcaatctggtgttacctggcatagggaggctctgcatagcaccggctatagcggtgtcatgtcggg

SEQ ID NO: 639806 - DNA, 348 bp, Homo sapiens
  misc_feature (6)..(6): n is a, c, g, or t
  misc_feature (19)..(19): n is a, c, g, or t
  misc_feature (34)..(34): n is a, c, g, or t
  misc_feature (195)..(195): n is a, c, g, or t
ttttcncccaagaaacacnagtacccttgagganaaacaactggctcttagccacagctctggaacaactgctctgcgccaacacctggcccacccaagtggtccccaagcagtaggggctctgcagggggagctgaccattgcagtgaccagatggcaccagagggaatgtgacggggaaatatccaggtgganctaatgcctgccgtgataagttggcctcttccttttgttcttcaggcctaccggtggcagctgctccctctaatttttcccttgctggttcctatttctgttattcatctgtcacctgtgtaatcaagttcttgaattaaattctgtctgtca

SEQ ID NO: 639807 - DNA, 86 bp, Homo sapiens
  misc_feature (59)..(60): n is a, c, g, or t
agcttttctgtcttttggccagtgccgagtggaatgcctggtttaagaggagggactgnnttcagctgtggtactttgttgtaaaa

SEQ ID NO: 639808 - DNA, 107 bp, Homo sapiens
ggatttgctggtgcagtacaactaggcttaatagggacatgcaaagaacaagagaagacctcagatgtgaagtccattaaagcttcaatatccgtacattccccaca

SEQ ID NO: 639809 - DNA, 139 bp, Homo sapiens
cccctttaggggttttggcccccggggcccaaaatttgggtcccccccccgggggggggtttttcctcccccccccgggggtcaagccctttttcctgccccccataaacccccctttaattttttttttttttttcca

SEQ ID NO: 639810 - DNA, 775 bp, Homo sapiens
  misc_feature (363)..(363): n is a, c, g, or t
tgggggttttttttttaacccctctttagtttattgcgctcaaaaaccaatttaaacccccccccatgtgtaacgggggggcggggacaaaagcaaaaaggcagaaagccggttgggaaaccacaaggtttggcccccgggcaatttttggcctggttgggatttgggtgtttcaatcctggtccctggtgggtctgggggtgagagtgagagggtgtggagacgcctccgggggggagcattgcgccattggacgccccttgggaagaatttcaagagggggatggggggcagaagggccactggtccgggcctgggcttctggggagacagtggtgttggctccccaaaatgtctctgagnggcgggagggggggtttagggggacaggggctctctctcacgggttgtcagaaagggggtcgctcagagaggcccaggagagggggcgccccctgagcgttgggcctaagaggttgagcgccgagaaagtggaaaggggggcctagcaggttgggtgtacacacgagggagggtcccataaaggtcgggggacaggggggaccgactattccacgccacattggagaggaaaccctctcgtctttagcccctggggggacattttggcgccgcccttaaagaaacctgggcttggtttctcccaggaaggctccgaaaatccgtgcgggaacctctggcgggccaaggctgcggtcgcagagcccgacacaagaaggacgacacaggggcatcagaccccaaagaccacgat

SEQ ID NO: 639811 - DNA, 177 bp, Homo sapiens
gcctcacctgaggtattacatagtttcttttaaacctttccggcagtcaagaactggtttcatctagctctgactttctcttgctagccagatacctaggcagaacctatgacagaaaatgacctagttcatgttaattatcttgcctagatcaataccagttgtaacagtgctggt

SEQ ID NO: 639812 - DNA, 227 bp, Homo sapiens
ccgaggatctcttttcagatttcgttctgcacagagttaaggcgagggcgagaaaagtggaaagagaaatcagagaggatacctggttctacaccaaccctggagcttcctgcgccggaggagacagtgaaccagacgaggacaggatacgactgcgggagtcccagcccctgcatgagaagctaccaaggttagctgctacccttagcctggcggggaggcctcgg

SEQ ID NO: 639813 - DNA, 130 bp, Homo sapiens
ccccccccccggggtttttttttcggcccccagggggtgtgtttttttttttggggggggggaccccctttaaaccccccccccccttttttgggggggggttttttttttttgggggggggttttttta

SEQ ID NO: 639814 - DNA, 409 bp, Homo sapiens
tgacggataagctgtatcacttgcctgctacagctggcttttaaagcctataaactctccttaccattccctcatttcacctgtcctaaaggcagacaaggcttacaagttagttcagaatctgcgccttatcaaccaaattgttttgcctatccaccccgtggtgccaaacccatatactctcctatcctcaatacctccctctactacctgttattctgttctagatctcaaacatgctttctctactattcctttgcacccttcgtcccagcctctctttgccttcacttagactgaccctgacacccattaggctcagcacattacccgggctgtactgccgcaaggcttcacagacagcccgcattacttcagtcaagcccaaatttcatcctcatccgttggt

SEQ ID NO: 639815 - DNA, 151 bp, Homo sapiens
cctaccggcaacgcaaggcggaccagtaaccactccaacgggctgaggaactacccaggcttactgaaccagatcaacatgaactaggtccaaccacatgtatgtgtagtgggtcggtatttaaccaatgacacatgattcataagttggt

SEQ ID NO: 639816 - DNA, 1079 bp, Homo sapiens
ggcgagggccgaccgctcccttcctgccactgccgacctactggacgctgccctgcatgctgcccagccactccaggaggaagtcgggaggcgtggagggtgaccacaccttggacttctgggaacatctcctttgtgtggctgacccacctgccgcatgctccctcctctcctacccactggtctgcttaaagcttccctctcagctgctgggacgatcgcccaggctggagctggccccgacttggtggcctgggatctggcacactccctctccttggggtgagggacagagacccacgctgttgacatcagcctgcttcttcccctctgcggctttcactgctgagtatctgtactccctgggaagcctgtgccagacaactttgagccttggaccacactgaggcattaggcctctctgcctgggatgggctcccaacactcccctgagagatggcctggattcacagaccctctatgtaaccattaagagagctcaaagcccttcctaccgtctggttgatggataccacaggaaacaaagcatctttcacccaagatgggtggaacacaaccttgctgggacattggatcccagagagcttaatctcttcaagtgtggagagggcagggtccaccgccctctgctgtagacttattgaaattaactacttgaaaacttcactggattggaggacgcagacatttctcattcagcatgaggattacccatgggtcatcataggcaaggtccaacttgattagagatggagaaatatatccagcatcttaactaaggagacacaacgattcacgtcgcccaggctggaagtcaatagcacaaccatgacactggagaatatatcccacagtgaagtgaatatcacccaaagacaccaaaattaccagaatcaagcacgcacacaaactgacaaattgatataaaacacactttacaagtcaagaatcaactggacagaaacaacacacgcacaatgaatagtgcaactaccccacttgagattcaactcaacgactcacaaccacacaaacggcgcggcacctctcctcctccc

SEQ ID NO: 639817 - DNA, 144 bp, Homo sapiens
tattccagatggcagaatctgaggatctcagattattgcatctgaagattattatacaggatgatcagttattttgttcaaagacacaggctaggattctgccaggaatattctatcaggaatggttagctctatttggaatga

SEQ ID NO: 639818 - DNA, 819 bp, Homo sapiens
  misc_feature (74)..(74): n is a, c, g, or t
  misc_feature (189)..(189): n is a, c, g, or t
  misc_feature (640)..(640): n is a, c, g, or t
  misc_feature (675)..(675): n is a, c, g, or t
  misc_feature (680)..(680): n is a, c, g, or t
  misc_feature (751)..(751): n is a, c, g, or t
  misc_feature (767)..(767): n is a, c, g, or t
  misc_feature (774)..(775): n is a, c, g, or t
  misc_feature (779)..(779): n is a, c, g, or t
gcgggagggggcgtatcgtgcaggctccgactccggggctggcgccggggtccgggccgaggggaacccgcgancggacttgtgggggagaatgaggatgaaaacgtggagcttccattgtctagggtttgaccggccgacagggatttcgacgggggaccggggatctggggagggggtcgcactttntcgcctctttcgcggcttcccggcttctgcttgcttccctgaccgttcccaggtgcgcggcggcgacgtgtctgctccaggcggcgggggggatggggggtggaggaagttcagccccaagccgcccgcctttctccagctgattcctgcgggaaccggggcggcgggaccctgcctctctccagaaggccccgggaacgctggcgcggggccctgaacccacgatcgtttgagcgcctgctgtgcgcctccgccgcgagtcgcagggcccgagataaacaatgggtctgaaaaaggagggagtttcaccatcctctctgcatcatcctcctggctgtccctcgggacagatggtggcaccgccagggtctggggacagatttggattctggtcccatatcatgccacccacaggcttcatgacttggtatttgctctctaggagcttttntcccatctgcgagtaggactgataagaatcccganccccnagagtagcaggagggtcccaggagtaaatctcaggcgtggagcctggcgctttgtaaataatcaattgtgntgttgttttttgttgntttgttnntagnctccatctcaagaaaaaataaaataaagttgttctctgaa

SEQ ID NO: 639819 - DNA, 754 bp, Homo sapiens
ggatatttttctcaagtataaaaatggagaccattacacctcaagggaagtgagtatgccttgttatgggttttatcagaaacccgtgcgtcattaaggctgctttccaaagactgggttcacctagaccttctttactgttcaatggcatttttgccaagcatcagaaattgataccgtaattcaccatacatctgctggagtgatacatttgtgatgaaactcccctaattcattctttgaattgctgactctttccccttaataaacctttcattcatacagccctttgctgttcatatcttttataagtttggaacttaaagaaatttatcttcagtttgacatgaagactaagaaactgtatttttcctgaacaataaaacgtggctataaaatagtgcccaacccaaataggacacaaaaggagagttttataattcactttaaaaggagatttgatggtatatagtttaaagattaaaaatattttgttcttcatattgacagagcgatgaccccacagtatctgcctcacggtggaaaataccaagttcttggagattactctttggcagtggtctgtccccctgcactctttcatgatctaatttctgttttataccttataccctaaacacttactaccaacacagctgttaaacattctatacgacaacaattgtatgatctggtattaggaaattacagttcaactagtaaatatcaaagaaaaaaggataagttaactccc

SEQ ID NO: 639820 - DNA, 352 bp, Homo sapiens
gttggggtaaacccctctttaaaaaaataatgcttcgaaaagtaaagcaaaatcttttcccaaaataattctttcccttttcaaattgttctgtccccgagccagtgtaataaacaagtgaaagaatcccattttgtaggcttaaaaaatgccaaattattcctttttcgcttgcccttaatttgagtggaaaaagctaaggaaaataaatgcctcagaaattccaaaaaaaggtcggtttttgagaaaaagagaataaggccctttcgatagtttaacccatacttttttttaatattttaatgccagtggtataaaaaaaatatgaataaatgcctttcccagtacccta

SEQ ID NO: 639821 - DNA, 149 bp, Homo sapiens
ccacatttgcaggatggtagaattaattacaacatataaactagtaacctgttaatctttagtcagcgcagcaagatttttataatggacaaactgcttattcagacagtgatcacgagcacaactcaaagtgcagagcaatgaaggat

SEQ ID NO: 639822 - DNA, 174 bp, Homo sapiens
actcagtgatgtatttcattctgagatggagactcgttctatgcccaggctggagtgcagtggtgtgatctctgctccccgcaacctctacctcctgggtacaacgcgattctctctctctcacgcctcccacagtagctagggactacaggcggtaccgacgctcgcacttcg

SEQ ID NO: 639823 - DNA, 216 bp, Homo sapiens
  misc_feature (10)..(10): n is a, c, g, or t
  misc_feature (14)..(15): n is a, c, g, or t
gcaatccganttcnngcgccccccccccccccccccgccccccacccccccgttatgggctctctgagggtttttatgcctttgacaagaaatcagtggatactggatttgctcctgtcaatgaagttttaaaggctgtaccaatcctctaatatgaaatgtggaaaagaatgaagagcaccagtaaaagaaatatctagcgaaaaaacaggaagc

SEQ ID NO: 639824 - DNA, 479 bp, Homo sapiens
  misc_feature (2)..(4): n is a, c, g, or t
  misc_feature (241)..(241): n is a, c, g, or t
  misc_feature (272)..(272): n is a, c, g, or t
  misc_feature (309)..(309): n is a, c, g, or t
  misc_feature (348)..(348): n is a, c, g, or t
  misc_feature (409)..(409): n is a, c, g, or t
  misc_feature (411)..(411): n is a, c, g, or t
  misc_feature (437)..(437): n is a, c, g, or t
tnnncgggtggggttgacctggcgtttgcgcagcggtgagaacgcgttgaatcatgtcaatggatcactgacaaggactactgaaacttcccacgtaacagccggacaagctctacagatctctccttaaaacctctgcaaagtccttcgcctgattacacagtgcgagggattgcagatggttttctttgttaaagcccagggttttggggctgtcgcttgaacacggccattggcaggntggccctgaccccaatggatgccaagacggncgatgttgaaaccgtcttgcgcgactttagagagtgnctgaacacctttgacgactgggctgcgagcttctggagnttttcggcgctggattgtcgagcaggtgttcaaggtcggcgacgaggttggcgctggtcgngnccaccaaccgcggccattttcccagnagacttgttgctacctgccaggccaacggacgtgccccgggt

SEQ ID NO: 639825 - DNA, 446 bp, Homo sapiens
  misc_feature (432)..(432): n is a, c, g, or t
gcggccgcctactactactaaattcgcggccgcgtcgacgactgttccaattgacttttgtcacaagagaacctcttttcatgacaaccaaagagtaatgtggctgaggtgttaaagagcagcctgggacgttggtgaagggtgactcctcccccgtttttgggcgtggtggaaacagtgaggaaatcgccagagaaagtcgtcgctctcactgcagagattatggaacttttggcgaaggaggcgcagtcacagtacattcccgcaagcaaaggaacaacgggctatattcgccctacttcctattgccaaaatagacgggggggtgaggccaatactggatctacacattctcaacgagagtgtagccacaaagggccctttcgaatgcttacgacaaagcatctgctggaatgtgtccacaacagactnttgtataaaaggtc

SEQ ID NO: 639826 - DNA, 1011 bp, Homo sapiens
agacagatgaggcgagaggaggaggaggaggaggagaaggctctgggctcctctgaaaaaaaaaaaaaaaaaaaaaaaaaaaaattttggggcgccgggcagaaaaattttctaagcaccatttcgtgtgtggggcggggcgccaagttaggttatgtagaccagttggcccataggttggtgccaaaggagagaatcgtgggccaatgcgattagggtcgtctgggtttcttcacccaaaataaaaaaaccgccgggcgggaacacccggacgggtgtctttgaaccaatcccaaggattggggggtccggagacggcaatcaagtgggcctcttacaaagggggtggtccaaacgggacgcctcgggattaatcaaattacagcccgcccgcggggggaacatacacaagaaacggtggaggcaaacactcatatacaggcactttgcctgtgacacaaactagtgaataacacacaacaaagaacggctgatgtaatgaacaacagagaaagacgcgaacggaagcagcagcaaccggagcggaccactggagatatgtccaaatcgggcggcaatatgggagaagcgcggtggtccgaaacaaagctgcgtcacaaactgcagccgaaagcgttataaagaacaacactggggagacaaccaaccccacagggtagttgacacggcacgaacgaaacaaaacattattttacaatcaaaaaacccacgtctaggggcaaaaacgacaaggcaacgcgactcaaccgagtaaggcaagccgcacaagtcttttgagcaaattctttgctgtacaaacacggcgactgaaacactgcgcgtaggagtagtaacacccaaaagcgacgcaaagcggttacagtggtccatggcaacagcggtaaacaatggggtctggcagaaaaacccaatattccacagcccagtcgtttccttcggcaaagaaaacagcgagcgagatacatggggcagacaggttcaatagccgaa

SEQ ID NO: 639827 - DNA, 289 bp, Homo sapiens
ttttttatatatttataaaaaaaaaaaaagttggtgattgccttgggaaattcccagggtattactggacctatttggtgtattgttaaaccagtgtccttgtgaaactgttgctctttatgttcctgaaacaggtaaggaaacagttggtcaacttttatacaaagtatataaacagttcagtattgtttctgttcattttgtttttttttcattgacaaaatcaaaccaccattcccccttgtgtaaataaatgatttttctgaataaagtaaagtttttaattcca

SEQ ID NO: 639828 - DNA, 351 bp, Homo sapiens
caaagattcaagtcatagatgatgtatcagtagtgagtcagtccgcattcataagtaagatagtgtatatgttgtcaaaagagccatacgaagttcatctcccagcaatcaaagccacagtattgactctcgtcaaatttaggacagcggtcgtcgtagtaatggtcaggtaaaaaggaactcatcatgcaagataggatcataggtgttcacgtcacaatgaaggaactgtgcagtaaacgcacactggggggtgcactcagtgtagatgtccagatacacgagcgacgagctcagccagatggtccttgtggaccccataagcctcagggctataaaggtgtcgtgtgc

SEQ ID NO: 639829 - DNA, 721 bp, Homo sapiens
aagaggctgaatgggccagggccaggcgtgtactcacgcctgtaatcgcagcactttgggaggccaaggcgggcgatcatttgaggtcaggagtttgagaccagcctggccaacatggtaaaactccatccccaccaaaacatacaataagtatccaggcgtgatggcatgtgcctgtagtctcagctactcgggaggctgagaatcgcttgagactaggaggtggaggatgcagtgagccgtctcaaaaaaacaataataataaagtacagactgcattttaaaaatatgcgagtgtttactgtgtactaggggctgtataaaaggttttcacatatatcaaaagctactttcccatttgacattttaaacaaaatgctttatatgtaattagcattttcaccagtactttgatcacactaagctggcatttgtttaagcttgtaagttttataaaggctttgttaaaaatcaaatttttaagaatacttttgcactaggtctccagaaatgctttgggttcatctttcattgctgcaaggaacttccatgcctctaacactcatcttcaaaagactggtaagttattatttctcagtctacgccgcacttactagatgaagatataaattacatacatcgtataactgtggtgagttgttttcatttgttagtttttctctagtttgatagactcctcggttcttaaacatattgtacc

SEQ ID NO: 639830 - DNA, 120 bp, Homo sapiens
aagactagtcgaccaggtaaggaggggagctaagagatagagagaaggggacagaggcaagaaaagatagtagatcaagaaagatagagaaccaggcgtagagggctagaagcgagaatc

SEQ ID NO: 639831 - DNA, 294 bp, Homo sapiens
  misc_feature (283)..(283): n is a, c, g, or t
aactgaattgtgagaagcagtaatcacccaccgataggcatgattaacaaagcaacctttcccttcccccgagtggattttgcggaaacccccttttcccttcaccttgcttgagatgttccaaatttgagaaacttgaagttgcctacagaaaaaggaaaaaaggccgacaaaattccctctcacttgcagtaaaaataaataaaacagcacacaaacaaataaaatgaaataaaagaaacaaattgaaataaataatgtgttgtcacattaaataaaaatnaaaataaaaat

SEQ ID NO: 639832 - DNA, 274 bp, Homo sapiens
ccgtgaactgcgccgtagtaccggtattgtaagaacagcgtacccaaagtctcgtttctgtcgaggtgtccatgaatgccaagattcgcgttgctgacctggggcggaaaaaggcaaaagtggatgagtatccgttttgtgggcacatggtgtcagatgaatatgagcagttgtcctctgaagccctggaggctgtccgaaatttgtgccaataagtacatggtagaaagttgtggcaaagatggcttccatatccgggcgtcagtctgtgagg

SEQ ID NO: 639833 - DNA, 440 bp, Homo sapiens
gcgagagtaccattacgtaatcaaatacctgccccatgcaagaatccttctatgacattctgacaactcacatagtctccacttggactacacggtctgacagggacctcattactttgctataatgtctacttatattactggacagctttaactagttagaaaatgcttttctaaactaaaacaaaagctatcaccagtctcacaacccaactataactttcacataccggttttgattctgttctccaggacaataaaatctacttcccaaggatgatggaattttcatgcaaaattgttagacaaaggcattctttacataaacatttgttgtagatcagcatcatgatgttgtcatgagccaaacagtggccttattttcacaacatcctgtcttatatcagtacttgcttgtaccttatattcattcataaata

SEQ ID NO: 639834 - DNA, 198 bp, Homo sapiens
  misc_feature (17)..(17): n is a, c, g, or t
tgagtatggactcaggnctgagcgtggtgggacacgactgtaatcccagttactcaggaggtaggagaatcacttgaacctaggaggcaaaggttgcagtgagccgaggttgcaccactgcactccctcctgggcaacagaacaagactccatctcaaaaaacaaaaggtgcttcataaaggtactctctttgtgtga

SEQ ID NO: 639835 - DNA, 444 bp, Homo sapiens
acaggaaagtggagagagaaaaaatacgtttcaaaaactatagtacacccgtttttttgttgttgttgttgtttttgagatggagtttcgctcttgttgcccaggctggagtgtggtggtgagggaagagaccacctcattttgtcttatgcccaatttctgcctccaaagaaagaagaagtaaaaactaaaaggcggaaatgaaatctacaagcagacagcctggtgccacaccctgggcctggtagttaaagactgacccctgacctaatcggttatgttatctatagattacagacactgtatagaaaagcactgtgaaaatccctgtcctgttctgttccaacctgattaccagtgcatgcagcccccagtcgtgtaccccacttgctcaatcgatcacaaccctctcacgtggacccccttagagttgtgagcccttaa

SEQ ID NO: 639836 - DNA, 413 bp, Homo sapiens
ccgggcttgctcaggtctgtagacttttatttaataaatacttaagacagtaatttgagataaaacgtaataaagatcggaataatcaaatctctatcttagtgttactattctttagatcaatgtttgatgctttaggtgcttatcactctgaggttaaaaaacaaggcaaaaatctttcatcaagaaactaaaatttatgaccagcctgggctgggcgcggtggcctacgtctgtgattccagcactttgggaggccgaggtgggtggatcacctgagatcacgagtttgagacaagcctgagcaacacagtgaaaccccgtgtgtactaaaaatacaaaaattagccaggtgcggtggtgcccacctataatcccagctacttgggaggctgaggcaggagaattgcttg

SEQ ID NO: 639837 - DNA, 437 bp, Homo sapiens
tgaataatgctgaaaagttaaaatgaaagcaagaagcagccaccatctccccactttaaatatttatacccagtaaaaagtagcaatcaagcctctgcccttcaggatcactctctagccttcagtcccaacccaaagatgggtcagcccatatccaggttagctctggctcacctcccagggctctcctggaaaatgtgtgctctcatcatcaagagaggtcccacatttccaacgccagccagcctttgcaggacaactcaatcttgacaagtcagaatcaaggggtctgtaaaatcctccatcctccagacctggtggccactgagggacatgcagtaccccaggaaccctgaagggaggaaggtactgggtgcaccagcgccctggctcagtccttggcctcacccacctcctcttctggcagaaaaaaaaat

SEQ ID NO: 639838 - DNA, 1093 bp, Homo sapiens
  misc_feature (1092)..(1092): n is a, c, g, or t
ctgttttcttccttttttctctcttgcttgtatgcacaaggtagtgacttatcttcgtaagatacaaaatgccagtcattatctatatggccatgtatgtgaaaccaaatgcaacctgtagaatcggtcatgagcatcacgtaacaactaaacttattggtgcccatggacttgaaaagcttggagaggtgcacttacacacagtaaattgcgctgtggaatcctactgcaagtatctatcctgggatggccagtctgaatctctatcaagggactttgtgtacatctcgcacatgaacgtcctatctatagtagaaattgctctgcatttagacaactcgtgggcaaaaacgagcagttgtcctccaagattcttagcaactatattcttattttcaaaatggtttaccaaaatttgtcaggtacattgtaatcgtgtagaaagcatgtcaaagaatcagtttctatcaatcagcttgacaatcctagtcaagcatctctactcctttattatgtgtgtgtatcaaacagattaagagctcctttgcgtttcgaataaaataatttctcataattaagcagtagaagatctatcttcacaaagtatgagggatgccagatgttgataaacttactctttctgaatctggacaaagtcgactaaacagatttttctgatgagcatgttttatgaatccgtccattgtgctccagttctatcacatttgcatttttcatgttacactgcaattacttaatctttttcccctatccttgtaaaattactttcctgaagtgggaggtgtagtctattcccccgttaagggtatgcattaaatcaagcttttttagcgtgagtgtacatgtgcttaacccattttcttttcccatttttggtttaacagtaccctgccttcttttccacggaaaaagtgcgcatccaccgggaacggcagggtgcgtgcgggtcaagaatagaacgcgcgaaattttcgtgcgcgcggacacacttcagctcggccgccgcggagcttgggatataacgacacacgtcaggccgcgactacccacttacacatactgttgtcggtnc

SEQ ID NO: 639839 - DNA, 703 bp, Homo sapiens
cgcggccgccagcgccgtctgcttggcttcttctggactcatctgcgccacttgtccgcttcagcactccgccgccatcatggtgaagctcgcgaagtgcaggtaaaaatcaatggtgagccccaatgaaaatggctcctcctccaagaggaggtagaagaatgatagtgaagatgatggaaatgtcagagagatgaaagatagatgatagtagtggagaagaggtcgtcatacctctagaagaaaggtcaagaaggctgctgaaacctcaggaaatgaaggtgtgtcgtttgccccaagcaaaatacaggttgcacgttggctctcgaccagccaatgaaagcaagctgtcactcctaggcaaatgatgtgcagcattgcaacacctgcctagagaaagacagtatactgcaggcaaatgcagttacctacacctgtgcaagaaggggagccacaccatggcaaagcattggtagcaactccgtggtaagaagggtgcttgcatcccaggccaaggggggcaaagaatggcaagaatgccagaaggatgacagtgatgaagaggaggatgatgaccagtgagggaggatgaggaggatgacgaggacgaggatgaggatgagatgaattggaccagcaggatgaaagcagagtgatggccctgctcagaggtgaggacgtgaggatgagaaatgttgggtgg

SEQ ID NO: 639840 - DNA, 232 bp, Homo sapiens
tattctattctattctgttcattctattctattctattctatctattctgttctgttctgttctattctgttctattctcttctgttctgttctattctattctattctattctattctattctattctattctattctattctattctgttctactctattctattctgttctatttagttctattctattctattctattctattctcttctgttcacggtaacaccaca

SEQ ID NO: 639841 - DNA, 399 bp, Homo sapiens
tacatgagtagcctggatatatctcgtccattaatgagtactctcatgggtactgttataaggacaggggctgtggagcccaacagactgtgtcaagccagtctggcgagtaacttgctgtatggtagggacaagttatttaacctctctgtttccttaaatgaggtagatggtaacggtgttataggcttataacataggatcaaagagatggtgcatgtgaagtgtctggcaccaatggagtactaaataaatatgaacaatttgctgctttcttggtgggagagagggtctcgctctattgccaaggcttgacgtgtagtggcaccatctccatcttctgggctcaagcaattctcccatctcagtctcctgaggagctggaactacagttgtgtg

SEQ ID NO: 639842 - DNA, 477 bp, Homo sapiens
tgcggtctggcatcccttgctatatgatcatacgccatgaactgtgtgtgcaagtcctcgatcccttctgcatctcagagcttccatgtgggatcccttacctgccggctgaagtgcatcctttaggaattttgtacatgaggcacttcagtgaggctgatggcaaactgttggagtttatacttgtatgaaaattcagtcttggctgggtgtggtggctcacacctgtaataacagcactttgggaggccgaggcaggtggatcacctgagggtcaggagttcgagaccagactgatcaacatggtgaaactccgtctctacaaaaattagccaagcatggtggtggacacctgtaatcctaggtactcgggaggctgaggcaggagaatcacttgaacctgggaggcagaggttgcaatgagccaagatcacgccattgcactccagcctgggcaatggaggaagactccctctc

SEQ ID NO: 639843 - DNA, 289 bp, Homo sapiens
  misc_feature (278)..(278): n is a, c, g, or t
gctcatgcgtgcttcttttcatctcttccagctactcagttcctcgggtgtcctcatattattggtattcatggtatctagctccctgctcccgctatagatgtatttctcaagctgtgatgcagtatgcttctgggtttttccagtgctgacctgatagttgtactgtgtctggctcccccagagaacatgatggggaatggtaccccaagctatcactctcctggctccttcccacagcagcagtttggtgcactggagtggtggccagacctgangcatagccagg

SEQ ID NO: 639844 - DNA, 361 bp, Homo sapiens
gctcgacggaatcaagtggaattgaatcgaaaggagaggaagcgaatggactgaaatgaaatggaatggaattgaatggaaagtaatgcaatggaatagaatggaacgaaatttcacggaatggaatcaaactgaatggaatggaatggaatggaatggaatggaatgaaatgcaatggattcaactcgattgcaatggaatggaatagaatggaatggtatggaatggaatggaatggtacggaatagaatggaatggaacgaattgtaatggaatggaattgaatggaatggaatggaatggaatggaatgaacgcgagtgcaggggaatgtaatggaacggaatgcaatgggtcgacg

SEQ ID NO: 639845 - DNA, 707 bp, Homo sapiens
gcaataatccatgaatggctactctgatctatgttgataagggacaatggagatgcaggcacccgtgtggttgctagggatgggtctgaaggtggggtctggactcttccgacataccagaatgccttaagatgggagatctcaagtttcaacacgacgttatggcattgacgttcgatgtccccaccagccttacctaaaagctactagaaaggctgtgtggaactgtctaacagagctgagcagaaaatgtctgtaaagacgcaagggacccctcaaacaaaaagcagtcaagctgttctgccaaagagatgactgagtaggactgttcaaagcacaaagctctgttcctgcctccagatgatgcctatccaggaacatagaacaaacatggctttcccttcaatcctctagacttcgagagtttgagctgcctgaagagcaccagattgcgcacctccccttgagttggagtgcctctcatgatccttgaggaggagagagagcttgaaagagctgtgctcagctgggccccccttcacctgtgatgatgccctctccagcatgggaatccaagctgttgcagtctccttcaagtcattctgtcgacctgggatgtcgaattgccacctgtttgctgtgacatagatatgtcacatttcttagtgctccagagtttgggtgtatccgtaggaataaagccattc

SEQ ID NO: 639846 - DNA, 545 bp, Homo sapiens
  misc_feature (80)..(80): n is a, c, g, or t
  misc_feature (102)..(102): n is a, c, g, or t
  misc_feature (136)..(136): n is a, c, g, or t
  misc_feature (323)..(323): n is a, c, g, or t
tcggacggtcgatactcagatcgggaacgtaatattactctgatacaggccttcggcctcaccgagcagaccgtttttcnggcgttgcccggcctcggccangatccggttgtccacgctatagatagcggcgtgngccacgagcgggttcttggtcaggttgttgagcaacacgttgaggctgaggatgtcgttggacaccaacaactcagtcgccgaagtggcagtctgggttgtcaggctcgcgcccagggcgtcagcttgctcgtgcatggcctgcttgaactgcaaacccatcacgcaggcgtagatcaccagggccngagcgaccaggatcacgttatggctggcgatgcgcaatgcaatcggtacacggcgatggcgcagtgcccggaagatcagcaggaagaagttatcggtttttactggcgtgggccggttcacttgcgctcggctcttggtccgtgaagttgacgcgcagtatagcgacaggcccctggccggcaaagcgctggctgtgcccgatggtcactgaaagtatctga

SEQ ID NO: 639847 - DNA, 132 bp, Homo sapiens
gggtgctgtgagctgaacagctgcgggccaaggagcccaccaatgctggcagactgtctaccaggctgagctgggagagctgcggctgcggctcgatcaactcacctggcaacagctgccctggctgtgagt

SEQ ID NO: 639848 - DNA, 285 bp, Homo sapiens
aacagcaagttttttgtccctgcacccccaccattttggggacctacaagggcctggattcaaaggacagtgcacaggttaggcttggagctccacaaggcttggggaattgggacggggcccccttcccggacctgcagccttggacaaatggggaacattgtgcctccctgaacaaaaatggcaggggaggaggttgatgctttaaatgaaaaggatggtggggttgggaggtataaccctgttcctttttcccagtttgtgcaataaaggttgtgaagatca

SEQ ID NO: 639849 - DNA, 360 bp, Homo sapiens
gaggaggtgctatcagcagctcacaagatgaatcgctagatgtattaaaagcagatggcaacatacaggcagcgtggagaatctgtgactcacagaggtagaagagaggaccccacttccatgactgcaaatcctaagttttatcagagagtacctgatagaacaatgacatgatctaagataaactctgtacgaacaaatgaccgatctagagtaaactaaacaatctgacgataacgattgttaagttatcaagtcatgaagaatgaagttagaaagcatgcaaggaatcgagtctggcattaagtgccccactcgatctcgcctttaggagaagatataccctcgataagttgtcaa

SEQ ID NO: 639850 - DNA, 130 bp, Homo sapiens
  misc_feature (21)..(21): n is a, c, g, or t
ccttggttggatacagcaccnatccccgctagataccatgatgcccttcgctgctcaagtggccaactctggcctgagtgacagcctgaccaccagcaccccccggccctccaacggtgcgttggcccaa

SEQ ID NO: 639851 - DNA, 158 bp, Homo sapiens
taggcggagcatgtccgaacactacacagacacacatgcacacacagcacacacgcatgcacagcacacagtgaacacagcacacacacatacacacagcacacacgctgcgacacacacctacacacactccatgcgcagccccatacgcaaaacaa

SEQ ID NO: 639852 - DNA, 351 bp, Homo sapiens
ggacccgcggtatgtcttacggaaatgttgtgacgtagtttggcttcttttgacaccattaagatttctccatatcagcaataagactgtttagctttcttattattcatgtgtttgctgggttagcacttttaatctccttccagaacttttcctttgcatctacaacttggctgtttggcacaagaggcttagtttttgtcgtatcttggctcttgatatgccttcttcactgagctcatttctaacttttgattttaagtgtgagatgtgtgactatcattcatttgaatatgtagaggccactgtagggttgttaattggcctaactttaatatttttgtaattcag

SEQ ID NO: 639853 - DNA, 535 bp, Homo sapiens
  misc_feature (1)..(1): n is a, c, g, or t
  misc_feature (27)..(27): n is a, c, g, or t
  misc_feature (33)..(33): n is a, c, g, or t
  misc_feature (52)..(52): n is a, c, g, or t
  misc_feature (59)..(59): n is a, c, g, or t
  misc_feature (80)..(80): n is a, c, g, or t
  misc_feature (95)..(95): n is a, c, g, or t
  misc_feature (135)..(135): n is a, c, g, or t
  misc_feature (201)..(201): n is a, c, g, or t
  misc_feature (206)..(206): n is a, c, g, or t
nccagcctgccaacatggtaaaccccntttttncttaaccatccaaaatcancggggcntgtggcgaaggctgcattccnagttactcagaaggntaagccagaagaatcgcttgaacccagaaggtgaaggttncagtgagccgagattgcgccactgcactccagcctgggcgacagagtgagactccatctaaaaaancaaancaaacaaatacacccctcattagttaaggataaagatgaggggggcctgtcgcggtggctcacgcctgtaatcccagcactttgggaggccaaggcgggcagatcacaaggtcaagatatcaagaccatcctggccagcatggtgaaaccctgtctctactaaaaaaaaaaaatacaaaaattagctgggcatggtggcgcactcctgtagtcccagctactcgggagggtgaggcaggagaattgcttgaacccgggaggcagaggttgcagtgagccgagatcgcgccactgcactccagcctggcaacagagtgagactccgtctc

SEQ ID NO: 639854 - DNA, 296 bp, Homo sapiens
tgctgggattacaggcctgaaccaccatccctgacccaactatagtttcttaaaaaaaactctttttaaccttgccttatatgtaagggtagaaggatggctcagagcttcaaagagcaggactagcctaagacctgtctgtgataatttgaccagaggtgcagcctagctagccattcttcctcaccctgtggcagacattcacgggagactgcacgtagctgtagaattacctttggggaagaagccacttggtgaacttggcacacacccgtgtttgaggggcaaagaccctg

SEQ ID NO: 639855 - DNA, 408 bp, Homo sapiens
  misc_feature (8)..(8): n is a, c, g, or t
  misc_feature (127)..(127): n is a, c, g, or t
  misc_feature (158)..(158): n is a, c, g, or t
  misc_feature (260)..(260): n is a, c, g, or t
  misc_feature (285)..(285): n is a, c, g, or t
  misc_feature (316)..(316): n is a, c, g, or t
  misc_feature (379)..(379): n is a, c, g, or t
ctccttgntgcacgatggcctcgctccgggtggagcgcgccggcgcgcccgcgtctccctaggacccgagtcgggcggccggcagcgctccgcctcctccttctgctgggcgctgtcctgaatctcnacgaggctctggctcattctcttcccaccanaggcacaccatgggtcagaaggccttatagcatctctgcgatattgtctggagcaatttgcagagttgtttgatctgggcttcccaatcccttggcagatangattatctttgatactcatcagatntactttgcaactgctctctggtgcagcgcancttctctgtacccccagatgatgtactcctggccatgatcatagcccccatctgcctcatatncttcctcatcactcttgtagtatggtgga

SEQ ID NO: 639856 - DNA, 281 bp, Homo sapiens
  misc_feature (63)..(63): n is a, c, g, or t
  misc_feature (109)..(109): n is a, c, g, or t
  misc_feature (133)..(133): n is a, c, g, or t
  misc_feature (185)..(185): n is a, c, g, or t
agccacccacagctgatatctccctggtgctatccccaaaccgccactctcaactcttaaagnaaataaatcatctttgctggcagggctatgctgaacctccttaggnactctctaattggatgtcctgggncctcccaattcttagtcctttaatacctgtttttctccttgtcttattccgntcttttttcaattcatacaaaattgtatccaggccatcaccaatacttatataggacaattgtttcttctaacaaccccacaatatcaccccttac

SEQ ID NO: 639857 - DNA, 85 bp, Homo sapiens
gtgaatagcagaagctttctgtttattcacagtccagtaataataatacccgcagcacaaagcatacgtcttttctatacaaagc

SEQ ID NO: 639858 - DNA, 167 bp, Homo sapiens
atgtgaccttgccgtgcagtgtaggagacacggccatgtgtatcacagatgcgatgcgtgtcactgatttcatcctctaagttgccgcacagtgcccaccaaaggtctgtccgacaagcctggcagaaggcagacatcaatactcattacagccaggggataccgag

SEQ ID NO: 639859 - DNA, 387 bp, Homo sapiens
  misc_feature (114)..(114): n is a, c, g, or t
  misc_feature (135)..(136): n is a, c, g, or t
  misc_feature (213)..(213): n is a, c, g, or t
aatatcaacaaaaaaatgaagataaaaaaaataaaaagctacgtaagaaacatatgttgttcctttagtggttaagccggggagaaagaattattctttctttatttgagcatntaaacatgggttggtcctagnncaagataaacttgagtttaggatttttgctcggtgagctcaagagccccttgaaggtagagggaaaaactttgctcnaaggtatcaggcagaagggaggttctttgtcctctactatagccctctatcaaccattaatggggttttgtacaatccaattaaaccggcagtttggaaatgacgccaggggtacccggagcctccaaattccggtaatccattggtccataagccttgtttccctggtgtttg

SEQ ID NO: 639860 - DNA, 1571 bp, Homo sapiens
cacgaggagcatttgcccaggtggagagcagcctgctatgaaatccagctcccttccttgctgggacttgatgcctgacatcagtcagtcagtactggatgcatccctgcttcagaaacagatcatgctgggcttttctcctgccccaggtgctgacagctcacagtgctggagcctgccagctatagttagaccagagtttcccagacagagtgtggcagtacccctcgggaatttccgggaaaatggattctgtaccagggctatagtgctgcatatcaagaacacctcggagtgacttatttaaccctctcagaagaccctagtcctcgagtaattatccacaatagatgtccagtaaaaatgcttataaaggaaaacattaaagatattccaaagtttgaggtttattgcaaaaaaattccctccgagtgctcaattcatcatgagctgtatcatcagatttccagttatccggactgcaagaccaaagacttacttccaagcctacttttgagagttgaacctctagatgaagtaacaactgagtggagtgatgccattgacatcaacagtcagggaacacaggttgtgttcctgactggctttggctatgtgtatgtggatgttgtacatcagtgtggcacagtcttcatcactgtggccccagaaggaaaagcaggacctattttaatcaataccaacagagcgccagagaagattgttacatttaaaatgttcatcactcagttaagcctggcagtgtttgatgacctcacccaccacaaagcatcagctgagcttctgagactcacactggacaacatttttctctgtgtggccccgggagctggtcccctccctggggaagagcctgtggctgcgttgtttgaactttactgtgtggagatctgctgtggggacctgcagctagacaaccagctttataacaagtccaatttccactttgctgtcttagtctgccagggagaaaaagcagaacccattcagtgttccaaaatgcagagtctcctcatatccaacaaagagttggaagaatacaaggaaaaatgttttatcaaactttgcatcaccttaaatgaaggcaagagcatcctctgtgatattaatgagttcagctttgaattaaaacctgctcggttatacgtggaagacacatttgtatactacatcaagactttgtttgacacctaccttcctaacagcaggttggctggtcactccacacacctctccgggggtaaacaggtgttgcccatgcaggtcacacagcacgccagggccttggtgaatcctgtgaagttacggaaactggtgatccagccagtaaatttgctcgtcagcatccacgcttccctcaagctgtacatagcctcagaccacactcctctctccttctcggtgtttgaaagaggacccatcttcaccactgcgaggcagcttgtgcacgccctggcaatgcactatgccgctggggccctttttagagcaggtaagaacacaagctgagggtctgtgatgagctagagcccgggtagcccttaaactgg

SEQ ID NO: 639861 - DNA, 251 bp, Homo sapiens
gcggctgcctttttttggagatggttttctcgatggggggcgcttcgtgctggtctgtacgacgagctcaagaaggtgatctaagggccgcggcggctccaacacacacacacccgaggggaaccaagagaaccacgtagaatcctcaagcgtgcggaccatcaaccttcgagaaattccagttgtctttttcccagccgcatcctgcctgtagatggccgggaaaggctctcaaaaaagggggggccgtt

SEQ ID NO: 639862 - DNA, 629 bp, Homo sapiens
aatcgaggggcttttttgatggtctgttaaacggagattgagtgtctgctttcggggaaacgtgagcctttccccccccagggccgttttagtgaggagtctgttgctggccccccccgctgggctgtgcgtggctcaaaacagaacacctcgcgtgattcgcggacgcggctgaaaaaagctgggttcctgtctacaaggcgccgtggttaagagttggtgcgacccgtcccacgatagctccactttggtgcaggaagatttccccgcccccaccgtgcgagcgctatgcaaaattctcctcctcggggggaaccccgaggtctttgggcggggattcaaacaccacccgtctcggggggggacaccccttttctgggaacaacaggggtgaccagacacacaaaggtaatgtcgtgaacgcccagtcgtcacccccggaaggggggttcccccacgctaacacgaggcagggctcacaaatacagtgtcgcggccccgacccagtgcccgaaaaacatacaactggcaaaaaaggggcaccacgggtggcaaaatgaaacggggaggatgttcaccctattcattggggaccccaaacaaaattttatttcccccgaacaaaacaa

SEQ ID NO: 639863 - DNA, 193 bp, Homo sapiens
gcgccctgcagcagccgcggacccgagtggatcggggacggagagagcacgagcccatcagacgcagtggtgaagaaagggacagaaggaccagaagatcaacaaacgttctttgaagagctggccgtagaagataaacaggctggggaagaagagaaagtgctcaaggtagaaggagcagcagcagcagcaa

SEQ ID NO: 639864 - DNA, 165 bp, Homo sapiens
ctctacaatttcgctcgaaacagaataataccctgaaggaggcctgtacctggctgtgaccctggttggcaggcatctactggagtttgtcatcacgtctgtcccgtcattttaattatcacttcctccaccaaaaccatccggaggtcttactttgaagccacg

SEQ ID NO: 639865 - DNA, 448 bp, Homo sapiens
  misc_feature (397)..(397): n is a, c, g, or t
  misc_feature (448)..(448): n is a, c, g, or t
tggtggtggtaagaagacttaacagcacaaccctctcaggaaattttgaagtattcaacacagtattgttaattacaggcactatggtgtacagtagatctctaggccttactcggcttgcataactgaaactttgtgccctttgcctaataattccccatttccccctcccaggacgaatctataggatattacactgaagtgaaataagacacagaaggacaaacactacatgatgccactagtatgagaaatctaaaatagtcaaaactcataggagcagagagtagaacagtggttggccttgtcccccttcttgatactcagccaaggagagaaagggccaggcttccagcagtcatgtgggcaggggcttttatggagcatcctggattcntttgcccttgtactgccctctctctacctactcgtaatcctcctgaggctn

SEQ ID NO: 639866 - DNA, 700 bp, Homo sapiens
ggcgacccaggtttgccagctgaggagccgagggagaagtcctctcgagaaggtagaccgtagccaggagctgatgggaacctcgctgatggtcacctgcatagcctaccaacaccagataccgatgacaggcatctcccgcagaacctgggtgatccccgtggtcttggctgcagcccccagtacctcacccgctgctgcagctcattagtgggccaacatatgctgtccgtccagcagttcaacaaggatcagatgtctcacctgttcaatgtgggcacagacactgcgtatgatggctgcagaaggagcggagcctcgacatcctgaaggggaaggtcgatggccgtccagtgttctatgaaggtgagcacacaggaccagctagctcctttgcagcagccatggtccggctgggaggtgctgtgctcagtcttctcggaagccacatcgtccgtccagaagggcgaatcccgtggcatgactccgatgcagaccatgagctgctatgccgacgtcggtcgtgctccggaacccccagcctggagcagtggagctggccgccaagcactgccggaggccagtgatcaatgctggggatggggtcggagagcagcccagccaggccctgctggacatcttcaccatccgtgaggagctgggaactgtcaatggcatgacgatcacgatggtgggtgac

SEQ ID NO: 639867 - DNA, 461 bp, Homo sapiens
tgagtagctgggactactgcagatgcatcactacacccagctaatttttactttttgtagagactcaaactcctggccttaagctatcatcctgcctcagcttcccaaagtactgggattacaggcatgagccacagtgcccagcccccactaggtttttgaatctgtctggctgtgatatgattttcatgcagaaacacctagactatgggataaatgcctacaataaacaactagagaagctggagatgggatgaagaatccaggccacgtgctctttcttacccttgtgggatttttgcctgggcaagaagaagacacatttttaatgtctctgttttgaaatgaacataactcacctgatgtatgatctttaggttataattaggtttgctttttctgtgaactacattctgccttcaaatgcttcaatccatctgatgtgctggcaggcgggggcg

SEQ ID NO: 639868 - DNA, 110 bp, Homo sapiens
ccagggtggggctggggctggagacgacgagtaggaggattaagtccccctgtccctcctgggatgatggattgtctcgttttcctgccaaataaacaggatcagcgcca

SEQ ID NO: 639869 - DNA, 317 bp, Homo sapiens
gacggttataaacccaaaacggaaaaccgagtttgtttacacttttaggcttgaatccctaaccgagctttctctgtggactactgctagagttagctttctaagtaaagcgtgcggttatctcattccatgctaaacaaacaattctattaaccttcgggattaaataaatctaaccaaacccttagcttgtgacagtgccagccctcaatgctgaagaagcctagcgatgcttctgtacctagaatgcttttcgctttggtttctagatttgaaactcaagagattccaaactccgccctcttaccagggtcccg

SEQ ID NO: 639870 - DNA, 248 bp, Homo sapiens
ttgcttctgtggtactcctcccctcagaacaaaattataagagtatagcctctgaggccaggcgcggtggctcatgcctgccatcccacccacactgggaggccgaggtgggtggatcatctgaggccaggtgttcgagaccaccctggccaacctggtgaaaccccgtctctaccaaaaatacaaaaaaaaccagccgagaattgtggtaggtgcctgtaatcccagctactcaggaggccgccaga

SEQ ID NO: 639871 - DNA, 1100 bp, Homo sapiens
tattaaattcgtgtttaatttataaaaaattacagcaacaattatcaaagacaacattatgtgttacaaacgtttttagacaaacaagaacgattaccacatatcaggtggcagataagggcaagctgagagaataaatagacgtgagttcccgggcaagtgtctggtcctcaaagacattccaaagcgtggcgttcaggcagcttgaaacaggcttcttttcccaggtgacaagcaatatggtggctcagataattacaaacgagtggttaaagtgagggtacatacattaggcccagtgttaacaaacttcctctttcttccctgcgggttaggccagtgattacaagtgtggaagctcattcaaaataattgttaaacccaaggggattaacaaggcctattttccacatcttaaacctcatttataagcccttgtcacaatgtgtgtcgccaagtgggaattcaggtataactgtggcaaaagcgaatccccggggtgtgtggtcaatacgagaaatacgtgggtatattatacgcagcatatatagggcatagtgccaaatcccttataccttcagtgttgggccccaagtctcagggggttaccgtgggtaagtgttgggaacgcggaacaggggggcaataacaattttacgacaacgttggctttccctttcaaaggaccacgaaactggttgacgcacaacagacaaggggaaaaaccccccttgaggcccaggggactcctaatataagaccccgtgtgtgggttgtggccgccaaaaaggcggcacggggggaaacgggcccagcgacactctctgaaaaagggggagtaaaaaccggggtctcccctttatgggggccaggaaggggaaactcccggggaaaagcgggtgggaacaccccaagcttgggggatccctgtgggaacagcaataaaccgcgaaataccgggggaaaacacacccaaacgagagaaaatatacacctgatgaggtcccccgaagcgagggaaatacacacaatcaaaaaagggccacggaggagcaaccacaatatcgacaaaaaaatatgcgcccccaaaagataccacg

SEQ ID NO: 639872 - DNA, 271 bp, Homo sapiens
tccagaggatcccggtgttccctttgtcttatgaaaaatctgttgagaaatatttaataggctgggcgcggtggctcacgcctgtaatccctgcactttgggaggctgagacaggcggatcacaaggtcaggagatcaagaccattctggccaacacggtgaaaccctgtctctacaaaaaatacaaaaaaattagccgggcgcagtggcgggcacctgtagtcccagctactcaggaggctgaggcaggagaatggcttgaacctgggag

SEQ ID NO: 639873 - DNA, 1031 bp, Homo sapiens
gctcttgggcggctaataagtaaattaatagacaggtaatcctggcacagaaccaggcaagcagccaaagcccgtttgtcagtcttgaagctcttctcttgccatggtgtgaggacttcatgcatcttacgagtcagtcgacgagatagcacgactggaggacttgtagatcaatgtctagcaagcaggagcagagaagtaacaggttgagagtaatgtccgttggtgtaggcaagattctcgaggcatagagaacagtaaagatcgtagattaagttcttaggggtaactcgatcgtggacttggaacgtcgtagttggtgttactcgtcgttacgtaagactggtgcgtttctagttcatcgtagtacgactaagaagccttgaagcacgcaaacgtggtggctctcttagaacgctaattggcgcacgactatacggccgtttgcgactggtcatacgccgtcgtgggccctcttcagtggcgcagaccgttaaagcttggtaaccgagagagtcatcgacagccataggcacacacgtgtcgtggcggtctctgctacacgacaaacacttgcattcatcagtcatccatcattcaacactttccgcacaaacgcgtggcgcatatttcgtcgccgacaatgccgaaaattcgcttacaggaaaacgttagggcggcctactcggaagttggttcccttcaagcccaacgcttttcttgcacactgggggtctcattcctgaaattaagtctcttcagaagtggaaagtaaaggttgtccccgtgggacagccatctttggaccaccctgggatctaaattccacttcccggcgagttaaacgcaacacatttcctggcgactcacgttttggcacaaggttcattacaagttccctgcattacatttgtgcccctggggggtctaaggcaacggaaaacatgggcccaagggggaaaagcagcacggcacatgggcttccgcagggggatatacacaattagagccattttacacaaagacgcaag

SEQ ID NO: 639874 - DNA, 336 bp, Homo sapiens
cgatggaatgtgtaatttaaagtataaatctcagctgggcacagtggctcatgcctggttgagaccagcctggacaacataatgagaactgtctctactgaaaatgttaaatattatctgggagtggtggtgcatgcctgtagtcccagccataggggaggctgaggcatgaggatcaattgagcccagtaggtggaggctgcagtgagccatgatcttgccactgcactccagcctgggcaacagagagaaactctgtctcacataaaataaaataaaaggaaactcttctcttaaaaaaaataattataaagttagtatcatagaaaatatctg

SEQ ID NO: 639875 - DNA, 603 bp, Homo sapiens
  misc_feature (212)..(212): n is a, c, g, or t
  misc_feature (305)..(305): n is a, c, g, or t
tgccggaaccccaaaaaacctgtgtcttcctggaacagaccctcttccgtggtgcccaaagttctaatctattttttttgagaaatgaggaagcccgtgcccctttttctgttgaaaaaaacaagccccataccccctcggggcaaaaaatctccatgcttggtaaacgaatagatccaacactctattttaatctttggatccatcccacngatagcatttgaggggcaataccgacaacgccagaaccggttaggtgctaatcatggcacctcactgggaaccacaaagtttttaagcatccncaatataaaggagccaattaattttcataggattgtgaagcataccaaacgttgaattaggtgctggccatgtgacctcttaggtaaaatccaaattttgagatgaccgcaataataggtatggtaagatgtttcattttgtgccgttattaaactatgagttactctgccgggccagggggctgcttcttataccatcatcttgatcatgacctcataatcttccgctttgaagaagtgattgttattcgttcaacgtgaaaacagttatggaactttcacaagctatcattcccag

SEQ ID NO: 639876 - DNA, 1164 bp, Homo sapiens
  misc_feature (171)..(171): n is a, c, g, or t
  misc_feature (341)..(341): n is a, c, g, or t
  misc_feature (542)..(542): n is a, c, g, or t
atacagttccggtgggagaacgcggctgcgaggttttcggctttggctcctgatatgcagcgacagaattttcggcccccaactcctccttaccctggtccgggtggaggaggttggggtagcggaagcagcttccggggaaccccgggcgggggcggaccacggccgccntcccctcgagacgggtacgggagtccgcaccacacgccgccgtacgggccccggtctaggccgtacgggagcagtcactctccgcgacacggcggcagcttcccggggggccggttcgggtctccgtcccctggcggctaccctggctcctactccaggtcccccgcggngtcccagcagcaattcggctactccccagggcagcagcagacccacccccagggttctccaaggacatctacaccatttggatcagggcgtgttagagaaaaaagaatgtctaatgagttggaaaattatttcaagccttcaatgcttgaagatccttgggctggcctagaaccagtatctgaagggatataagccaacantacagcaatacttaaacaatcacaggcaaaaaaggaagatacctttgctaacatttctgaaattaactgcaagctcatgtgtcaggacatttggacaaaactttaggtgggttggataaattacccaaagatgtgacctggatggataatagtaaggctttgggattttaatggacaggattgtgaattagggaaaaagtggtaacttgcacattaagcttggaggcctaccctttttagggttaccggttcatatcttaaacattccggttccaaaggccattggcctttaaggtttttcagggttaacataaacatttgctcttttaaacaaacacctcacaaaaaaagttcggcctcttgccaacggttttgcctggcacgttacgtcggccgacatgggcctttggcaatgcctcatgggagtgcttcattacgggcgcgttaaacgccggtcgcaaaccccgggccccattaatgcctgggacaaccctttcgccgcgcctatagcaagcctccccgtgcttctcaaattccgaccatcgcccgcctttgagctcaattctgccgctaatcttcctccctcttttccaaggcagcagcactctcttcacattccgcc

SEQ ID NO: 639877 - DNA, 307 bp, Homo sapiens
  misc_feature (150)..(150): n is a, c, g, or t
gctgggtgatctagaggatcccgagctctctctgtggggtgaccgctctccgtggggtgacgctctctctgtggggtgacgctctctctgtggggtgacgctctctctgtggggtgacgctctctcggtgggggatgacctgattacctngcgaaataatggatgaacatctcacagacaaattcctctagactagtcaacgttctgactccagcgtgtgtccaactccagcagtcagccaagtttggccccatgcatttcctggcccccatcccatggggcccccacagagcagcagcgtcgggtc

SEQ ID NO: 639878 - DNA, 543 bp, Homo sapiens
tcataaagtattgaattttgtcagatgctttttctccatctgtcgagatgatagtatgattcttgtcctttattatagtgatacagtatattacattgtttctcatatattgaaccgaccttgcattcatggggcaaattctacttgttcatggtgtataatcctttttctatgctgctggctttggtttgctaggattttgcatctgtattcatgagggatattgggctgtagtctttttgtgatgtctttagctttagtcacgtcactactgacctcatagattgaggtgggaagtgttccctcccctcctattttttggaagagtttgtgaaagattgttgttaattatttaaacatttggtggaatttaccagtgaaggctgggcttttctttgtgggatttttttccctaattcagtatcttcatttattatagatctgtttagttccagtagtttgcatctttccaggagtttgtccctttctaggttctttgttgcaatctgttcatatataatggttcatagcattaaaaaaaaa

SEQ ID NO: 639879 - DNA, 150 bp, Homo sapiens
agcagactgtcaaggaaaataaacccccctctgctgagtaattagagatagagaagcctacgaaaataactggctatgcgcctaccatgatttccagcattccagggtttccatacccattacaatttccagcattccccctcaacccta

SEQ ID NO: 639880 - DNA, 298 bp, Homo sapiens
ccgccaccacgctggctaattttttgtatttttggtagagacggggtttcgccgtgttggccaggatggtctcgatctcctgaccttgtaatccgccagcctcggcctcccaaagtgctgggattacaggtgtgagccaccgcacctggcaaaatgctgttctttaagtcagcgaactgaaaaagtaaaagactgctgggtgtggtggctcacacctgtgatcccaacactttgagaggctgagggggaaggttcacccgaggtcaggagtttgagaccagcctggtcggcatggcga

SEQ ID NO: 639881 - DNA, 345 bp, Homo sapiens
gacctcaagtgatcttcccgcctcagcctcccaaagtgctaggattacaggtgtgaacgactgcgtccagccgaaacagccatttctatgatcagtgtgtgaacaacctgacttgttcctggatgcagagatgctcacagatggagaatcacggagccacaatgcatctgtgtgaaacaggaaaaaaactatgaggatgtctgccagttgaaggaggtaaactctcagacgaactctagtagtggcatgaaacataaaggcccttgtgattcaggtaatacagaatctgcacaccattcaattcttactaaagaataaaagatacagatgtctgcaaaaaaaaaa

SEQ ID NO: 639882 - DNA, 1831 bp, Homo sapiens
  misc_feature (132)..(132): n is a, c, g, or t
ctactggctgagtcctttgggcgttgacgggagatgcgtgagctaggtcgcgaggtggaggcgagcactgtcttgtggtaggcggaccttgtggctcgggactaaactgggaggggtggtcgccgtccccantcagtccatttcctgtgcatgggctgtcttcacagaccacatggtgtacacagggagaggtatgggggaggggacacagagtgagaataggatagcatctgattgcctgagaaccctctcctagacactgctcaaatgcgtggtatatgaatggggactgagcgctgggctactcagcaacgagcagatgcatcctcccatcggtagacgggcacgatctagtatcgcccaagctccgagggtaccatctttactctcagatctactgtagtatgtggacctcctgggcaaggatttctcaatagtaattttactgtgacctggggcaggataccgttcagtgaggtgcccaggagactgcatcccgtttcctccatttccacataccccacatctccatcaagcaccaggggtctgagttcgtagcagggtcctgggggtatcccaactgctatagctgtaactactgctgcccctcagtaatctgaggtgtctcaagtttaaaacttgaaggtccttgatgaccaatagactggtgagagcgggacaggagcttattcccccaggacactggtttataccattcacataccatggctgtgttccgacagctccaaacgggtacgagaagccaatcccaatggcagaattcttcaaatccctgcgttttgaagttttgttcaccccttcattatccgggcctgcaacccggtggacatcggctggggacctgggggtcagagaatcgggaaaaaccgctgtaggacaatacgcccatatgtggccacacatagctcgtaaacaaggtcccccacagacgcaggatagatacagcaaatctcgccactgtgatgtgtgtagcattaaacaacagcggcgtcaacacagcacgacgacaccaacacaccagcacacaacaccgaaccaccgaacagcaaccacacgacctagacaacaaccacgaagacaacacgcaggcaagcaagggccaggacaacgaaagacaggggaacgcggaggacgagacgaacaagcgagagaacgcagaccgaggacggggatgcccacgcgcacgaggaagaagaggggagcggagaagaggaggggagggcggcggagggacgggaggagaacaacgacggggaggcgggacagacgcagagcgaagcaggcgagggagagcagagcggggccagggccgacagagacgcagaggcagaccgggaccaggcgagcccgaggggccaggagggcggagaggcgagaagcagtcacagcaacaagaaggcaaaagcaggaggcgagaacgaggaaggagaagacaggcgagacgggggaggggacgagggccgaaaggggcgcggggaaggacagagaggacaggagaagagaggagagggagaaggagaaccgagacaggaacagcggggcaagacggagagcagagggacggggagagcacaggagcagcgcgagaggagaggacagcaggaagagagagccaagaaagagagccagcggggagcgaagcaggacaagaaaggagcggcagcagagggagcgcgagagcgcgagggagagcaggcaggcgagggagaggagagaggaggaagagtagagagagagcacgacggacgagcagcgaagacgggagcggaagccgcgaggggaacacagcgcgaggcaagaggcgaggcac

SEQ ID NO: 639883 - DNA, 828 bp, Homo sapiens
ccactgggggcccccccccccttgcgggcccctctggtgaattcccggcccccccaatccacggaggttcttcacggcctttccgtggccgcatcatgggaattgtcgccgccgctttctctctgcatgaatggctgcccctcagtattctctccggcgtgcttcaccgggcagttccccccgcgtgtgtgtctcactgcgctctcctctccagggggggcagcacacctcaggggtgggctccatgggatagtactcctggacgagattgtagggaaagccactccgctgtccagttatgtgtcttggaaacacctttttgcacccccgggagcagggctccccccgttcctggtgggaacatatgaccacacggtgggttcacgctcttctcgcgacggtccattggctctctctctcgaccacctgagctcgcctgtcccctcgcttttgtcgccacccccccgtcaccaagatagagtccccttgggtcgcctcccccggtgagagagagtctcttcgatctccccaggcagaccctgcgccactgatgacgcccgagagcactagggaccaggcttcttataccccacgcaagagtgtttcacactttgtgtgagattgcccctcctccccccctccctgcctacttcaggtttgctttttatgccaaaccaacagtctgctcgtacgctatgctcctcgattgcactgccatgcatgctgttacccacgattatttgtctgctgaccaaccgctgggaaaatgcttcatcacccgcgaggatacgcaaacacacaaaaaattctattctgtccccaaaacaa

SEQ ID NO: 639884 - DNA, 353 bp, Homo sapiens
accaaggagcctgagtgggatttgcccaccactggacagccaggctcccgtcaggaaggcttttcagagggagtgttggaaggagtcgtcgaggagtcttcctcacccaggaagtcttcctcaccgggtgagccccaacctgctggacctgctcagaatttgcccaacaggggatcctggttgactgaggtctgctaattccaactggcctacgctaaattctcccagaatgtcttcatcatcaatgaatcgctttccactgacacgacgcctggaagaacataaacactgtgaggataaatgccaatgaaataataataaaataaactttctttggtggccagagggaaaaa

SEQ ID NO: 639885 - DNA, 378 bp, Homo sapiens
aggattcggcacgaggagagagagagagagagagattgagacacacccactccctaaccggcgcgctcttcgcaccgcttaaaacatgctcccaccctcttaatacattacaccagtgctaacttcacacctttttacccacacgtccatataaaactacgagtcatctccttagcccatctcttgaaccgcacaccacttattgcggttcttacgatcacatttccaccccaacgctctccttcccataactctgcttaacacaccctccatcactatcctctcctatatcccagctcccaattccttcttctgtaactttcctgcacgcttttttttgtagcttactggttggtttggccactagactgcagggcg

SEQ ID NO: 639886 - DNA, 216 bp, Homo sapiens
aatagaatcgagccggtaccgaattcgacaagtgtgcaaaaggtcaagtgtcattctacccataagaggtaccgagagtagtcaaatttatagggacagaaagaatggtggctgccaggggctggggaaaggaagaatggggaatgagtgtttcatggggacagagcttcgattgggggagatgagaaagttctggagatggatggtggtggtggc

SEQ ID NO: 639887 - DNA, 134 bp, Homo sapiens
  misc_feature (53)..(53): n is a, c, g, or t
tgctctagaggtcccgaagcacagaggaggggcggggctgggggggaccactncgcctgtccgtcgtccgtacgtcagtctgccctgcccggcctctggctgggctcagtccttccagtccttcttgctgtcca

SEQ ID NO: 639888 - DNA, 340 bp, Homo sapiens
acggttcgcacggctgcgatgcgcgcgcatgcgatgccgagcggcagacccgcgacgagtgcggcggcgaccgagccgcccgcgagcgatacatgacggagcgcttcgcgccagaagtcgtcgctgcgcacctcgtattcgcgcatcacggagaggccgtcccaccagccgcttgcgagcggcacggaaatcgctgcaatggcgacgacgagtgcgacgaggcgccgccacgggccgaacgcgaggcgggcgagcgcgtcggcgatgagcacggcccatgcgaacagcagcagccagacacccgcatcgggcgagacgcgggccagcatgtcgtcgggtg

SEQ ID NO: 639889 - DNA, 416 bp, Homo sapiens
tatgtatctacctggatgacagagcgagacccgtctctaaaataaaaagggaaaaaaaacttacactgtctttttaatactaggaaagctccttgagattagaaattgggtggtgttttttcttaccgttttggtttattaattttttaacttaaaatattaatgtaatggaagaaatcactttggagggaatttaaaactaaaatggattcctactggattatggtattaagacttgtggtattacctgtaatgccataaaaaggcatgtgagggatcactggcccaattgattatgtttcaaatgggggaataaagaagctagaaaaaacaataccgggccacattgtgccatattttaacctttttagggtttaccatattgagttaacctgatacacctaattgaagccagc

SEQ ID NO: 639890 - DNA, 245 bp, Homo sapiens
  misc_feature (98)..(98): n is a, c, g, or t
  misc_feature (105)..(105): n is a, c, g, or t
  misc_feature (205)..(205): n is a, c, g, or t
tgagctgttaatactattttccactgacaacttgtgcacatcgaggacacagtgtatgtgaagactccgctgaaaacttccaacatcggtgggttttnctttcgnagtcggtttgacaattactttataggaagactcttgacgaatatgaccaccttctaagttgatgaggaatttccctttaagctcgattacatgtggaggngtgtgtcgtgggtgctgagccaggggaggggggtgagaag

SEQ ID NO: 639891 - DNA, 213 bp, Homo sapiens
agcaattgtgacacctacttgcattgctgtgctcggcccttctatacggtatgctggacgcccccgccaaccacggtgcagccctcgctggcatctttcttgggctcgtagccgccgctcggggaccggtagtgggactcgcacgggtgccgcccgcctctgcaccgtcgctggcgctttggcgcggtgtgcagcggtcccggggcccgtgcg

SEQ ID NO: 639892 - DNA, 693 bp, Homo sapiens
gggttggcgcagggtgccaagagaggcttcgcactacggactgagaggcgtgaggaattgtggggtcgactggatgtggcccatgagggggtcgatggggccaactcacagaaggggactgacagttggccaatactcacatcccactggttgctgttctgaaaccatctgattggctttctgaggctttggctgcgctggggactgctcactttggccatctctgcagcattggtacttgaccacgcgtacctgaagcgctctcgagctgttctgtaaatagctgtgtgctaacatcccatgccgctccctcctcacgagtgcacccaccgcccttgagggcccgtcctacgaatggatgtggggatggctcgctatttgtaagtgtgctggattctctgtgtgttttagctgtacccctctatggctccttaagactttcattttgttgcagaaccatgctgggctagctaaagggtggggacgatgggaagataggccccagcgaggctctcaagagaacgcacctgcgaataaaacatgtcttgtcggccagctgcccagggacggagctacagcagcctctgcgtcctggtccgcagcacctcccgttctccgtggtgacttggcgccgttcctcacatctgtgctccgtgccctcttccctgcctcttcctcgccactgctggcccc

SEQ ID NO: 639893 - DNA, 357 bp, Homo sapiens
tccactagtgtaggccttgtcagacaatggctataaactgaattaggcagtcttaaaaaataaataaaaaccggaatgggaacaaaaggaccgttccaatttggttaaatgcccaaaagggccggtttattttggaccagattatgcttacctaaggttttttaagggcgcttgaaggcccttttttcaataaaacctttattttcttttaactggggcaagggaatctttttgaggttttaaaaaaccgggaaaaataacttgcaatctttttggccgtaaatattcaggggttttgagaatggggggataacaaagaaaaatcttctctgggaaataaaagacctgtttttacag

SEQ ID NO: 639894 - DNA, 84 bp, Homo sapiens
cggacttgcagctggagcggatcagcgtctactacaacgaggcctcttctcacaagtacgtgcctcgagccattctggtggacc

SEQ ID NO: 639895 - DNA, 653 bp, Homo sapiens
gagtcgactagaggatcccccatgtgggcatcacggtgtcaacataacagtgggcacattcatggtctcagactatctagtggactgagagtgaagacgaaaagtggaacacctagaaaaaacggccaaatctcaaggacaaagactccaggcctgcattggagtaggagggttaatgaagttacaatcttctggttattcaatcaacaagtagttattaaacattcttgtgacctagtctcaagtggacatttccccagcactgcagccaaaataaaaatgtcagtccaaaaaagggaagaggagtgaatgacagaaaaaggacaggatgaggagctcaagtgatccccccacttcagcctgccgagtacctgggaccaccggtgcatgctaccatgccccagctaatttttggtattttgggtacagatggagtttcaccgtgttgcccaggctggtctcaaactcctgagctcaagcgatcggcccacctcgggctcccaaaatgctgggattgcaaggcatgagccagtgcacctggcctatatcttcttcagtgccttttaatttttggcagtcaagtggagcgtaaacagtagctgtatggtctgatatgcattcctgattcagatacgggaagtatcctcatatgt

SEQ ID NO: 639896 - DNA, 188 bp, Homo sapiens
acccggggttttccttgtttttttttcctttttttaggtgaaggttatgggggaaatacccgtgttccgttttgaaccataatagtttgtttattccacatttggaggatattcttttttgttgtactcctgtttcaaagggtattcaagtaggttttccggaatatagaaatggaatttttcttcca

SEQ ID NO: 639897 - DNA, 287 bp, Homo sapiens
acgacagaagatagggttttgccttattcaatcgatgaatcaattctggatgtcacagatacatgggagtttttttggtgattcaccagaatccgtagcgcgacaaattcaaattcgtgtacgtcgcgaaacaggaatctacttatcagtcggcatcggtgattcacctgttttagctaaaatcgcacttgatctggaagccaagaaggcaccaattttgatggctacgtggcactatgaagatgtttctcaaagctttggccagtacttatctcacagacatatgg

SEQ ID NO: 639898 - DNA, 730 bp, Homo sapiens
atcttggctcactgcagcctccgcctcccaggttcaagcaattctgcctcagccctcctgagtggctgggattgcgggcgtgcaccaccacacacggctaatttttgtatttttattagagacagggtttcaccatgttggtcaggctggtcttgagctcctgacctcatgatctgctcatacctgtaatccccgcactttgagaggctgaggtggacagattaacttgaagtcagtagtttgagactagcctggccagcatggtgaaactccgtctctattaaaaataagccggacatggtggcatgtgcctgtaatcccagctactttggaggctgaggcagtaggatcatttgaacctgagaggcggaggttgcagtgagcggagatcagataaaactaaatggataaaaagaaaaaactaaagccagaaaggaaaatcggaaggaaggaaggaaaaattattcagataaacctaaatggattaaacgcaaaaactaaacaaacgttacctctgagaccttgttaccggagagatagtaatgccgagcaggttaacacaaagtactattaatcatttgggctatgttaccacattgttcctttctaagcttggaataccccttctggggacctttactatacggttggataccactttaggcaaggtactactggcgatcctacaatagtagcttctcggggcgcttttgcccgcagggttcctgcg

SEQ ID NO: 639899 - DNA, 111 bp, Homo sapiens
ggtactctagagatccatacccggatctgggtagaaaaccaacacaatttcatttaaaagacatttgaactctgattttctcatagtgaatatctgagcaatataggttac

SEQ ID NO: 639900 - DNA, 179 bp, Homo sapiens
tagagggtaagagatgggtagaagagtatgcctctgaaaatttattagtttattcttgtggagaataccaagaaaatgtgtattggcccatggctaaatatgatatatgccatttggtatttattggtcccaagtgtcttttggtaagaggagaataaacaattaaggatattcactag

SEQ ID NO: 639901 - DNA, 320 bp, Homo sapiens
tgctgattccgaggattcattcggcagtatttgtctgggcagctagatataccgcggtgggatcaattgggtgagtacccgggaacgacactaccgctatctaggcatgcaatacattgttcgcccttcacccgtgtagacatagattggtaaatccagagttacgacatgatcccgtggttgccccagttgggtgacaggagtatttagagtcgtggttgcttgtggtatcgatgaataccccactctcatcccaggccccattcttgactcgaatgtactcatgaatgttacataaagcatcctgtttgcggttatcg

SEQ ID NO: 639902 - DNA, 114 bp, Homo sapiens
  misc_feature (48)..(48): n is a, c, g, or t
  misc_feature (81)..(81): n is a, c, g, or t
tcaatgaccatctgcagtcctctctcccagcccatggtaccagcattngactctttactgtataagggcagcttttatagngttccacatgtaagtgagatcatggggtaccga

SEQ ID NO: 639903 - DNA, 710 bp, Homo sapiens
aggtgttccagagcagtgccaactacgcggagaacttcatccagtagtactcactctccatgcggtggagccggacgcatgtggcgggatggctgatgcatgggtggtggcgcggggcacggccggttctacgtgagaggaggccatccaggctcatcgctcgcatcggtgtcgccgaacgggatcggtcgcttctggttatcggaccgagagtggacactccgtctccatcccctgctgtactccgtgcgatcatttaggagaagatagatcagaagccattggtgcgggatcattctgactagccgagtctacaacccagggggcccctagatggagattgtggtaacctcaaattcgaatcatttctaatggcaggtccttgctccacgaagcctataactgcataaagattttccaagtcagcgatgcactgttggccgaatatgcagttgtgccctgacctgaaagtagaccttggtgttctgggaaagcagccagttttgccttggaacatagtgttcagagccttcacgagtggcagaatgtggattcggtagaagcttatgctacaatgcttgagaagcatctttgatttcagtgcactgaaagaactactttctggggcaaaccgatgaagatccgcattgatgctatgcatggaggttgtgggaaccgcatgtttagaagaactctgggaagaactccgg

SEQ ID NO: 639904 - DNA, 759 bp, Homo sapiens
  misc_feature (590)..(590): n is a, c, g, or t
  misc_feature (592)..(593): n is a, c, g, or t
  misc_feature (596)..(596): n is a, c, g, or t
  misc_feature (603)..(603): n is a, c, g, or t
  misc_feature (613)..(613): n is a, c, g, or t
  misc_feature (616)..(616): n is a, c, g, or t
  misc_feature (619)..(619): n is a, c, g, or t
  misc_feature (623)..(624): n is a, c, g, or t
  misc_feature (669)..(669): n is a, c, g, or t
  misc_feature (689)..(689): n is a, c, g, or t
catggagtcccagtccccagcaaggctccctgtacccatctgttgacattatgtcttgtgcagcatctttgctgaggacacaaggtcacttgtaaacagaggacgagaacgggaaccgagtacaaagccctaagtctattgtaagtgaaaactgagggaattcctgtcttctttagtgagtaatgatccatagatctagatacggtggacatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcattttgttcgtctgtttctgtcccgttttgtttacagatgaggtcttgctgtgttgcccaggctgcagtgcggtggctattcacagatgctatcatagcacactacagcctccaactcttgggctcaagcatcacgcctagcagtttctggttcctttaacagcaaaaggaaagagaggtctgattcttacctcagggttntnnggntgtcatngtttcgtaangtnttngttnngacactgcagagcacaaggctaaggttacagctgagatctttggnaccaaaggcagagcaagcanagcccgttgctgggcccaacactgtcaggcaggtggttctaattcggccctctcataattgccataggta

SEQ ID NO: 639905 - DNA, 328 bp, Homo sapiens
tggctcggtcccagttacggttggctgccacggctcacaccagagggatggggtaggaggcgcattgcagccaggcctgcacagtgttctttcctgcgctcgagtgacggacagtacccgttcattccccactggggaccccaagagtttttcacgatccagtaagggatcccatttttttctccatacccaacagccagtactgcatggtttactatctggagttttatggcaggaagtactggagtagatcccgttctatcatcatgaagtcctgagtcacctcaaaggcaaagctcacagggttgtagagggccacagcctccac

SEQ ID NO: 639906 - DNA, 460 bp, Homo sapiens
  misc_feature (317)..(317): n is a, c, g, or t
ggcttttaaagagtattgaagatgaaagggtttttctttcttttttaaaaaagaaaaacaaactatggattgtagataatgaaaagctagggtttgccgctcttcatggtctactcgtccgttccaaagtagttatatccaagaactgtttttccctgctcccgctacgctgttcccccgcgtattaaaagtagagaacaggcgattgatgtaagtgtacccgctccctgaagataccatgtagaagagttgtgatacaaagagagtagtccttgcgtagtgacacacaactgacttcgtgtaaatcgtggttagancttttcatttaacacctttgggaaagacaatggtacttgtgaaagtgggttcaaccaaacttcacgccaattacccgttttcgtgggagattattgatgggagcttctatagttggtgggtagtgtatccttacgccagagaa

SEQ ID NO: 639907 - DNA, 329 bp, Homo sapiens
aggatgtcacgcacgctcacgtgtattggcaggatagatagactcgctgttgtggtccaggcacgaggtggcacacaccgaccctaatagcatagacatcaggacactgcagtattgaggttagctagtaagagctcgtttaggaaccgagcactggcctatgacatatcactggccagacatggaaggagccgttccaggtgccatctttaccggcaatgaatgacattagctcccaagtacctggggagggcatacactgtctacacactatgaactaaaactcactggttgaaactaggaagccattaagtaacactggtagaacc

SEQ ID NO: 639908 - DNA, 472 bp, Homo sapiens
ttaattcattcaacaaatattttcaatgccagctgtgtctaagcattgttttgtctccagagataccagagtgaacagatataaattcctgctttttcaagcttaaattgatattataaacaaataacatatatattgtgttcattgaatataaaggttaggtagaaaaatcaagtgggggccagacgtggtggctcacgcctgtaatcccagcattttgggaggccgaggcggccagatcacctgagatctggaattcgagaccagcctgaccaatatggagaaaccccatttctactaaaaaaaaaaaaattacccaattagctgggcgtggtgacgcatgcctgtggtcccagctactcgggaggctaaggcaggagaattgcttgaacccgggaggtggaggttgtggtgagctgggattgtgccattgcactccagcctgggcaacaagagcgaaactctgtctcca

SEQ ID NO: 639909 - DNA, 487 bp, Homo sapiens
tacgttgatgggaaggtgattgatcctaaaaggtgccacagccatgaaaacaaaagagccggttaaaaaaatttgtgttggtggactttctccagatacacctgtaagagaaaataagggagtactttggtggttttggtgaggtggaatccatagagctccccatggacaacaagaccaagtaagagtgcgtgggttctgctttattacctttaaggaagaagaaccagtgaagactatcatggcagagaaataccacaatgttggtcttagtaaatgtgaaataaaagtagccatgtcgaaggaacaatatcagcaagcagcaagcagggagcgatctaggaggaggattagcaggaagagctcgtggaagaggtggtgaccatcagagtggttatgggaaggtatccacgcgaggtggtcctcagcatagctacaaaccatactacattattccatttgcaacttatacccaacaggtggtgaa

SEQ ID NO: 639910 - DNA, 1892 bp, Homo sapiens
actgcgttttgttaacgtgtgcctccatgtgtctgttgggtgtttcgtctgtcgccgccttgttagtgtttgtgttaggggaggcgttgccctacggttgcggctgcgttgtgtgggtgggtgagttgtcctgctctcgagctgagtctgttcggtgtggcggacaaggctatagaatgtggtttcgggctgagatggttggtccccccgcggttggtagtctgcccgtcggcaggtcatctgtgtttgtggtcaggagtgctgggtgtgtgattgttagtgaggggcgccccgccgcttcttgtgtacgcttgttgggtgggggtgcatagggagtggtggtgaggtggcaggtagcttgttgtgagcggccagcacactctgtgtgtcaagcagttgcgcagcctgctggtgttcacaagttgctggtagggtggtcccagtggggcgcactttggcctgtggggggtctctctcgttagagtggggatgatctgcgtgcgcccgtagggatgagaagggccgtgggaggcgcccaacataaaggggggattatgtaagtaaggggggggtggccctgagaggggagcaccacaggagaggttgctaagccacaagtccccgatgtgttgtcccctgccaagagggaggcccctcgggcgacaatgttgtcgcccaacgcaagccacccataggggccccacaggggtggcgccgacgaggggtgtgtccgccgcgagagagcaccgctccacgatgtgggtgtgcacgaagcgtgttccgaacgacaccgccggagagcacgcaggggtttgtgtgttgtcagaaaacgtgtgtaggggtagatggcctcccctgcgtgagatagaaccaccgacgtgggggggcccacaaaaagaggtgctcaacggtggtggtgtaagactgttcgcccccgccgatattggggaaatagttggtgtgtgtccgcacgcacaatatatacgcgccccccaacggttgggagataagatgtgtgaaagagggtgatttcttggtgaggtgtaccaccaccctcagaggcgcgcaactatgtgggagatatattattgagagaccccccctcacctgggagtatatgggagagagataatataaatatataataggtgtgtctcaataagggtgcacagcacagtgggggcgttaccacacacacggacaccacccacgtgttttgtgtgccacactacggggtgagaaaggtggtgttttaggacaacacccacagccgtttgaagaaagggaggagataagatattctctacatatgggagaataagagaaaaatctcgagtctcgatcgtcataatatctcacagagttgttatatgtgtgggagatatatagtgaatatatatctctctccttaagagagcgcgctacatatgagaagagatattgtgactcggtgatgttggagaaacgtgtggtgctcctgaaacacccagacacgtgttgtgagggtgtccccgaatataaatactcatgctccaccacggcgcccaaagggagaacatgtttgagaagagatggataatttgttctgcaccacacaccaagcgtgtctacaggagaatatattgtgatatatatggggttatatttatagctgacacatataagagaacaccacgtagaataccacgaagacaccacccatgttgtaccggaatatccaaggatagataaagaggagaaaataggatagttaattggggaccacggaccaatatccacccagatacccccgtgaaaaaagaaataaagctcccacatttttcgcctttgacttagaaaaaaggaccccatagtccaaactggagtttccagaaaagcattagttttatccc

SEQ ID NO: 639911 - DNA, 661 bp, Homo sapiens
  misc_feature (24)..(24): n is a, c, g, or t
ggggcaggtccgcacgcaagtgcngcaggcatcctcgtcgctgccgtccatgcagtcggcgtctgcgtcacagcgcaagcgcaggaggatgcagtggccgctcttgcactggaactggtccatgtcacagcggggggtgcagtctttctcgtccgagccgtccgcgcagtcgtggtctccatcgcatttccagcgccccgcgatgcagcggccgttggcacaggagaactcactctcggagcagggccgaggggctgggaaggacagggggagacaggcccaggagggtgggcacaaggactccaggcctcagtagtgccacagtcccgagcccaaggcccatccccgtgtctctgaaggccacagctgactgacccagaggccgagccagtcctggcagagcccactggctgctcctatggaacagctgggcacaggcgggctcgcacttaccccatgggacagacaccagagaggacacaggtccctggccttgccctcagaacagactgtgtttggggaggggagcgggggcaagaccactgagacaagcaccagggtttggggagaggtcaatcaaggatgatgggtagaggcacagcacagggatgggggtggggggagcgcgccggcgcccgccgggctccccgggggcggccgc

SEQ ID NO: 639912 - DNA, 238 bp, Homo sapiens
ggttccgttaggggtttttgtttttaaacttttttttcccccccctcctgggcaaattccgggggggaatttttttttttaattttagggcccccaaaccattttttggggggaaaaaaaaaaaaatttctgcccggtttttttgtcaggttcccggcccgggcggattgtttataaaccccttttggaaaaaatttttttttgggggggaattaattccgggggggtttgcccctta

SEQ ID NO: 639913 - DNA, 636 bp, Homo sapiens
  misc_feature (71)..(71): n is a, c, g, or t
atatgaactaatgtgctttctccccttattcctggtgtgccatccatgatacacatctccgtcttgcgctntacgttcacatcacataatgttacctaggggaactcccgctgtggtttagtatggcaaatatgtcagctcaaagtatgtattgatgctttaagtttgcctagtaggcacaacaagtatttcttgttccttttgccctcatgctcatatgttttaactgaggtgtacatggccaacgttgagtaatatctgtggaactggatgtacagtagagccatgggtacctcatgtatcccactggaccagtcccctggggcaatcacatcagtggctcagatctagactgctctatcccagccagaactctgctgctgttcatttccatcgaggaccacccaggataagcacacataagttagccttctcattcattaggtcacctaatctcttggtgttgcaggatgagagcatatatagatctcctgtctacgagagtgtgttcataattgtacgaaagggatatgaataatggacataagccaagaggctgtgtcacttgtgttaacgaggatggccatggatgacctcataatgagtctcaacaaatactgggaatccaaggaactg

SEQ ID NO: 639914 - DNA, 622 bp, Homo sapiens
  misc_feature (227)..(227): n is a, c, g, or t
  misc_feature (309)..(309): n is a, c, g, or t
  misc_feature (326)..(326): n is a, c, g, or t
  misc_feature (334)..(334): n is a, c, g, or t
  misc_feature (351)..(351): n is a, c, g, or t
aagcggcaacgtgagtaggtttgtcaccaggaaggaatataaccttttttcctgaaggaaaacactcagcttgcccattattattgttcatatattaaaccatttcaatctaacaaaaattgtaccaggggcacagagtgctaccaaaagtttatcatcaggaaatatggtcccttcctagttttgttttagtcatattacttgccagtaattcatcttcctcttanttttttcccttgtgagatttaattttggtgtaaatgtagtcttctgtagaaaatgtaatattaataattattatcacaattnttttaaaagagtaaatnccaaatantcacaatgaactaagcnctctaacaaactttacattttttaattcaatccctacaataactctgtaaacttcattttacagataagcaaattatgactcagagaggttaagccagacccaggtcatgtagttattaggttatgaaaccaggatttctcaaccagcactttagaccaggtgcggtggttcacacatgtaatcccagcactttgtgaggccaaggtggaaggatcacatgagaccaagagttcaagaccagcccaggcaacatagtgagaccctatctct

SEQ ID NO: 639915 - DNA, 118 bp, Homo sapiens
tgcacgctatgtcattcaatcataacaaaggtatagaaacaatagacacatctcccagaatctctcctcccctcaccaacctcctagggtagatgaatgacctaagcacagaaaaggt

SEQ ID NO: 639916 - DNA, 388 bp, Homo sapiens
gtcgacttttttttttttgcaacgatccttacacgggattcatttatgttaacatggcggcaaccacagctgcagacttcagtctagggaacgtatcaagcaactcaactttttcttgtcatgtcatgacttttctctgcttcttgggagcacttccagcatcctagtgtaactctgtataggtgctatggtgttacggaggacttaggtattgcactaaacacaatgaaaactatgcaagaaccacgagagatcactttttactgtgatacacaatttactggagagacgaatagctcagagacaattagcatcacagagcgttttaaacacagcattttaagtggatacttgtaacacttgagctcaccgtaacagcaaaagaagg

SEQ ID NO: 639917 - DNA, 116 bp, Homo sapiens
atcagtgagcagagatcgcaccactgcactccagcctgggcaagagatgagactgtgtctcaaaaggaaaaaaaaattaaaaatgttgctggtattacatcaaacctactctggaa

SEQ ID NO: 639918 - DNA, 337 bp, Homo sapiens
gttggttttattgtagaataaaatcttcgccccctggcatttaagtgctgaggcaaacgtgttcttaggtgaaatacaccaaaacattctccgcaggggcttggatatggctgctgcaacacatttgttgtgggctccttaattaatgataaaatttaagctaacccaagcccaaaaatgaataggtttttttaatttttatttttcactaaacaggcaattgaaatacatggtacaaaaataagtggtaagataattgtaaaatgaaatggacagaatattcaattttcccatctatgaaaatttcccaataaaaatcatagtttactttgtaaaa

SEQ ID NO: 639919 - DNA, 287 bp, Homo sapiens
  misc_feature (49)..(49): n is a, c, g, or t
  misc_feature (69)..(69): n is a, c, g, or t
gataataaaagatattactgatttattatttactatacaatatactttnatattttacagtgtactccnttttatttaaaaagttaactataaaacagcctcaggcaggtccttcaggagatattccagaagagggcattgttatcatagatgacagctccattcatgttactgaccctgaagaccttcaagtgggacaagatatggaggtggaagacagtggtattgatgatcctgaccacgggtaggcttaggtttatgtgtgtgtatgtgtcttagtttttaac

SEQ ID NO: 639920 - DNA, 847 bp, Homo sapiens
atcactctctgtggggggtggccctgctgtctcctcataatcactggatgccttggaagttcgtctgtggcatctgtccatcctccctatgggccgctggtccatgagactcacgcgatgggcaggggttctgggtaggacggtcagctgtcctctctcctggactgtgtcttacccagccctaaaccctgccccatggaagcccacagtgctcgacctagtcgtgctgctcccatctgatggtctagggtgctagtcctagtgacctgactaggggcgccagaggacactgtcgcttgcctcctcatccaaccaaggccccagacagagctcatagcccctgtacctgttctccctgatcccacatggcacagaggcgaggctcctgtctacagaagcttcctcattgtactactgccttgggaggaccctgtgttgtgctcagggaaggcctctttcaatggtcgtgtgccggctggggacggagcgggtgtaggatcccaacctctgtctaagtaatgtctggaggatggagcggtctacgcgcctgattagggggaccgtagagcagtgtgctatacgctgtctgtaccatgctagtggctagctactgacctgtggtgttgcggcccttcgtggtggaaaatgactgtgcccacccgtgaacgagaattcgatgtgcatgagcgcgtggaccagaagctgatagcccttggtacagtcaccattccttggccagaatgatggggttccatgccatggggaaatcacccaaactgcgtcccttgttcacatgaggggaaagccaggaccatggtctgcatggtctgtaattgtcctggcccag

SEQ ID NO: 639921 - DNA, 981 bp, Homo sapiens
ctcagtcttccaactgccaatatagaattactgggtacaatcaagttgggaaaggtgttgggtggggcaatacccatgagtcgatagtgataagctcctaaggattttctaacttgtacttttgtgaacgaagagaatgcataaataatgtcggtgaggataaagtacagatatttcatgtagaattaattgctagttatgatgcgttggtgggtagttaacgtgttcctgtgtgttccagtcaaacatgatcatgctacgaaacagcatgcttcctgagagcaatgtcacatgagtacactgattgttcttcctgcagtcgcccttgccaagtatgttcactgtattaatgtaatctaatatcgagtgattaattgtgtagaacatttatgatatcatgggcaacatccgatctgatctaccagccttaagttcacacgataggtcttccagcaaagtctgattagactaacagagatatttcttctgggacaggcgccttctgtggtaatttccgacagttctttgtacaagttccttcctcaagtttcagttctttccagtgtttgggtagctcactgtcactcactgaatagagaagacgtgtgcctatagttcctgtgacaatcatttgtgctggacagaatgatggatgtttaagatatcgccaagagtacttcaaagaaaggtctggtgaggaccaggacgcggagacaccactgttcaaggactcagtgtttcagaataagcctagacggaatgggagccatactatgtcacggtcaaaatcagcatgtcaggcatgttgatcaaaggcagatcatgaagaaagcatacgtaggacgtgtgtggaagaccgtacaccaggtggggaaagggcagaaatcaaaaaaaaacacaagtccaaggaagagattagcgcacgaaaaaacacaacaagaacaaagacagaagagacgcggatacagacatatatcacga

SEQ ID NO: 639922 - DNA, 171 bp, Homo sapiens
aacgacttcgcagcagcagcagcagcagcagcagcagcagcagtgcatagatatcaaaagggtttagaacagtcaggtaggatcacacaagtcaccgtgaagcaatacttctccacttagccaaagctaacaaaagatttctcttctaggtcaacctagaagagatcacgg

SEQ ID NO: 639923 - DNA, 661 bp, Homo sapiens
aaaagccccaaagttcttcatagttccaaaaggctcgaaaatctagaaaatgtccaccatttggaccttcccaaccccaggccaaggcttctttcgtcttcaaacccgttctgaccagcaagggtatccctttaatcccatttcttcaaaactccccaaatctgcccaaagcgttttaacaattttgcttcatttttacttttaaagtcgatgaccaaaggttcccaagaagtctaatgccctcacatacacataccaggcaaatttatgtaagcgtgcttaaaaccacagaccaacctagaatcgttatgcgtgtgttgaactagtcatacccaagcacagggcagcaaaaaaccgtgttgaaactgttaagaacttttccacaactgttgtacaaaagtccgctacctctgacgatatggttccatgctggccacaacgtggttgatacttcgcaactgcaagtcggcttactttaggcttattacaaccattttatcagcctttgagcctactattgttagaataaatagcatatgtacatccaccgctgaataaggtggcttggtgttaagccggtgcacagtcaacaaccagtcctttatcatcgatttctccaatcgttatgagtccccccactgtgaatccattaataacatgt

SEQ ID NO: 639924 - DNA, 441 bp, Homo sapiens
agtttgcagtggtgtttctgtgcatggttatggtctgggtgaaaaaattatgtttattagcgtcccaaatctaaagatctgtgaaaatgagtttggaggtagtaggtgaaaaaccaagggcctagtctggaggagagagtctaattctggcactaagaatctggggtagagtcaacatttttccatgaactttgagaggaaatggttttggggagaagcagcaatgtgggaaaatgcagcacggcacagtagaaaagcatggactttggaataatttaaatctggtctgaggccaggcgcggtggcgcacatctgtaatcccagcactttggtaggctgaggtgggaggattgcttgggcccaggaggttgaggctgcagtgagccatgatcgcaccactgcactccagcctgggtgacagagcaagaccttgactcacca

SEQ ID NO: 639925 - DNA, 284 bp, Homo sapiens
tttaggctttttttggcccccggggggaaaattcccctaaagggggcgcccccccccttttttccccttttttggttttttccggaaccccctggggctccttttttttccccccccgggttgggccattaaaatcctattttggttttcgggccggtccttggccggggggggctttaggggcccccccaaaaaaaagggaatttccccccccccccaacctcctttttggtttttttccaaaggggaaaaaaaaggcccttaaggttttttcccccttttta

SEQ ID NO: 639926 - DNA, 407 bp, Homo sapiens
  misc_feature (157)..(157): n is a, c, g, or t
  misc_feature (208)..(208): n is a, c, g, or t
  misc_feature (245)..(245): n is a, c, g, or t
  misc_feature (289)..(289): n is a, c, g, or t
  misc_feature (317)..(317): n is a, c, g, or t
ccccggtactcgccaccttctaccgcgcccatcccaaggtcaccttcaacatcgtaatcgccagtgcatcggccaccctcgacgccctgtgcagcggcgaggcagacctgggcctggcgttctacctgcaagaacgcgccgacgtcgaagtcactgnccattgccagctgtggcaccgggtgctggtcagcgccgaacaccccttcgnccaacgcgaaagcatcgaattgagcgaactgcaaggncagcctctggcgattcccgactcggcctacggcgtgcgccaggncctggaagtggccgcgaaaaaacgcggngtcaccctcgaaccggtgttcaccaccagctccctggaagtgcagaaaagcctggcccggcaacgggcagcggtgctgattttgccccag

SEQ ID NO: 639927 - DNA, 861 bp, Homo sapiens
cagagtggccgcagtccgatctttgccctcgcatcctgttccaacgctgatggctggtgtgagtggcggtgacgccatctgtgtgggctgccatggcaaacggaggtgaggacagccctgtgcccagaggtccagccatatggacaagcagttcctggtatgcagctatctgcctggatcggtaccagtgccccataggttcttccttgacctgcactagccttgctgtgagagatgtcgtccggaaactatatccctggccagtagcctgacgctatcctgtccagtatgccgacagacgtccattcctcccagaagcaagggctagtcgtcaggctacttgcaggaacaatttcttcagtcatgcagcctcatggaggcaagtgcaagcaggcacctgatggggcccacgaccctggaggaccccctagaccgcttcacgtgtagtggctgtgccgtcctctctcctgcccctagtcatgaaggtgcaagacgactcgacgttttagctgtgatggcctgtgtagacggccctgtgtggtgatgtgccgtcgccgtggatgcatcgtgacgcatggccccggtgctgctcgagggagtgtggttgcgagcaagctccacattgctgtgtccctgcgaggcgccaggctcgcaggcctgtcgcgtggccgtattgcccatgagatgctccgcagtcaactggcctttagtccgggcagcatcccagccagccatctgacttggcagcgcaattgtagaacgcccttggtccagatctagtgcatcctttccgaggaccctgtgagcaaagcactgttggcagcagccatgcaggctcctggtccggaaacctggagacca

SEQ ID NO: 639928 - DNA, 148 bp, Homo sapiens
  misc_feature (97)..(97): n is a, c, g, or t
  misc_feature (126)..(126): n is a, c, g, or t
tctcgatctcctgacctcaggctatatgcccacttccacctcccaaagtgctgggattacaggcatgagccactgtgcccagcctggtattgataantttatattcagataatttgttatggctcnttaatatcccacaaggggctct

SEQ ID NO: 639929 - DNA, 107 bp, Homo sapiens
tatgtatgaggatcaactctatgatttttgattttttaatcttttatttttatcaaactccgtattatgctatgtgcttaattcatggcatgggcacattctccaat

SEQ ID NO: 639930 - DNA, 472 bp, Homo sapiens
tggctgattatcagatctagtagttttccggtggaatctttaggtttttccaaatataagatcatgtcatctgcaaacaaggatacttgacttctaatcctttctaattgggatgctctttctttctttctcttgtctgattgctctagtgaggacttccagtactatgttgaatcacagtggtgaaagtaggcattcttgtcatgttcccggtcttagaggaacggctttcagttataccccattcagtatgatactagccgatatataggtctgatatatatggcctataatgctgtacgcaggtatgtacctatccatacccagtttttagagggtttcaatcatgaaaggatattgaatttgatccaaaattactatacagcaccaattgaaataatcatttgtttagtgtcctgccattctgttgatatgatatatcacattacttgatttggcatgcgctgaacta

SEQ ID NO: 639931 - DNA, 895 bp, Homo sapiens
gcgctcgagaggcagggttcccgcgtttcggcgggttgtcctagagccagcccacgggtccaaccgccggtgggaaacttgtgggtacaaaatggttgacacccagacgtggagttaaggcccctgttagggggtaaaaagtgtctagttcagttgccctgatcttgatatccacagcgggcgtccaataatttgcttccctgggaaacatgggagggctcttcgtttggataactccagtagtccctacccctgggggtcttcccacgacaccccggccgccctgtgtgatctcccaaggccccaaacactttctgagacacccacaagccccctattactttatgcgcgcccccttactggagatattttggccggggacccacttagtaacgtactctccttcgggggcgaaacatgctccccagatcttccggggacaactcttctgcgctaaacagtcaccaactgcatgaagtttcattcccccgggaaaccaacctgggaacaaccacccccccaagcccgcagtaagtatccccccccgtttgttagggcacccctatcggtagagtccccaaagtggtgtctcccctatgtcaacaagctctctttagggagataatcccctaaacaataacccggaaacaagggagaccttgacctccatacagtgcccgaaatctgacgtaggggttcgaacactgcggcgggaatatatctctataatcgagggcccttgtatcaatggtctcttgatagcgccggcccaaagtgcttccgaggattcaatagcgagacacccgcatttaagtcgtaagaggtaagatccagaaaagccccttatttttcgcaaaatacggccctatctcctcctttcgccccacatagacaa

SEQ ID NO: 639932 - DNA, 1006 bp, Homo sapiens
  misc_feature (20)..(20): n is a, c, g, or t
  misc_feature (77)..(77): n is a, c, g, or t
  misc_feature (141)..(141): n is a, c, g, or t
  misc_feature (384)..(384): n is a, c, g, or t
  misc_feature (396)..(396): n is a, c, g, or t
  misc_feature (400)..(400): n is a, c, g, or t
  misc_feature (406)..(406): n is a, c, g, or t
  misc_feature (419)..(420): n is a, c, g, or t
  misc_feature (423)..(423): n is a, c, g, or t
  misc_feature (428)..(428): n is a, c, g, or t
  misc_feature (438)..(438): n is a, c, g, or t
  misc_feature (447)..(447): n is a, c, g, or t
  misc_feature (454)..(454): n is a, c, g, or t
  misc_feature (478)..(478): n is a, c, g, or t
  misc_feature (490)..(490): n is a, c, g, or t
  misc_feature (513)..(513): n is a, c, g, or t
  misc_feature (518)..(518): n is a, c, g, or t
  misc_feature (523)..(523): n is a, c, g, or t
  misc_feature (531)..(531): n is a, c, g, or t
  misc_feature (547)..(547): n is a, c, g, or t
  misc_feature (551)..(551): n is a, c, g, or t
  misc_feature (558)..(558): n is a, c, g, or t
  misc_feature (561)..(561): n is a, c, g, or t
  misc_feature (565)..(565): n is a, c, g, or t
  misc_feature (598)..(599): n is a, c, g, or t
  misc_feature (603)..(603): n is a, c, g, or t
  misc_feature (611)..(612): n is a, c, g, or t
  misc_feature (621)..(621): n is a, c, g, or t
  misc_feature (640)..(641): n is a, c, g, or t
  misc_feature (658)..(658): n is a, c, g, or t
  misc_feature (663)..(663): n is a, c, g, or t
  misc_feature (668)..(668): n is a, c, g, or t
  misc_feature (763)..(763): n is a, c, g, or t
  misc_feature (934)..(934): n is a, c, g, or t
  misc_feature (980)..(980): n is a, c, g, or t
tttaaaattttaatcttganattggttaaccttaggtaaacactaaccatatttttttatatacattatatacacgngaaataaatagtcttccaaatagcattttttaaaaagcatcattatatacaattaaggcttcangccaggtgtataaatatacaactcactgagaattcaatttgcaaagcttccattagtaaaaacagaagtcagaagtgaccaggatgtacagccaataatatgggttgggcaaccctaatccaaaaatccaaaatccgaaatgctccaaaatccaaaactttttgagcaccaacaagacaacaaatggggaagcccctcacataagttaccacaaaccatgcttcatgtacacaactatttaanatatcgtataanattnccctcnggctatgtgggtnnggngtggntggggcatcngtgggtttngtgtttnggctcgggtcctattcccaaaatntctcattatgtntatgcgaacgttccaaaatctgngaatnatctnagatttgngacacttctggttccnagcnttttggntangggntactcaacctgtacaagcttcgctttggctagnnagcnatcacagnnacaagagangcacacaattggcttgggnncatatcttgggataggnctcgnctggntatgtcttcagaagtttaacagtgatacaactttggcacgatacagattaaaacaatgtccttagaaaacctaagtacaaagaaaatcattcttnctctcctgcttggtgtcacacttcctcccgaatctcagccataaaaagtccaaccgttggcacagatgttctcctggttatacgttaataaaagggcttaggattttatggatggctctatataaaaaaaaagtccttgtttgtctcacgtctggggcatataggtgggantggctgcaaaagtcttcatggagtttcagagatagactttgcctcnggaaatctgagtcctctccctggctg

SEQ ID NO: 639933 - DNA, 617 bp, Homo sapiens
  misc_feature (168)..(168): n is a, c, g, or t
  misc_feature (171)..(171): n is a, c, g, or t
aacattaggtcaggtagcgaggcccgggtgttgagtagacgtgactttcaccttctgccggattgtgaggcctcgccagccacctggaactgatccacacccaagtccgctcatcaccctggagactcagaaggataccctattaaacttatgaaaacccatgggcgnacntctgtgtccggaactctggaagtcaaatcttatctcctgggagtggaacagcagaatccctggatggttctgtctttgaccttcctgtatccttcactctggacaccaccccatcagcccttcaaaaccctcatgggaaagaggagttgcagaccagtggctttggccagcacctgaggcttccagcagcagctccttacacagtggcgactcttaaagtccaatctgttagcccaagggacctgaacctccatctgcaaccagcaatggcacaaggtagactctcagcatttgtgctatgccgttggggaagagcttcaatttgtctgcaaacgatgctccatcagtctcatttggttccctgtctttggggagcctgggaatattgttctcgctccccgagttctgaatttcccaatgttaaagagatgttggaacccaaaaaa

SEQ ID NO: 639934 - DNA, 244 bp, Homo sapiens
gccactgtcgggtacaggaataagaatgtgagacagaagacatggcggcctaaccacccgcaagccttcgtggggagcgttcgcgagggacaaggctttgcttttcgagaaaactgaaatacagcaaagttacaggaattgctacggaggaaagaggtcaacgtcactggatctcattcacagatcgataccagatatctgaacatctcttttggctggggaggaagcatgggggcagcaggaa

SEQ ID NO: 639935 - DNA, 1261 bp, Homo sapiens
ggagagaactagtctcgagtatttgtatgttttatttttcggagggctgggaaatggtaaattcccttttgtacagttagtgctattaataatttcgtcgttgcaaatttacaaaggtgcacgttttataaagaaaagcccaagtgatgcacagagtgtgtgactccataagcaggtggtgcccacaaccaactccgtgccgtggtggcccttcatttcgtgccgtgctgtgctctaagaagggatacagcacaagagaggcgtggggacatcagaaatacccctttcgacagaaaagagagccaaaaccgaggttgtgacacagtgtgggggaagacatccaatgtataaaacaaagagccccgtggggaccaactgtgacacgaggcagagagaaagccagtagcccaggcgggaaacgcggcgcacgagagcacggagatcatatacacggcggaacaaccagcgcacaacgggacaaacaacgcaatgggggtctgaagcgccatacatattcaccacatctagcagacaagatacacacaccctagggggcgcactgagacggcgacacaactgagaggaccacagggccaaacaacatcggggcgctaacggctcgaggcaaagttgggagccccatacatcagcgggtgtcgggcacgacaaacacacgtgatggccccctacaattgagagcaagaaaatcataagcaacgcagaggcgcgccgcaggaggagaaaaagaggcccccgtggcagacatgctggaccccaacaggcagcgccgtggcacgggtagaaccacacaaaagatggcaccccacccgtacgaagcgagggcacgggggcccctccaagaaacgccccggtggaacacaccacaacaagcaaacagcggcatacgtctgcgaacgccaaacggtgcgaacggcctaccaacacaagtagggggagagccacgacattaacgaaaagccaacgatgtggataatgatggtcccccacagacggaagcaaacaacggggggcggctcataatagtgagatcgcacccacactaccagcagcagattaggatacgcggcaaacagtaggagaacaaaccccaggcgggggtagcaagctcgtggaggagggacgaaaaaagggggagggcagcaaacgaaagcggggagggagacaccctccctctatagaagaaaacaaacagggccgcgagaaaacaagcacacagaggggccatcaacacacgcgatac

SEQ ID NO: 639936 - DNA, 135 bp, Homo sapiens
gggcgtcagaggtccctgtatgcgtctcacggataaatgatcagatgaaagggctcagaggtgacacaaacctactttaaacagtttcgaaaacttaggattttagcctaatacctgaacacaactatatctttc

SEQ ID NO: 639937 - DNA, 597 bp, Homo sapiens
ctctccaccttactatcagacaaccttagacaaaccatatacccaaatgaagtataagcgatagaaattgatacctggcgcaatagatatagtaccgcacgggaaagatgaacaattataaccaagcatagtatatcacggactatcccctataccttctgtataatggattaactatgaataactttgcatggagagccaaagctatgacccgcgaaaccagacgaggtacctaagaacagctaaaagagcacacccgtctatgtagctagtgggaagatttataggtcgaggcgacaaacctaccgagcctggtgatagctcgattgacaagataggatcttagtgcaactttaaattcgcccacagaaccctctaaatcccctagtcaatctaactgttagtgcaaagaggaacagctctttggacactacgaaataaccttgtagagagagtaatgctgaacacccactatctataataatcccaaacatataactgaactcctgacacccaattggaccaatctatcaccctatagaagaactaatgttagtttaagtaacatggcattttactgcgcatgcctgcggtagg

SEQ ID NO: 639938 - DNA, 658 bp, Homo sapiens
  misc_feature (209)..(209): n is a, c, g, or t
  misc_feature (212)..(212): n is a, c, g, or t
gactgttgagctagaggaagatggtcctgtgtgtattaacctcagtgctcaacttcctgatggattatttgagtttttctgtttctgctgtgaagtcacgggatcccgaatttttcttcttgaggttggcgggatccacacccaagtccgctcatcaccctggagactcagaaggataccctattaaacttatgaaaacccatgggcgnacntctgtgtccggaactctggaagtcaaatcttatctcctgggagtggaacagcagaatccctggatggttctgtctttgaccttcctgtatccttcactctggacaccaccccatcagcccttcaaaaccctcatgggaaagaggagttgcagaccagtggctttggccagcacctgaggcttccagcagcagctccttacacagtggcgactcttaaagtccaatctgttagcccaagggacctgaacctccatctgcaaccagcaatggcacaaggtagactctcagcatttgtgctatgccgttggggaagagcttcaatttgtctgcaaacgatgctccatcagtctcatttggttccctgtctttggggagcctgggaatattgttctcgctccccgagttctgaatttcccaatgttaaagagatgttggaacccaaaaaa

SEQ ID NO: 639939 - DNA, 1372 bp, Homo sapiens
  misc_feature (28)..(28): n is a, c, g, or t
  misc_feature (38)..(38): n is a, c, g, or t
gtgcagacccgcgtgtggcgcaggcaanggacctcaanataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccggtgaatgtcctactggtgtgaggccgtggtctgtggaatgatgaagcctgtgcgcacgacgcgggcatatatccgacgggcctatatgcgtcaagtcccagtcaggatcgtccgtgtcccatgtacccacctcatcttggtctaccttccggccgatgcatgacgcctgcacgcatcacttgggcatccataattccatgtgggccccccacacggcggacaccttctggcgtcggaaccttccaatcttccaatgcgtgcacagcgcggaacttagggccaccgtatgggccctgataaacctttacaccgcctttgggccaggcggacctaaaccgcaacactggtgtggcattggtgtggtcccccaacgccgaagcatattcataggggccgccctaagctcactggctgtgctaaatccccctaggggccacacacaccggatggcgccaacctgggccggcacacccaagaccactgtcgcacaacgggcacaccggccaacacggcccctctggggacacgtctgtaaacttggcgccctcacacatagcgctttggcgccccgatatcatggtgccccacctatatacacgtcccacacctacaccccccgctttgtggcaccatcaggggtggcgcacccacagacatacagatccgccgatcccacaagttcgtgcggggtgcctacccccgaagcgtataaccccacatgttggttgtgcatcccagtttaaccctcggcgggtatttggtgcacaaccaccacctgactagtgggccaccccctgagaaagcacaccgcgccccgaaccagtaattacggggcggcccacaagcaaccgcgctccaccgctcttcctcgggcacaaccacgcgcaccccaaaaggacgggggagcaacaccacagcgcccactggtagtatggggcgcccgccgctttaagaacctgctataacaccccccgcagcatttactgtggggcggccccttctgctcgcctgtgcatcaaaccttgctgccacaccacaagcgtcttacttatgtaccccacaggtgcggacggcgaacacacattcccgaagacctccaagaaacacattttatccagtcccaccatagggcaaccgtcccaatgcactaccacacacgccggtggacacaacccccatgatacggg

SEQ ID NO: 639940 - DNA, 262 bp, Homo sapiens
aggcatagtggctcaggcctgtattctcagcactttgggaggccaaagcgggtggatcacttgagcctaggagttcgagaccggcctgggcaacatggcaaaactccacccttacaaaaaatacaaaaactatctggcatggtggcacacctgtagtatcagttactctagaggataacctgagcccagtaagtcaaggctgcagtgagctgtgatcatgccacagcactccagcctgggtgacagagtgagaccctgtttc

SEQ ID NO: 639941 - DNA, 164 bp, Homo sapiens
gcgtcacaacatataggtaaagaggaactgctggccacgagtacggggtgtggccataatcctgtggagcatccttttggagtgtgtgcaaccagcagcacatcggcaacgccctccaccatccgcagagatccccttgtggccgctaagtgggtctcattgct

SEQ ID NO: 639942 - DNA, 1659 bp, Homo sapiens
ttttttttttgagactgagtcttgctctgtcgctctggctgaagtgcagtggtgtgatctcggctcactgcaatctccgcctccagggttcaaatgattctcctgcctcagcctcctgaatagctaggattacaggtgtgcgctgtcatatccagctaatttttgtatttttcgtagagacggggtttcaccatgttagccaagatggtctcgatctcatgatccacccacctcggcctcccaaagtgatgggattactggcgtgagccaccatgcccagctatttttttaaccaatatattagctagcttttttccccagaataattttccaaaaatacatttaatagggaataaaagttaaaagaactttcagtggtttaatgctgttacttttaatatttcaagaatctgactgcagccatgagcagcaatgagtgcttcaagtgtggacgatctggccactgggcccggtgaatgtcctactggtgtgaggccgtggtctgtggaatgatgaagcctgtgcgcacgacgcgggcatatatccgacgggcctatatgcgtcaagtcccagtcaggatcgtccgtgtcccatgtacccacctcatcttggtctaccttccggccgatgcatgacgcctgcacgcatcacttgggcatccataattccatgtgggccccccacacggcggacaccttctggcgtcggaaccttccaatcttccaatgcgtgcacagcgcggaacttagggccaccgtatgggccctgataaacctttacaccgcctttgggccaggcggacctaaaccgcaacactggtgtggcattggtgtggtcccccaacgccgaagcatattcataggggccgccctaagctcactggctgtgctaaatccccctaggggccacacacaccggatggcgccaacctgggccggcacacccaagaccactgtcgcacaacgggcacaccggccaacacggcccctctggggacacgtctgtaaacttggcgccctcacacatagcgctttggcgccccgatatcatggtgccccacctatatacacgtcccacacctacaccccccgctttgtggcaccatcaggggtggcgcacccacagacatacagatccgccgatcccacaagttcgtgcggggtgcctacccccgaagcgtataaccccacatgttggttgtgcatcccagtttaaccctcggcgggtatttggtgcacaaccaccacctgactagtgggccaccccctgagaaagcacaccgcgccccgaaccagtaattacggggcggcccacaagcaaccgcgctccaccgctcttcctcgggcacaaccacgcgcaccccaaaaggacgggggagcaacaccacagcgcccactggtagtatggggcgcccgccgctttaagaacctgctataacaccccccgcagcatttactgtggggcggccccttctgctcgcctgtgcatcaaaccttgctgccacaccacaagcgtcttacttatgtaccccacaggtgcggacggcgaacacacattcccgaagacctccaagaaacacattttatccagtcccaccatagggcaaccgtcccaatgcactaccacacacgccggtggacacaacccccatgatacggg

SEQ ID NO: 639943 - DNA, 1279 bp, Homo sapiens
  misc_feature (447)..(447): n is a, c, g, or t
  misc_feature (496)..(496): n is a, c, g, or t
  misc_feature (623)..(623): n is a, c, g, or t
  misc_feature (811)..(811): n is a, c, g, or t
  misc_feature (831)..(831): n is a, c, g, or t
  misc_feature (835)..(835): n is a, c, g, or t
gaggccgcaagatcctgaccttggtggttggtgaaagcaaagttgaactgtggctccattctcaggcttcatcgccctctgtgggatccctggtgctgctgttggccatagccatgccgtgttggctactggcccaaggccaccagggaccaatcgggaggggcgtaaccagctgccgctctgcgggcagcagccaccgggtcccaaccacggccaacagcagtagcagtggcagcaaaaaccggtccagggagccaccctagagctccagggggtgtcaactccagttccgcggcgcgcccaggagcacgcctccagcacgagccgcctccccttcctcctcctccacgtccgtgggcttcttcttccgcatcttctctggctacctgcactctgacaagctcaaggtcttcgggcccctcatcatgggcatcggcatcttcctcntcatctgcgcaaacgcggtcctccacgagaaccgggacaagaagaccanaatcatcaactgcgggacctctactccaccgtcatcgacgtgcacagcctccgcgccaaagacctggcggccgccgcggccgccgccgcggccgccgccgcctcttcgtcgtcgtctgcccccgccncggcgccccccggggccataccgctcaacggcttcctcagctacgtgcagtcgcggggcctggagctgaagcccgggggctgcggtggctccggggacgccttcggagcggcggcgatgctggccaagggctcgtggcctcctcaccccgcggcgccgagcggcggccgccctcggggcgccgcgtcnccgccggacctggcctcttncccncgctgtccgcgggagcccccgagcctggccgaggccgtgtacagcgtctaccgcgagcgctcgggcgtggcaggcagtcgccgggccgccgctgccaccgccgccgcagccgctagcagctgcagcagtccggcgccctgcagcccacccgagagctgggggcgccagagcacggccagctccttcgtggactcctcgctgagcgccttcgcgctgctgcccttgcaagggggccgcgataggggcggggacgcggagggcgcgagctgcagctggcagaggcctccgggggaacgcggctcccaggagatcccgaggggcgagctcgacctgagcatgaccaacctccgcggcgcagtgggcagcatgcgcggggcgcgccgggagccggaggagcccgagggcgcggtagcggcgcgcgccgccagggggcagggcggccgc

SEQ ID NO: 639944 - DNA, 326 bp, Homo sapiens
  misc_feature (116)..(116): n is a, c, g, or t
  misc_feature (125)..(125): n is a, c, g, or t
  misc_feature (132)..(132): n is a, c, g, or t
atgatcagtttgattgcccggctttattgcctttacaggaatgtgatactcagggcttactctataccccaatgagttttctttgatcctaagaccccccctgaagttgtttaggntcttttggncaaacangataaacttcttcagaaactttttttttcctttggcaggaaggggtcttgctgcaggtaactaatgaaaaagtggtcccccccagagttttcaaaaaataagaaattttggcccctttgaaagtagttcttgttggggccttcatttaaaaagccctctttaaaataaaagggaaatgttttttgataaaccca

SEQ ID NO: 639945 - DNA, 505 bp, Homo sapiens
  misc_feature (116)..(116): n is a, c, g, or t
  misc_feature (125)..(125): n is a, c, g, or t
  misc_feature (132)..(132): n is a, c, g, or t
atgatcagtttgattgcccggctttattgcctttacaggaatgtgatactcagggcttactctataccccaatgagttttctttgatcctaagaccccccctgaagttgtttaggntcttttggncaaacangataaacttcttcagaaactttttttttcctttggcaggaaggggtcttgctgcaggtaactaatgaaaaagtggtcccccccagagttttcaaaaaataagaaattttggcccctttgaaagtagttcttgttggggccttcatttaaaaagccctctttaaaataaaagggaaatgttttttgataaacccacccttttgttggggttttttaaataaacccattcccaaatgagtgttgtttgtaaacccgtaacccccaattggctaaaaagataaatgtttcctgtttttaattaggttttgtgagtagaccgattcccattttttttttaaaataaagtttttaaaataaaacccttttggttccca

SEQ ID NO: 639946 - DNA, 884 bp, Homo sapiens
ggcctcgctcaacatggcggccttctgtgcccgccccctccgctaacgggcacgtaactccgtccgaacgcgagtagacgagggcggcggagatggcggggggatggtggcttctcgcaagaactccgcgacctactgacccggcgattgacaggctccaactacccgggactcagtattagcccttcgactctcactgggtcctctgcatcgaagaggcggcttccggatgtagccctcggggaagccccagacgcacagctatgagtcccttcgatgtgacgtctgcgcagaaaacatgttctgatgtccagctcaaccggcccaacaagaggagtgccatgaacaaggtcttctggagagagatggtagatgtgcttcaacaagatttcgagagacgctgatctgtcgggcggggtgatctctggtgcaggaagaaatgttcatctgcaggtattgagcctgatggacatggttcggacatcctgcccgcccaatggagatgatgtggcccggatcagctggtactccgtgacatcatcactatacgcaggagaacttcaacgtcatcgagaggtgccccaagccggtggaattgctgcggccaaggggggctgcatggcggaagggggacttgtgaccggctgtgacattcggactgtgccaggatgcttcctccaaggtgaagaagtggccgtgcggtggtgcgaagtaggacacgggccggccaaggtctcggaccacagcggcacagagggctacgccgcaaagaggtgaagccagggcagggggcccgcgtcccacaaagaagcggggccacgggaaacaaacccgggaaacaagtcgcagagggacacaatgagggacaccaggaaaaacatccc

SEQ ID NO: 639947 - DNA, 415 bp, Homo sapiens
  misc_feature (15)..(15): n is a, c, g, or t
  misc_feature (20)..(20): n is a, c, g, or t
  misc_feature (47)..(47): n is a, c, g, or t
  misc_feature (61)..(61): n is a, c, g, or t
  misc_feature (77)..(77): n is a, c, g, or t
tatgcccaaatgttnggggnaattggcagcaggaccatatggcaggnaggaccaaaggtanagtggccctcaaggancaatgggagggtaaacattgtccatgttcccctatccttaaagaaatgcatcggctgggcgcagtgactcctgcctgtaattcccagcactttgggaggctgaggcaggaggactgcttgagtccgggagcttgagaccagcctgaacaacatagcaaaaccctgtctctaaaaaatttaaaaattagcaggacatggtggtacatgctgtggtcccagctactcaggaggctgaggcaggaggaccactcaagcccagaaggttgaggctgcagtgaatcatgatcacacaactgcactccagcctgggtgacaaactgagaccctataaaagaaag

SEQ ID NO: 639948 - DNA, 1039 bp, Homo sapiens
  misc_feature (730)..(730): n is a, c, g, or t
tggtcccagtcagtccgaaggctgcggttgcaaaattaccgcctgcggattaactgcaaaaattgttttgtccgtgccgctgttgctagcggcctgtgtgtccgcgcctttcctacggggggccgagatctggtgtctccaaaaatggcttgggtgtaccatctttcattggctggcaagggaatcttccatggctcttctaacatctctattcttacaaaaaatctgggaatctggctagaaaattgtcctctctatttttcttgaaagagacgcgcgatattattctgtgagagctctagatataccactctctgatgagacttctttgcacaacaaactcgtggggccgttgtctaacagcatatctcgcgcggaagaccttgcgatatctttggccccgcggcgataccattggtgggtcctggacgagacagtggttcccacggcgcgagaaaacaagcaacaatgtggggtaacacaagttattacactatataccaaggcgcataaacaaacggggggataatttgtctacccatgttgcaaaccgttgtgagacacccctgtggcaccaacactggctgtagcgtactagtatcactgccaccgacgatgcatcttggcgcggaccaacatgtcgcaacttaccacccataaattttcaacaccgggacaaggcggaaccacattatacttcggtgatgaaacaatcaagcgcgacaaccanagtgatcaccaccccatattgtgtgtgtgaacactgacttaaccccaaatgtttagggtgattttaaagcgtaacacaccccgttagatataggagcgactaacaaatgcataactcatccgaggaatgcggcccccccatgtgtggacataacaaacgtgtctaatttatattgtgaacgatagctaaacccacgaggggggcttccaaacaatgaagtgggtgaaatctcccccaaaagagccacaacagcccgcatatatacgggacacaaacaagtatgcggtgaattcatggaaacagacatac

SEQ ID NO: 639949 - DNA, 340 bp, Homo sapiens
tgatacgactcgagctcggtacctgtgggtagcagcaacctaggatatttgcaggtgtaaagccatttaccaagatagttgtaggtaagaagggcagatttattagagaaattgtgaaaatatgttgcagtgggcagctcagcagagaaggggctacctgcaaagaggcgagggctggaggaaagttttatagggtcctgctgaagggtgctacgtgtgaaatgaggtcattgtgcccgcaggttgtttgtgattagctgtctctaacaattgttcatacaataattgttcattattgttctcaacttggggctctccccaacctggggacccttcctta

SEQ ID NO: 639950 - DNA, 473 bp, Homo sapiens
agcagtgtggggcacccgcagtgatgggggtaagcgctcacagatcaacaggatcccaaggcagaagaatttttcttagtacggaacaaaatgaaaagtctcccatgtctacttctttctacacagacacagcaaccatccgatttctcaatcttttccccacctttcccccttttctattccacaaaaccgccattgtcatcatggcccattctcaatgagctgttgggtacactacccagacggggtggtggccgggcagaggggctcctcacttcccagtaggggcggcagaacggccacttcttgaaaccttttctggccctccctccccagctttacagcagggctggtctgtgcttaccaggctccccacagtgtgtcacaatctattacaatgccgtgcttagaggaggcaagacaataaacccccacagcgagtgcctcgaggggagatccctctaagagtcgac

SEQ ID NO: 639951 - DNA, 114 bp, Homo sapiens
ttcgtccggttgagaattaggataccgtctgcccgcaaggagctcgttgcggtgcagcgggtctcctcatcttctcagaactgggcggctcggcacatatcctcgtcagcttcc

SEQ ID NO: 639952 - DNA, 446 bp, Homo sapiens
gcctcttcccacccgtccccaccttccttttcggggggcggcccgcgcggcgcggctgacgaccgcgtgtggtgctgttctctctcccccccaccgtcttcgacctcctcgcgcgcacctcgacctctcctcctctccctctcgctcgacgcaccccaacgatgatgcctcccgccgatcgtctttgagctatggactcgagtgcgcccacgcacagcgctcaagcgtctctcctctctccctacgccgcgcccacgcgccccgcttcttctccgacttgctggcgcgcgccacgctccgcgccagccacacgccccacgctcgcgcgcgctgctggcgtctctagctcgcctacacgcgggcccccccccttctccgacgcactcacacgcgcgctgctcgctcttctcgcgcaagcaccttctcttttcctcccctcacctact

SEQ ID NO: 639953 - DNA, 446 bp, Homo sapiens
  misc_feature (446)..(446): n is a, c, g, or t
caggatggtgagaacttgaattgaagtgtactccaagtgtaaaatataccctgattttgaagactcagtaggaaaaaagaacaaaaaatactaataatttttaaatgagaacaagttcatataatagcattttgatatattgggttaaataaaatgtactattaagattactggtacatgcttggttttacttcttaagtgcggctactcattttaaattacacatgtggcttgtgttgtttctactgaacatctctggtttatattgcgctggcctcccctttcccatcctttcttgctccctttaaactctaatcagactagagatgcccttcttactgggcgtctaaagccctcggaatcttttattggtcacagcaggatctcctgggtattttgtatttgtcctcactgatattccttagctgtgttgatcatgtcatttn

SEQ ID NO: 639954 - DNA, 1049 bp, Homo sapiens
  misc_feature (581)..(581): n is a, c, g, or t
ttcgccctggcattgatgagtatctgcgtgtactcgaccgggtgctgaattagccgtttgctggagggtagctagcactcaatcatggagatatactacaggaatcacgctgtatataccctgcatctgaatgtgcccagcgcctgtaagactgtagaatcatatcacccttgcggtatgttgatgagggttgccacgtgttccggaggggtgcagtgttcatcattgttcgtgaggtgctgtggttcatcatggtcagtcgtcacggagatagtggacctgccaaatctgccgtcgtagtcgtcgagaaggcgtggaataatctcgacctattggattcatcgtaaatcatggtcctatctagcaaaacgcacatgtcgtcacgcaccaggcgagtggtagagtgtggcgtcgctgaatatctctcgtagtttgtatcctggagtcttggttagggtgctcagtccgcagaccgccggaaaagcccgctcgagttataccattcgtgtccatagtgtttcgtggtgccaccttgtatcagcaaattcttctactacctccacttgtgtgggacgtgttancaggccatttactggcatattgatgttatggttatccacagtcttgaagtaactatgtttgtagcttgtgcggcctccgtaatggtgtagagcatcaggcaatcaaacagagattgtgagtgccatacgtgcgtacgtagtcgaatattcatgccgctgtctactgatcatcctacgtgcggcactggagcctttaagctaccctgaattgagtctggcatgcgtggtgtcctgaggggaactcttaggctcgcacagcagaaagcgctatacttgcgtgaactttcgagagcgtacaagtgacgaacacagcccccaggtagggccgcacaagccatggaccagcacattggtcaccgctgtgtatattctcaaccaatacacatgtcaagacacagcaacgcaccttgtcgttcgtgtccacaaatatcaaaccactaatgactgcagcaacggccagcgacacac

SEQ ID NO: 639955 - DNA, 731 bp, Homo sapiens
atattatactaagcatttaccatctcacttctaggaattactagtatatcgctcactcctcatatcctccctactatgcctagaaggaataatagtatcgctgtcattatagctactctcataaccctcaacagccactccctcttaaccaatattgtgcctattgccatactagtctttgccgctgcaacgcacggtgggcctatccctactagtctcaatctccatgcacatatggccatacacttacgtagccataatctatacctaatctccaagtgctacaaactaatcgtcccaacaattatattactaccactgacatgactttccaaaaaacacataatttgaatcaacacaaccacccacagcctaattattacgcatcatccctctactattttgaaccaaatcaacaacacctatttagcatgtcccaaacatatattcgaaccactaaaacaccccttcctaatactaacttacctgaataacctaccatcacaatcatgacaaaacaaacgccaatttatacagtgaaccacttatatgaaaaaatatctaacatctctatacttatttcgtacaaatctccttaattataacattctacagcacacacaccataatctatttatctcttttcgacatcacactatcccaccatcggtatatacccgcatagatccccttatcgcctaaccatctacttctatttaaacataagtcta

SEQ ID NO: 639956 - DNA, 152 bp, Homo sapiens
ttttatggggccaaaaagggggtgttttccagaaaggtaaaatttaattttttttttccttggggtttgggatttcaaccagcctacaaggggggccttggtaacaaatcagaaatatgccaattaatgattaaagggtgggattgccccca

SEQ ID NO: 639957 - DNA, 426 bp, Homo sapiens
agcagactcttcttttaaaaaaaaaaaaaaaaaaaaattttaaaacagcctgaccagtataagcttacgtccttgtccattcctggggtgagagggataaatttaatgtcttggaatagtctacttgcaaaggggcatgaaacagaaaaatcagttaaagggctgccctttccatgggggtaagcacccatactgttttctgtcacagcaggggtctagcccggtgcttgataacttactactcagttatcaattttcttctgtgcagtatcgcacgggctagaatttgagcttagaattagaagggagcttgttttggccttagggccttagctttggccaccttcaccctagaccgtattctcctgtctcatttcattggtcacctagagactttgtttttcacatttcctttatccccttcct

SEQ ID NO: 639958 - DNA, 394 bp, Homo sapiens
tgtatagaaagtatttcacaataaaatagtacataagtacatattcagttcctgccactaatctatattctcagcatctactctggaatatctctctatatgactaatcagtggcgcccttgcagtataatgttctgtagatcatcaaatctatattccacacaaaccaattcctttatatctatagacagaactattttcaacatgccttcttgatcttaaaacaacagtaaatagacatttgcactccaactttataaccagctgcaagtttctttctttctttctttcttttttttgaaatggagtcttgctctgtcacccaggctggagtgcggtggtgcgatctcggctcactgcaacctccgcctcccgggtccaagcggttcgcctg

SEQ ID NO: 639959 - DNA, 926 bp, Homo sapiens
gggggctgtgcagagggaaggctcggctaatcggtccgcatccgtgtcgaccacctgtctggacaccacgaagatgccagccgtttggcgggcaaatagacggccaagaagggcatcctagaacgtgtaaatgctggacgagattgtgattggaagatggacgggtgagactttgcactggacaagacgggctacgtaagacggcaggtgatccctggagctcctgaaagctgaatcatggaggtcatccataagacagtaacagccagcttcatcgaccaggttcctcagtagcttggttgcaacaaggtctttgcaagaccttatctaccattcattaatgtcgtacgtttggatagtaccccaagctgagacgcaaatacggggggccagcttcatagtccctgtgagcaggaaagaatgtatacttgtgcgcggggatagtcccaatagtaatgcttgcttggcgaagtatgggcgcccgagcaccgttgggtcgaatgaacgggagaatagctattggagtaggacaagggaaggtaggatagagatcgagacaatcccttttcatttatccctgttacgagtaggtcccagaacgttggaaagactttgacatgtttccggaaactgggagtatttttacatcgggcacaaacatggcgaaaagggtccttattagttggaaaagaagaggaaacggagtgtgagcctcttctgtaggaattcgcgaagcagttaattggtaaggaatccaccgggtaggaaatgaaaagcattggtgcatgggtgccaatatgtggaacaatccttttggattacggtaatacgcgggataaagactcctgggaggggaggcaaaatcgattagttagcagtatgggccactagaaaagggaggagttttggaagtgggatggtaggcc

SEQ ID NO: 639960 - DNA, 556 bp, Homo sapiens
  misc_feature (275)..(275): n is a, c, g, or t
aaagggcttcggaaagggaaatccctatttatccctcgaaggttttttttttccaggatttttttgagccttttaccattccagcctagcccctaccccccaattaggaggggatgggcccccaaaaggtatcaccccgttaattcccttaaaagtccccttcctaaacacatccgtattattggcatcgggggtatcaatcccctgggctccccatagtttaatagaaaccccccgaaaccaaataattcaagcccgggttattccaattttanggggttttttttttcccctcccacaagcctcagagtatttggagtttcccttccccatttccggggggatttaggggtcaacattttttgtagccccaggcttccccggacttcacgtcataatgggccaaacttttccccaatatttgtttcatccccccactaatttttccctttacatccaaacatccctttggttttgaaccccccccctgaaacgggcattttgtaaatggggtttgactatttttgtatgtttcccttttttgatgggggtttta

SEQ ID NO: 639961 - DNA, 125 bp, Homo sapiens
ggaagactcgggaggtgatcagtggtatatggtacattatattaccgggtctctagagataggaaacatgactagaagtttatcacactaagcactgtaagaataaaggcaagagctaatcatct

SEQ ID NO: 639962 - DNA, 270 bp, Homo sapiens
cctctctgtaggaaggctggagagggcggtgggcccatggcatcaggagcgggatgccaccgagttctcaaatgaccttgtccgcccggcccttcctgtccggcctccagtgggcaccagatctccacccagtgcgtgaccaccccctccccaccaatccctcagcgagattctagcagaggggagagagccaggggccgtggggacccagtggtgcgaaaggggctggcagagagcagggagtccacccagggtcaggttcaggcctgc

SEQ ID NO: 639963 - DNA, 1164 bp, Homo sapiens
  misc_feature (154)..(154): n is a, c, g, or t
aaaaaaaaaaaaagagaatcgtacgtcgactttcgatttttcacagcctcagccttaggaaaaagtggttctcagtgggattaaacagcgtggtattgtgtattctaaaacttcaaattgggctcacattaaatgtgccacggcatttccgaangtttggatttgtgattaacatttgacaggattacttggtgttgttttaattttttataaaaaccgtgaaccacgtggtgattatatgtggggttttgggtaatttatagccagaaacctcttatacgtggttagaaaacaaaattagaaccgtgcaattatagtgtgtgttaacctatttgtgtggacaagggggttataacctcttggattatctcacacaatctaactctcgagtgtgcacacattcacaattctcccatgtgtggctacacagtctgtggctacccaaaaacaaaacaacaacacacagacacacacacacacacacacaacacacacaacacaacaaacacaacaaaacaacaagagagagagggcgcggcgcgcgcccccagcagacacacatctctctgcgcgagcggcgcgcgcgccccacgccctcacgagcgcgccccccgcccgccttctctggtgaaacacacgcgcgcgcgggcgctcacacaagtaagagggagagcgaccgcgcagactaataataaaacagccctactggcggagcgccgggcccgcgcgcccgaccaagcaagaccacacacgcgcccacgcgcgcagccgggcgtccataacaacacgacgggtaggacaacgaggggggccacctctctgcgcgcgtccccgagagcgccccccctccaccacatcaacatcgcggcgggtggcgccgtgacccccccaccccccacgcgcacacaaccacactccccaccccccccagcgcccttctacaacaagcgccacctaagaaggcagcacaaacaatccttatcaacaaaacttagctacaagcgactctgtccaacaacacgcggcgcatactcacccccacctaagccgcacgacaccccatcccctacacccccactgaaccacaaacaacactcctctccaccgcacaccgacacaagtaccgcaagacctccgcaaacaaacgaccctaactaccaaccg

SEQ ID NO: 639964 - DNA, 418 bp, Homo sapiens
tcggtaccacggttggctagttagtggtgagactggaacttctgaaccaaatctagtggttccttttctaagaccataccgtttcttacaaaatcccacattcccagccctcagacttggtactgatattaggttaaactctttggtcattagaaagttcagtgaacttattttctccagctctttttacctacttggttgtaagtactaagtatgtaaagaaggctaaagaaagttaagcatggacagcactagagaggggcaagtgtccaaggcctatacagggatgttaaaggaagagttaactcccagaattggatcatctacactggtcctctgcctgttgttactctttcaatctctgcaattgggaatgggatgtgaaaggtgaattccatagcagccaaccgtggactag

SEQ ID NO: 639965 - DNA, 90 bp, Homo sapiens
ggatttgctggtgcagtacaactaggcttaatagggctcgaattcgagcctcgaattcgaggctcgaattcgagctcgaattcttctaac

SEQ ID NO: 639966 - DNA, 342 bp, Homo sapiens
agctcgcgcacgtgtagcagggacactatagaagatccgcgcgcacagcacacgcgaggaggcaagaacttgagtgagtgagatagtgtgtgagtgtgtgaaagagggtgtgtgtatcaggctctatgggctgtgactaattggccggactattactggacactctgagacttacgtgctgacaggacatgttcaaagatgaccttagacacatatagcggagccacagtgaccctgttcaagactcttatgatgcagcggagcccaggtcccgcacaggagcagcagttaaggcacccttgacggaacctacgatagaaaggcggagagcgtgcacatcac

SEQ ID NO: 639967 - DNA, 936 bp, Homo sapiens
atcttgggcttcatttacaggctcatgtgtcagatctgcatgcatgcttgcatttttctggtatctgaatgtggttccttgttccaggaattcaacattaatttccaaaagtatcatgggacttgtgacaatacaagacatgaatctatgtataacaatttatcggcctttctcatttacctgctctagtattatgtattgtgtgtgcgtgcgtgtgtgatgtcaggctgccacgtaaaacttcagagaaaaatcttaaaagcagaccatccttttttgcatgctctattctaagtagaatgttcaatgtaactggataaaattgcatgttaaagatatttaggtataccacagtgtctctcttttattcctcattcggttctcagtttcctgtatatttgcttactgtgccgtttaagtggttctaggatacaaatgcactggtgaagcaaactgtagtgccaacagaaggtgatttcccagtcgtaaactgttcatgcagacatttgaagggactggtgttttcttaacacaacacaactcacagtttactttctaaaaccagaattctcattctcctctcatcgtcctcattgtcggccaaaccaagaagtgcatggcgctttcaatctctgaacactgtagaacccattacgaagactggtccgcatgttcacacttgtagtgcttgaaaagcacttcttaagctcgcatgggtcttcaaccgacactgcacaggtctccccaaggacaaactcagaacaattattattaccacagacataactgcgtcgaacatgttcgtggtcctctgcgaaatgcggcgccctgggttcacaccaataatgccgcggaacggattgtcttggatcacagcactcggctcctcttcacattggtatggcccttcttaagtcgatcctctcacattactcc

SEQ ID NO: 639968 - DNA, 956 bp, Homo sapiens
ctcttctggtgctccgcgcttgcggggtgctgcgctgcggcctgtgggcccggggcccgagcctgctagtgcgccatggttcgggagggccctcctgggacccgggagcggaccctgtgtggcggtgaagcccgatggcgtgcaacggggctcgtaggggacgtgatccagcgctttgagaggcggtgcttcacgctggtggggatgaatgatgctgcaggcaccagatgagctgtcttgcgagagcaactaccaggacctgcggagaggaagcccttcatacccttgccctcatccgcctacatggagcttctcgggcctgtgggtgcgccatgttctggtggaatgggtccatagtgtcgtccgcgcctctagggcccatgattgacacaccagactcggtgaggctgccccagtgaaccataaggggtgacttcagctgtccacgatcagcaggaatgtcatccacgcaaggcgactccgtggaggggggcccagcggggaaaatccagctgtggggtttccagaggcagtgagcttgggtgagctgggcagaacgggggggccagcaccaggcatgatccacccgaggcctgaggctcaaggcttgccattacagcccatccccggagcaggaaccaattaacctccgtcagcaagaacccaaagcccagatctaatactgccttgtccaaaccatttactttcccttgttcacctctgcccccagcccaagcccaagagagttttgagcccaccaagtttcggtgccttttcttgtaccccaaggcaagcccaagaattgggaccaatccttttttgaccaaagtgccggacaacctttgtgtgggcggcgggacctcacattattataacccctccttctagggggcgggctaaattccttgtccccacttggttgtcaccaattttatccgccggttggaaaaagacct

SEQ ID NO: 639969 - DNA, 298 bp, Homo sapiens
aaagctcgtgtagaggcaatctgcgtctctacgcaacttggttcgctggcgcatctccttaggctccttcattctcgtggcgaaaagtgacgcatattctgccgcctcttctttatttcacttggtgcgctgcttcttcagcagcgatacgccgccgtatgtgctcgcaggacaggtggtctaaatgcaatcggtgcatatcgggatcgcgattgccttgactgggtgggggctgtttatgaaggtagctaggtgtacctggaatcagtctaaatgctagcagtctacatggaatcag

SEQ ID NO: 639970 - DNA, 423 bp, Homo sapiens
atagcgacaccgtacccgagaaacgaggtctggaccagtgtgcagcgctcgaacacccagttgtccagtgccatgcgcgacaggtcgacgccacttaaatctactccgatcaagcgcaaagggccgctgtgccggtcgatcaagtcttgcagttcatcgcgctgcaaggcgctatcggcgacgtcggtgtattgcatcggggcctccgggtaggcggaaaaaagagggggcgattctaacctgccatacccacaaaaaacccggcagggcgccgggttttctgcaaggggaaaagtcctactccagaaccggacccgttgcgccaatagctgaccgcgccgtgcgcttgttcttgatccagtaacacactgccatgaacgctacccacaccgggatcgcatataccgacacctgaatccccgg

SEQ ID NO: 639971 - DNA, 119 bp, Homo sapiens
gtggggcggcagttgggtaaagggaggaacggatcacaggtgaaaacaccttccgaccaaagcccttgttgcctcggggtcctccccagagctgtccccactctcgctgtcggtcaccc

SEQ ID NO: 639972 - DNA, 202 bp, Homo sapiens
  misc_feature (57)..(57): n is a, c, g, or t
  misc_feature (87)..(87): n is a, c, g, or t
  misc_feature (98)..(98): n is a, c, g, or t
  misc_feature (160)..(160): n is a, c, g, or t
  misc_feature (176)..(176): n is a, c, g, or t
gcacaagctcacactggggaaaaacatgagttgttgccctggagcaagctgcctgtntgccaggccagtagtgaaccagcccctttnaaatgctccanacctatgagaaccaaaaaaaaaaaaaaaaaaaaaaaaaaaaaggggaaaaaaaggtagcttnagggctgacacatggnagctgcgttctgggagttgggctact

SEQ ID NO: 639973 - DNA, 326 bp, Homo sapiens
ttcaaaatataaatctggtcacggggtaggttggtcatcccctgctgagctctcatcgatgtctctttccctgtgtacaggacatcacctgttccaacccagtgtgatctatgggctggagcaggaagaggagtcgagggcagggcggagagcagttctccaagaatggcgacttaaaagcaaagggccagcacttcggcaggatagatctgggtccagagcatcaaatgagacacagacggcaagaagccacaagggagggcagctctgtgaccgcacgcagtgtggagaagctttcagtgaacactcaggcctcagcacacacg

SEQ ID NO: 639974 - DNA, 430 bp, Homo sapiens
gacgggaaaaggggcgagcaggaaagggaaagggaggagcaagtgaggaggagacaagaggaagcggggagggaaaagggcagaagcagtcaggagaggataagagggggacgatgagtggaggagaaagaggaagagaaagaaagaggccagatggtgaacgggaaagcaggtcgagtaagaaatggcaggaaggaaaggacgggggggtgaaagcggagggggagcagtcttgactgtgaccggcaacaggagagacagaacagaagggaaaaggcagttcgagcggacctagagtggccgtaggggaggtaagagacaaggttataggatctcggagaagtcaggacaatgaatgagagctcagggggaaagacacgacacactctctctctctctctctctctctctctctctctctctctctctc

SEQ ID NO: 639975 - DNA, 184 bp, Homo sapiens
  misc_feature (22)..(22): n is a, c, g, or t
  misc_feature (62)..(62): n is a, c, g, or t
  misc_feature (121)..(121): n is a, c, g, or t
cagcagacaccctggggatggnactccacacacgatagagatgccaggggccagggaagccncagcgctcggtgccttcgtcccagggttaaaatcggcctgtggggtgtggtgagaaggncaggttgtgcgggtgttgaccgatgtatcccttaaagttattataataatgggtaagtcaata

SEQ ID NO: 639976 - DNA, 1418 bp, Homo sapiens
ggtgctgctccgctcctcgattgttattgtccggtggtgtccccgccttttccggagtgttttgcgggacgatcgggtcgctcgtatggggcgcctcggtggcgtggttgattgtgccgccgggtgtgtagggagtgtgggtcgcgtgtgcccccctgccgggttgtgtccccggttgttatcacctccttttctctccttcttcctgtttgggttctatgtgtgggtcattcctccccccctcttctgcgtcccgagagccagcccttctttctcggcgcgggggcccccccccacacggtgggggagtttgtccccccccgcgtgctgtcccctctcttggtgcgttgtctggtattgtcctcggttttccacttggtttatatgcccctccctgcttggattggggggtccccgttttttctcccgttggttcctgcgtcttctttcgctggcgggggttgggtcttgtctctcctttggaatgccaccactctgcggtgtctattttgataccgttgatagcttcggtgatgtacacaaattcgggagctagaatgtctctatcggggctcctttcctagcgggcgggtccctgccccccttgtcaaacaaccctttgctctgggggggagtgccccacatggggggggcccccccaccgcacccactctcctcactgttacacactgggaatgaatttctttggggaatacaccacctgggggctcgctcttgtgggagtcaacacacacacgtggttgccgaccccaaacgggtgtgttagtctccccctcctcccatatcccccccccacgctgttctgcccatctctcaatcgtgtctcgcccaacccttccacacgcggcttatggattacacccacccgctcacgacgtggggaggaaattttacttgttttctggcgctcgccgtttcgcactcaccacgctgtactcgccgcccctcggcctctctctcccctcgcttctctcacgcggcgtgccacgcgtctcaccacgcgttgctccccctcgggggattttctatggcccccccctgggcgggcgcagtggttacccaccacccactccggctggtgttattgtttgcggcggcgcgcgtatgtttgttggtgggggaatgctgctggtgttgccaccgctgctgtgtgttggtggtgttggtgtgtgctgtgtgctgtgtgtgtttctgtgaccctcctgttcccacatggtaacgtcccacccctcgtccccacagagtcccctatttccctccaccacatataccacgaaaccacactccccgggagcttctggggaagaggctgaggaccaatacctgctgtcactcccgaggacattttttttagccataaaaattgagtgtccaactatttaaaaaaacaaaaaaaa

SEQ ID NO: 639977 - DNA, 336 bp, Homo sapiens
tgcaccaaattcagggcagcttggtggatgctggcatcgtgagtgtccattgaggttggtgatcatgaatatatagtgaagtcagtcagctgggttatgtgatttttcttcagcaacattcagctgatggggcataggcactagaaaaggcagacaatgggatttaaccaggatgggagtggtgtcaggtggcagtgatggagaggacaaatgatggagggtattggcaagggagagatggtaattatggaacacggcatcaaaatgggacaaagagggtgcagaaccggagtgggtagataatggaaaaggggcatcgaaaacaccgggtaccga

SEQ ID NO: 639978 - DNA, 689 bp, Homo sapiens
aaaatccagcccataccctttgaggtaaaaacttcgggccaggcctcccttcataagtgccaggcctttcaaaaccacgtggatttttcttttcattgggaactgggccactaaaattttaagggctatatcaaaacacaagttgcatgcagttttcagtaagggttcaaaaaggtaaaatgcaatgctttgtaatttacaaaggaagaatatttaactgctcaaattacatgccgggtcactgcttttaatttaaaaaataaaagagcgtcataagaatctggtttctcttgatacatagtaaagggtgttttgtgtctgcatgcataaggtgattccaggggaggggatgaaagatatgtgacatcttccctgaaattttatattgatatgcaatgctttgtcatttaaaacctaagctaatgttttctacaatccataactctgagtttatctttttggaaacatagaaggggatgacattgaagataaaatggatacagcaattgctgaatgacagtttgcccaaattagtgcagttaaaatatgctgacgcccctgcatggccaggaagacttttgctccatgcacacaagcaccaagtatcaagcgaccaccaacacgttcccattcctttaggccaccatagctttgcttttgctttctgtttcctgaactaaaaaaaaaaa

SEQ ID NO: 639979 - DNA, 125 bp, Homo sapiens
gctaaaaggctggaaggatttgttggtgtgatctatagattcaacctgaagaaaagagagcccataaatacaggcctacgcatatatggacaactgatttttgatagaagcgaaaggcaattcag

SEQ ID NO: 639980 - DNA, 167 bp, Homo sapiens
ccagctactttaggggctgaggcaggaggatcacttgagcttgggaggttgagactatagtgagtcctgaacatgccactgcattccagcctgtctgacagagtgagaccctttctctaaacagaaactcaggctgggcacagtggaatacgcttgtaatcccagca

SEQ ID NO: 639981 - DNA, 217 bp, Homo sapiens
  misc_feature (99)..(99): n is a, c, g, or t
  misc_feature (132)..(132): n is a, c, g, or t
  misc_feature (150)..(150): n is a, c, g, or t
atctacaggatctcggaattgtgtggtgttatgggtacccatttgggaacacccataattagtttatactgagtgggtggttaaagttcatcccgaggncccagcgggatgtcggttcaaacatgactaatntatcctgtaagtcgtaancacatcttttttctttcttactttttttgacaggggagatcacccaatgttaatgccgggactcgaa

SEQ ID NO: 639982 - DNA, 221 bp, Homo sapiens
cgttatccctttgtgcctgatcggcctgcatggtatgactctcggaatcatgcgtagctgctccgtcatttgagtgctcatcatatgcgccttgatgttgatcatagcctgactgctggtcatctgaatcttgttgaccctcgtcaggctgatcatcaggaaggtgcccttccaccttggattcctgatgattccatgttatgctgctgtccctggttcat

SEQ ID NO: 639983 - DNA, 340 bp, Homo sapiens
gctgggcagatggtgaaaccccatctctattgcaaatagaaatctttgccaggtatgtggcttgggctccttgtaatcctagctactttgtacgctgaagcatagaactgcctgaaccctggcaggcggaggttgctgtgagccaaggtcgccccaccgcacttcagccttgtggttacagagcgagacgtccgtctcaccaataaaagaaaaagcagctagctcatacatagttgtaagaacttatagatagatttcaaatgattagaacagtgcctggagtatagcaagaactcaatcattgtagctgtactatttagaaaaaaacaattgtggtgag

SEQ ID NO: 639984 - DNA, 572 bp, Homo sapiens
ggtcttgaactcctcagctgatccacctgccttgtcctcccaaagtgtgggattacaggtgtgagccaccacgcctgaccgtattttattattttattattatttttgagacaggttctccctctgtcacccaggctgggggacagttgacgcaatcatggctcactgcaagcttgacctctgggctcaagtgatcctcctacctcagcctcctgagtagctgggactacaggcttgcacaccatgcccaactaattttgattatttgtagagatggggtctctctattttgcccaggttggtcttaacctcctgggctcaagcgatcctcccacctcaacctctcaatgtgtcgggattacaggcgtgagccaccaacccagcccactttatttttgcttagtcacaagaacaaaatggttttctttgttgagataaagtctcgctctatggcccaggctggagtgcagtgggcgatctcagctcactgcaacctctgcctccaggttccagtgattctgctgcctcagactccctagtagctgaactgcaggcatgtgccatgcatccag

SEQ ID NO: 639985 - DNA, 474 bp, Homo sapiens
catttggctgccttggtctagactcagtgtgctaatcaccatttgtctaattagtactgtgggaccatcacaggataaatggcacagcactcaccattgcagacttgtgcccaggcccccagacacctgagttgggtgtcctttactgccttacatagaagcctgggctccgaggttcagggacctcccaaggacctaggtgtcactacatgtgctgctgctgactgaaagtgctgacggagttcataagctagtcaggggccgcagctttaaggctgggttctggtcacaggctgccttccaggtacccaggaggaagctgggggcttgtgtgtgctgaggaagggacctgaggcagaggagaggggttgccttgacagtgctgtggcacacatggcggagtccgaggcagatcttatggatgttgcatttattgcaaaattctacaataaagacttttaaaaagttaaaaaa

SEQ ID NO: 639986 - DNA, 189 bp, Homo sapiens
cccccgggccccccccccccattttctccggccccgcgggggttcctttgtggggggccccggttgggggttcccggcccaacggggttcccttccccccccccccccccttgcccttttttaggtttggaggggctttggtttttttttggggggtgggttttggggataaaatttttcccctcttta

SEQ ID NO: 639987 - DNA, 645 bp, Homo sapiens
  misc_feature (630)..(630): n is a, c, g, or t
aacatggagaaaccccgtctccactaaaatacaaaattagctgggcgtgggggcgcatgcctgtaatcacagctgcaggagaatcgcttgaacctgggaggtggaggtgtggtgaaccaagactgcaccattgcactgcagcctgggcaacgagagtgaaactctgtctcacaaaaaaaaaacccaaaaaacaaaaaaacaataccaaatttgggccaaagatgtttacaaaccggaaccctaggacaccgtgggtagacattggtaaacaatttcagccaccgttgaacaccagttctggggcctcctccaaaagttaaagagaatggtcatatgatcaagcaatggattctaagaaagacacccaaaagaactcaaagcgggtatcaaacaatttatggtacacaagtgttcacacgaactattcatggtagccaaatatgtgtcaacaacccaacatatttatcaagtgatgaataaccaatgtggtggggtatcacatctggtggaatggaaatattattcaggcataacaacagaatgagtggtgtacatgcccaataattgaccttgatacttgaaaataacagagccagaaaaagcatatacgctgatccatttaacaaaggncagatagtaatagag

SEQ ID NO: 639988 - DNA, 251 bp, Homo sapiens
ttttgccatcggtatagcactaacaaatcaaattagtactcactgacaaaatactttaaaaaggagagggtcacaaagctcccctccaaccaaaaaaatgtaaaatagtcccagaagagtgaattaaaatgctcattttagttttcctgaggtctaaatctcctcaggcaccttctgtgatcttttatttagagggaaaaaattttcggctgtccgcctgtactttctccatcaggcattcagccccaaag

SEQ ID NO: 639989 - DNA, 1034 bp, Homo sapiens
gtctgttggtggtcgtggctgccgtcttcgactccgttgccgctggttattcgtgtgtgtgcgtcttggttctgcattcgtctcttgtttggcgtgttgaccggggctcttgtgtcgtttgcgtccgtgttgttgcggtcgtggttatctcctgcttggttggttcccgtctcgtttgccgtgcgtcttgcggtggctgtctatggcattgatgcttctggagtggcttttgtgcccgggcatggttatgttgttgtcttttctctttccagcgttgtgctgttgtggtttaacgggggtgctcttctgttgttgtctgcttctgtctgggggtagtcgagcgttcggggctctggatggttctctggtggggtttcggttatgtggttggtcttgtgcttgctagtcgcttgggtctcttggttttgctcatcttcctttggtgtgaggtgcggtgtgcgtctcttccgtttgctgcttctccggtcctctttggtgtagagtgtggtgcttgcttggggtcgctcgatgggtccttgacactggcatgggccctccatcagtggaatctggggcagtctggaccctccatagcctcggagtgttctgttagctctgtggccctaccctacaccatcctctacgccttcagactcagctctctagtacagagacctgctgccaggcacggtggctcacgtctgtaaccccagcactttgggatggctgaggaaggtggatgacttgagcccaggagtttgagaccagcctgggcaacatggcgaaacccctgtctctacagctgaatttttaataatattagccaggcagccaggtgcggtcacagcactttgggaggccgaggcaggcgaagcacctgaggtgcacggagttcgaggccagcctggccaacatgacaagacgccgtcgtccactaaaaatagaaaaattagctgggtgtaggggcgcacgcgtgtaatccccagctacactcaaggagcgctgtaggtacggagtatcgaccttgaagcctt

SEQ ID NO: 639990 - DNA, 601 bp, Homo sapiens
tggcgccccccttttttttttttatttaacacaaaagggggggggggggggcccgggtgggtgggcccgccccccacccggcccccccccgcgcaaggagcgcctcggccgataaaaaaaaggggtacgctgagcggcgagcacacaccaagtaccaacccacgaagaagaaaagaacgagatgccgcgaaagaaccaaccaagaggcggggagaaacacaggaactcattggttgccgagagaaagccgtcccccgcaggagcaaaagatagagcgaggcgacgaggggggagcgaaacacagaacaaacaaaagaaaagaacgcacacacagctgggggcgcccacgagcgtggaaaccccaccgaatgtggtggacgcgaagagcaagggggggaacaacacggagctagaagcagcagtagtgtgaaaggacacacaagtaactgcagcgggaagacagcgcaaaacaaaaaacgcgcgtggcacaaaaacaagcaggagcggttcacacactggtggaaccagccaccacaacaacaggaaggcacgagcgaaaaaacggactgcccacatatggctgcccgcacaccaacaaaca

SEQ ID NO: 639991 - DNA, 122 bp, Homo sapiens
ctatctatctctgcagagatggcacttctgcatcagtcattgactccaagaatgctctctctagtgccacgacaccacgtgctccagctagatcatgcaggtgatctcccgtaaagccatag

SEQ ID NO: 639992 - DNA, 422 bp, Homo sapiens
gccgcactgtcatcgtggacaccagccgtgtgcagcctatgatgctgtctagggcatcgatggtactgggcaggaccggatgtcaggtactgtgcacgcaggtgcacgtggaattgatggtctacacgagcctatgcatcatgcgcggtgtataacgccatacgagctagggcgacatgctgaccattgaggagtcagagcgagaagcccggcggttagcctgagcttggctgatcgctgggtctcggatgtacggtacaatcacttgtactatgggaatggattgacacactctgctcgtgctgattgatcggcgactgtactggtaagctgatgttcatggcgtcgagcacaagctaactcactgactttgctgggctatacgactcacatgatgggaccctcactactcacgcctctgt

SEQ ID NO: 639993 - DNA, 216 bp, Homo sapiens
ttgcaaatactggggcactcagacctacgaagacagcaggctggaccatactgggtgtgctccaggactggatttccttaagagagtaccctggggcacaccaggatgctgattaccaaattatcctctgctgtttgttctcttcacttcttcggccaagaaaaccactggttttcttgttccaggaaagccagatcccccatcctggagttttaa

SEQ ID NO: 639994 - DNA, 810 bp, Homo sapiens
ccacgcgtacgtgcagactttgaaaagcagtagatacaagtggaagaagaacaagtgcttgaaaagtaatgcgaagcttttgtgagaagtttaatgagaaggattagaaggagatggattaagatgagccctaatagggcagcacttaaagacaccaggatagatctttgagtagtttgtagaatggatgactaatattggaagaggagtggctggagatcatgttggaaacccatctcaagggtgaaacttctttgttgccaggtacagatggtagatgaaattttactctatataattaagggagggcaaatcaccaaaggggagaaacaaatgaatatcatgtaagtgcggtattaaagttactcttagaagttactctgtcatgtgaagattttctacagatgagagacagacactagagagaatttggctaggaagtgccattcaggaggagacagagtccatctgaatgaaatatggacagcagctaaaagaagggaggctgaagataaggtagcgtacatctttagggcaagataggtaaccaggagcaaacggaatagaagaaaacattaaagttgaactccaggatgacaaacggtcactttcgcaacgaactggcaaggaccagacctgcgagagacaagaccccataattgggcccaaaaggaacatcgaccgaaggggctaaaaggcgtacaggaggagccataaacataacgcgcagactacatgcatccggacaaaaggcgaacgaaggcagactaagaacagaccaccaagaccccacaaaaagcgacacctgga

SEQ ID NO: 639995 - DNA, 423 bp, Homo sapiens
gagagagagagagagagagagagagagagagagagagagagagagagagagagagagagagagagagagagagagagagagagagagagagagagagagatatagagctgtgacttaagtcgatctgcactgatacatacgcctgctgcatatcagtgacagctatcctacgtggtgtatccctgacatctgtgtgtggtgcggatggttatgggcctgcttgttgcctccagctttgtgattcctccttgtaccatggtgctcttcacttatgatctggcgtgttcaggtggatttctgagtgcctggatctgctctgtctgttcgatgagtgtgcacaccttatcctgcatgttctctcggtccagatctgtgtcatgctctttgtattcgcattcgctgtcctttctttggttgcgtcct

SEQ ID NO: 639996 - DNA, 1021 bp, Homo sapiens
ttttcccccgggttcttaaggtgtaccccgtggtggggccgaccggcaggttgttgtggccgcagcggatttgacatgattgtgttcttctcaccgtttctttgctcggggggttgttccccctagagcgcccctctagagctttcctcacaagaggggggtgctcccaccccttctgttgtgggcgcacccacgccccgagaaagtagacggtggtctccccccctcctctgagtggactccctccctgggaggccgcgttgtcgtgccacaaagggtggcccccctcttatttttttgggggccaattggcaatctctctgcttttgcgtgtagcgccgcctttttctttgtggcacacgaccccttggggcacaacgtagaagggcgcttcccctttctctcccgccccttgtgagaggtctctcccaccacagagagggaggtttttataaagagattgtcgcccacagggggcgtctccccttttttttcacacaggaccgcgcacaaacctggagtatctcacaggacccaaatagcctctccaccctcgagacttatttggagccctcattttctttgagacacacagagagctacttcacacacacctctctttggggggtgcctttttttgccccactcattctggtggaaaatgtgaccaccacagagcttttgttcactacgtcttgaaaagagctctcttttgtggtgggagacaacagaaaaccgggggggtctcacccctctccgcgaagtccttgtgttggtgccagaacagaagcggccgggcttgttgtgagaaagatttgtacccttaaagttctcattgacaccccacacctcccgagatttggcccctggcccgcttctcagaccctggaggagaaagaaaacacgcatttatggggcccctgtaagaaaagaaccccatttccaagagaaaaaggggctttattcccgggaccaatttttccattgggggggtttccaaaaaagtttttttccccctgga

SEQ ID NO: 639997 - DNA, 215 bp, Homo sapiens
  misc_feature (134)..(134): n is a, c, g, or t
catcactttctcaaagagctggaaattaagggacaaagcctaccacctaggtacggacatactaagagggtaggaaggatactactagagtactctacctaggtacctagttttccacataaggttagcagggnaaagcccagaatagaccgagaccggaataggtagcaagctacttcctgtaagtagcatatcagtaacaatagtaactaggc

SEQ ID NO: 639998 - DNA, 285 bp, Homo sapiens
  misc_feature (216)..(216): n is a, c, g, or t
  misc_feature (225)..(225): n is a, c, g, or t
agcgtccgctatgaaggactgggtctacggcttggactcaccctgacagacccgcaagaaaaacaactggttcttgccagcctctagagaaatccagaacactcagccctgacacgttaatagcccgtgcacagatcagaggctgtggccacacataccaccaagccacagatgtcttccacaagcacgttcttaccttagccacgaagtgaccanagcccacancgtacctaaaggttgaactcaaagatatgtacagggtattaaacaaatccaagggacagt

SEQ ID NO: 639999 - DNA, 658 bp, Homo sapiens
gtaaagccaagaatgatgcggaacgaaacaaaattaataacaagtttgcaaaccagatagcaatgtcagtcaagttaggcaacggtattacggatccgagcatgaatataagattagccaccagcatcgagctagcaaataaaaacaatgtcagcaaaaaagttattgagaacgccatccggaaagcttctggaagcagcgcatcgggcaaggactcaaacgcttctgagctatgtgtatacgagggaagggggcccggcggggtcgctatagtggtggaagcgctgacagacaacaagaacaggaccataggtctgataaggagtgcatttaataaagctaatggatcgatgactccaacgttgtttttcttcgacaaaaaaggatacgttacaatggtacctccgaagatgttagacactgaggacaaggtgctagaaagcgtactggagattcaaggcatcgaagacattgcgcctgtgcaggaagacgcagaagatttagagtgtgataccgaaactgaaactacaggccaaacttacgaagcggtgatggaacctgccgataccaataaggtggccgccctactgaaggagcgtggtttccacatcagagacttgggcatcggctacaatgaaaagccggataggaagttttc

SEQ ID NO: 640000 - DNA, 97 bp, Homo sapiens
gaattctgtcttgttgccttttgattcctttttcttctgcatttgtgtgtttttttaagacttgagagttttatacttgcatgtgtttttattttgg

SEQ ID NO: 640001 - DNA, 121 bp, Homo sapiens
tcgtctcgagtacttcgtttcgagtacttcgtttcgagtacttcgtatcgagtacttcgtttcgagtacttcgtttcgagtacttcgttacgagtacttcgtttcgagtacttcgttacga

SEQ ID NO: 640002 - DNA, 746 bp, Homo sapiens
agatcgacagtatcatgcaacaaggtacacgaccaatgaagaattgatctggacagtactggcggtgaaagtttgcacccattgtgcgagtgaggagccatcgaaaatatggcccaccgcgacgggcgccttgtgtgcatatccacatagctgacgtggttctgacgaggattcacttatcaagatataacaattctacactcgaatcagtttggaaatattctcatccttagtggggatgttaattgtggcagacagtgattttggcatatacccgggcatcatgggcagtggcaaagaagattacattgcaaagatgtactcattccgggaggtggagacggaggcatattgtgtgaaatagtcaaattaaaaaccaaagatgttcactatggtagagatggaccaaattgttgatttgatgggtgtacgaaataaatgcgaaaaagtgtgggggatgtctaagacaatcttaaaggaagagtgggaatcaggttctaattagaagactgtatccgggtatgaagaggttacgccaaagaagggagagaagacttgtgacttatgtgattaactgattgaaaagttgttccaatctccagttccaagaaagaaagaatccaattgggagtttctaagactggattctggagctctcaattgacaggtgttggaacaggatgggcaaatattttacaccatgggcactgggttaatctgcacagaaggattgtgtctattgaaga

SEQ ID NO: 640003 - DNA, 123 bp, Homo sapiens
gtaccctaggcttggaactttgaatagttacttaacctaagcctgagctttaatctataaaagggaagataacatctggtagggatgtgtctgtcacatgtaagcgctccaaagcctgttagg

SEQ ID NO: 640004 - DNA, 192 bp, Homo sapiens
agccatcctggagggcagacacgctcacagagtcagaggtttgcattgtggacagtgatagggaattgaggggcagagaatgagaaggagttgaggggagacgcatctcacagatagtcagatggagagacagagggacagtgagtaaagactgacacaggcgtatcaatgacagagatgcagactgggcgc

SEQ ID NO: 640005 - DNA, 1242 bp, Homo sapiens
aaacaagcaccaacaagacctcaaagcaaacacaaacaaccaacgcagccacaccaaccacacgacacgcagccaccccaaccgacgcaccccaccccacccacacacgcccaaaaacacagccccacaccccatcttcccccctccacaccccacaacccacacaccatctaacaccctcaactacgacaaacacccacaaacaccatcccccgcccctcaacatccccctacacacaacaccactactcacactccccagcaccccacaacaccgccgggcacagcgcccgaacgcccgcacccccccccaccccgccccggacagacaacccactcagacccacgcacggcccccgacgcgacgccgccatacagtgacctccacagagcggagggcgccggacaccctccccccatctcccaccactccgtgcgatcagtccccccccccactgtggccacaggctcaacctacccacacgccctgcagcggcgcgccagccaccgcgccgacccgccgccccctcaccgacgcccccccgaccccgcaggccaccccccccctcgccacccaacgagggccccgcaaacccgcccccgccgtccgaccccgccgccggggtggcgcgcgggcagtaactagaacagtgcgcccgccggcccgagccaccccgcccacgaccccacctccgaccgcacaacggcgcgccccgggtacgctgctccagcagacagcgatgctagacaggcaacacgcgcgcgacctcccctcacccctcctccctccgctggcgaaccgccgggatagcacgggccagaggtgcaggcggacacaaggaagtgccgcacgacggaggcagcgcgccccttcccgctcgccccgacgagcgaagccgcgggacgcacgcgaccccctcgccacccccgcagccgcccgcagcggagacacaccccgcgcccaaggactcgactggaggagtacggccgctcaccagacgcgagcttccctccgacgcagccacagcacaggaggccaagacccagacccatcccccgagaccaccgcccacctacgcacggcccccccccccgcccaccaacgccgcgagcaccagtgcaacccgccccgcacacacacgacccccccacgcagtgcccgccccgacgagcagcctcgccgaaccgacgagccgacatccacacacaacgcccgccacccgtgacgagcaaccccccggg

SEQ ID NO: 640006 - DNA, 386 bp, Homo sapiens
  misc_feature (29)..(29): n is a, c, g, or t
  misc_feature (47)..(47): n is a, c, g, or t
  misc_feature (68)..(68): n is a, c, g, or t
  misc_feature (80)..(80): n is a, c, g, or t
  misc_feature (144)..(144): n is a, c, g, or t
  misc_feature (196)..(196): n is a, c, g, or t
  misc_feature (269)..(269): n is a, c, g, or t
tgtcccctacaaaaaatacaaaagttaancccccagcgtggtggcanacgcctgtagccttaggctanctctggtggcanaggtgggaagcttgtttgaaccctaggaggttaaggctgcagtaagccgagattgcaccactanactccagcctgtgtgacagagtgaaaccgtgtctcaaaaataaaaagtgaantcaggagttccagaccagcctggccaaaaccgtgaaaacccatctttactaaaaatacaaaaattcgcctggncagatgcactggctcgcacctgtaatcccagcactttgggagccaaggcggggatatcactcaaggtcgggagttcgagaccaacctggccaatatggtgaaaccccatctctacta

SEQ ID NO: 640007 - DNA, 749 bp, Homo sapiens
agaagacagacacccttgaagacttgtatccaagccagccaaaatcccaaatcctcgatttcagagattatttcaggtgtctgctgcacagagctttacatccccgggagcctctataccccctaattcatgacagcatattatggaatatgctgaatcctcccgctgaggtgacaactgaaaagtcagattcctcatctctaataataaagaccctttttcctctgattgagagccaggaacaaaggatcaagtgactgctcaggagattttccaagacaaccatgaagatggacctacagctcaatacattaacatgactgagcaagggggagcccacttcagcgtgctccagtctggctgaaggcagggtcacctctgtcggaagtgtgaatcctgctgaaaacttccggtgtgctagtgaaacagaagaaggccagctttgaggaagcgagtaaccaggtcataaaattcacatctgaacagtttttggatgctaatgaaacaccgtatttgatgaagagcatagactgtgtccgagactttccgggaagaaggccattaaagtttccagaagaagcaggctttaacaagcttcctgaaagccccttcaagagaacagtgcaacttcacccaataaatcattctgggaacttgttgtccaggatggaattctctgatcaccaagaggaagccctggaagttttgttcaccgtgaggagcccaagagtttgggccccaagaaaaca

SEQ ID NO: 640008 - DNA, 327 bp, Homo sapiens
cacaaactgacaatgattccttccttattttacagctttattactgatttccctctaaaaagagactcaagtgtggagctgactcatctatagattaaggaatcacaaagtaccatagtcacttaaaaaaaaaaaaaaaaaaaaagcaattgttttacctttcaactgctgatgttatgtacaatctatcaccaaaagcatagctgtgcaatcatgagccgagtatatccacccctaggaattttggaaccggcgcattttaagcaatgggaaacctccttaccttacaaagtaaaagcattttctattttaaaatttttatttctg

SEQ ID NO: 640009 - DNA, 496 bp, Homo sapiens
cggtgggcgtacaccaaggcacgatcaccaaccttctgcattagaacttttcattctgcttatttccagctctaaaacttagctgtggttcagttcaccttaaagatagggtaattcgtaaatggcaaagttagtgttgaggcttttcctcaataacttgcttcccaggcctattaggccatctctaaaatagatctagctgctttatttttacgtactcttagttggatgtaagaaaccttacgatgagctcccttttctaaggtgtttgtggtttatgcatgtcagcttttttcctgttatttcgtttctccatttacggccgtggacccatgttttggatgcgcgatgtttatatgggagaacacaaagctgatgtgtagcccccgcaaacagagaagatccttttcttgtaaaacacaaggctctattatggaccacgaagtccgacccttcatcattaaaaattacctgcattcctgggccccaatctgcc

SEQ ID NO: 640010 - DNA, 385 bp, Homo sapiens
cgcggaatgactggacaccctgctcagatgggaaatcaagctccgcgctcctgtgactggaaaacatccagatccctgacgcacctccggcgattcccaaggaggccaggaactattacttcggctataactgttactcgaagtgggcggggccagacatggccctttcaaaactgggacaacttggtaacaggagagagggatggaaacacaaccaaggcttgggaacggtctttggtaaaagggaaactgtgggtccacattcccttcaggattaactctaggcctgggaaactttcaggccctagctgggatcttggtcacccggcctgattctgttcctcaaggtcctcctcaagctcggggaaccgagggctcgaaattc

SEQ ID NO: 640011 - DNA, 271 bp, Homo sapiens
cgggggggggtttttttttgccgggccttttttttttccccccccctccccggggggccccccccccccttttttttcccccctttgaggccccgggggcgctcccccccccgggttttttttttgggccgggggggggtttctttttttccccgggggccccttttcccccttggcccttttttggggcccttttttccccttttttttccaaaacggggggggggccgggccgggttttccggggttttttttccccccccgcccccga

SEQ ID NO: 640012 - DNA, 223 bp, Homo sapiens
gtagcagttctacgtataacctagcataaccattcttaattcaacgtatgtatattatcctacagtactaccgcacttcatacgtactcaacttaaactccagcaccacgaccctactactatctcgcacctcaacacaccgctaacatgactaacacccttcattccactccaccctcctctccctaggaggccagcccccgactaaaccggcattttagcc

SEQ ID NO: 640013 - DNA, 179 bp, Homo sapiens
ctgtgttgtggcgggtcgcttcctcttcaccttcacatgcttctggctgcgcaggttggcgctggcccggtgcagagcctgccacctcctatgtgcggaccaccatccatatgattgctcgcgccacgctcagcagcctcagacacatcatccgctccacctagtatcgcaccgacctg

SEQ ID NO: 640014 - DNA, 772 bp, Homo sapiens
gggcaacaatgcgagagaagcccggaacccccagagatacggctgaacaggaaagaggcccagggtgcagacacagcgtaggaagtgcctcgttccggtacctgggccgggtgcaatggcgcgtgaacccctctcggacaccggggcggcaggcaccgcgtatccagaggagcagtggcctcacacctaggggcccctatccacacggtatgcctaaggcatcggggtattgctgctgtcagcgtctgctgtgcagactcatttctcaaggtggccaagccgggcaccaccgtatctcccattagaggatgtactttgtaggggtgtaagtgcaccgacgaggaggtcctcgccccaacacagtgtgtcaagctgtgctggtgccacccatctacccgctagaccggtgctgctatgggaaattcctgctagactgtcgcacaggctggacccctggaagatgcatggaagcctggaaagctggtgggtggctctgacggggaaatggaactgcgcccttttgctcctggttccagggagtcctgggcatctgcggtgtgagcaatagcctggcttcagagctgagagtgccaggggccacaggaaaggcaggaacaggaccttatctctgcaaggcccaacgcaggggcccttactggctgcagcaatagatctgtttccttataccagatcatcagtcctcactaaagacagcgatatgggagacaccagggcctggcccgccagcacaaagatgtcatcggagagagaa

SEQ ID NO: 640015 - DNA, 343 bp, Homo sapiens
ctgagaaggcatggcggaccctttcgtcatcgtgctgcccaggtccctgatgaccacctcctgaaagagcagcacctggccagcctccatcaagctctgtgggtattaactacccatttaactacactaagccaggtaggaaggtagtccactaactacactaaccagcccagaaaaacaaccgtattagactatactaacgtaccctgtgaaaccagccctagtcaacactaagccagtgggatactagtccattaactatactaaccagcccaggagaacgacccattaagtacactaatcagcccattatcaaccaggccattatcgacactaactatgt

SEQ ID NO: 640016 - DNA, 259 bp, Homo sapiens
  misc_feature (33)..(33): n is a, c, g, or t
aaaatcaagttattcaataggtggggtgcaagntgtcacgcctgtaattccgagcactttgggaggccgaggagggcagatcacaaggtcgggagttcaagaccagcctgaccaacatggtaaaactccgtctctactaaaaattcaaaaattagccggccgtggtggtggacatctgtaatcccagctacttagggggctgaggcaggagaatcgcttgaacgggggcaggtcggggcagggcggcaactccctctta

SEQ ID NO: 640017 - DNA, 116 bp, Homo sapiens
  misc_feature (63)..(63): n is a, c, g, or t
  misc_feature (85)..(85): n is a, c, g, or t
  misc_feature (93)..(93): n is a, c, g, or t
caggcggccgggggacggtgcatcaagcagggggagtaactggtacagtcccaccgagtgtgnggccatgggaggaagagccagnagtaaggnctggaaaagaagtattcgctacg

SEQ ID NO: 640018 - DNA, 140 bp, Homo sapiens
cgatggaatctagtaactcgggttgaaatcagccaccgttcccaaacgacagcgtagtgtatcctaagcttgttaatatccatctctggcagcattaagcacggataggaccaatagcaacttcggtgacgaccttcgac

SEQ ID NO: 640019 - DNA, 1108 bp, Homo sapiens
  misc_feature (123)..(123): n is a, c, g, or t
tcctgattaacagtcctacgttatctgtaatagagagtcagcctggtaccttactgagaaattcatcagctttttcctaccaaaggcagacatctaaccgttccgcacaccctccaggggcanatccaaccatcagcacagccagtggtgacaaccagttggcatctcggcagcaacagcatgtgtccatggccacatgctcgcagcacaggcaggcatccagggcatgcagaagcaccaacgttcaggcacagtctagaactagcaggtcatctcagtgcagtcattatctgaacaccactagtagcatgtctccaggccatgacaggcacagacctggtggccattctagcaggaccagtagtacgggaccctgccagtgtctgtccggaagcagagaccctccagtctcttactgaactccttatggctcagcctagatgcgtgcagatccagaaagcctggttgctgtgggggtggtcccggtggtgatggactcgcgagagcactgtgcaggagcaaggacctggcagtacactggaccagctgctgctgcagacccatccggcatccacagtcataaacacatctggggacgacagacaggtactcgacctgcgccgccaactcactctcctcaccacccgaaagccaggcaacagagccgacattcaatcaggctaaacaaaatcggtccaaagaaaagacacaccacgcacccacacacaacaagcaagctacactatcaacacatggcaccgaacgactccggcaccagccctcggacgactgcaccaccagaaacagcatcgcccctcaaccaccgacggacccacgacagacaaaccaaatctcggagacaaacacccaccaaacgaaaacaccccaacaagcagcgacgaaccacgcggcgtggcggggcacagcgaagaactcacgaccgaacgcgcaaaggacgacagaacgaccaacgcacagcaaaaggacagacaaaacgaaacagagaaacgacaaaggcgacgacgacaccacaggcaagcaaggaaggaggaaaacaacgaaacaacacggagcgagaacaggatcacagccaacacagagaccaaga

SEQ ID NO: 640020 - DNA, 185 bp, Homo sapiens
atgaggtggtggagctggcacacacttgtatagtgaaatgttaacatgtgggaaaactccgccttagacaaactcaccaaagtacaatcgtgtctctctctagccggaatgctacagagagaaacggacaccttagatttgcaacaaaagtctgtccactggtctgtttgccaaagtgaacactg

SEQ ID NO: 640021 - DNA, 162 bp, Homo sapiens
ctctagacggatcccgaaggcgcacgatgggcgtcctcctgggggagctcgtgcctcccagccatgacctcagtgctcatggggacggccccaggctgtccaggctcggtgtcaaacttgcaggacggaggaaactgaggcgcaggaggaggaaactgaggc

SEQ ID NO: 640022 - DNA, 210 bp, Homo sapiens
ggggggggttttccttttttcccccccggggggccgttggggggggggggcccccttttggtgggcccctttttccccggggggtttaaaccccccttttttgggggggggggcccccccccttggggggcctttttttttttgggggggggccccccccccctttccccccccccccccccccagcatttaagggggttttttccccca

SEQ ID NO: 640023 - DNA, 132 bp, Homo sapiens
agcttcctccaacccccaagctggactcttaccttattgagggtacgaacagcagcatagcggagagcagccttgggtgagctgcagaaaagctggagcactgtggggagatggatgccacatgtcaggttg

SEQ ID NO: 640024 - DNA, 325 bp, Homo sapiens
cgccggtatcggcgtcaacgatgttcttggccagcacgcggccgtacaggaagtcttccggcacggagatgcgctggatgccgccggcagccaggtcgcgcagatgcttggcgttgatacgcttgtctttttcgacgatgaccttgccggagcggtccgcgacgtcgaaacgggccatttcgcccttccaacgctcgggcacgaactccatcatgccgccttcgctcttcagttcgaagttgtcgaagtcgaagaagttggccaggatcgattccggcgtcatgccgatcgccttgcacaggatcgtcacgggcatcttgcggcg

SEQ ID NO: 640025 - DNA, 336 bp, Homo sapiens
  misc_feature (18)..(18): n is a, c, g, or t
  misc_feature (166)..(166): n is a, c, g, or t
  misc_feature (171)..(171): n is a, c, g, or t
  misc_feature (173)..(173): n is a, c, g, or t
  misc_feature (195)..(195): n is a, c, g, or t
  misc_feature (197)..(197): n is a, c, g, or t
  misc_feature (199)..(199): n is a, c, g, or t
  misc_feature (206)..(207): n is a, c, g, or t
  misc_feature (236)..(236): n is a, c, g, or t
  misc_feature (253)..(253): n is a, c, g, or t
  misc_feature (291)..(291): n is a, c, g, or t
cttaatatgttgcttcanttactgtttccaagaacctatcagcaaagttaagtgagagtttattatacgcatatataacttatataggtatgtgtgtgtgtgtgagacacacatttttatatatagatagatctcaacagaacttcagtaggcttcctactaaatnagacnanattaacaggtaatagttattangnantaaggtnntaattgggggcttactatacacttagcantgttctaagctggttgntgacagtgcatttaagaaatctagaaggtgggtaggtnccttaaatcagtggtggccaaccctttgaatgtgagggcattttt

SEQ ID NO: 640026 - DNA, 284 bp, Homo sapiens
taattcggattcttcaaatctaagagtgcctggctcaaaattaaaatacctacaactatgccaaaactggactctttaattgccttactggaacagtagctgattcaagcaacgaacaaatcctcttctctgatttagtgaacaatgattaactgactcatttgactggtttgcggacttgcagcctgaggacacattccccaccacactgagcctgcactctcatcaatgcaaatgaacattttgcttattcagattgggggggtgaaggaagtacaaaaggg

SEQ ID NO: 640027 - DNA, 229 bp, Homo sapiens
  misc_feature (1)..(1): n is a, c, g, or t
nctgcaacgcccggctagttttttttgtaattttagtagagatgggatttgtctcatgttggtcagtctgatcttgagctcctgacctcgggtgatccgcctgcctcgagctccctaagtgctgggattataggcgtgagctgaaaaccgtggccagcatcttttttttttcacagaaaagatggggctctcactatgtacctcagcgctggctttcgaactcctgtgg

SEQ ID NO: 640028 - DNA, 387 bp, Homo sapiens
gacgaccttggtggctcacgcctgtaattccaacattttgggaagctgaggtgggtggatcacttgaggtcaggagttcgagagcggcctggccaacatggcaaaaccccatctctactaaaaatataaaaattagccaggtgtggtggcgtgtgcctgtaatcccagctactcaggagggtgagacaggtgaatcgcttgaacccaggaggcagaggctgcagtgagccaagatcgtgccactgcaccccagcctaagcgacacagcaagactctgtcttcaaaaaaaaatattgaaataaaataaaaattactatattcaaaattctcggaaaattttattaattcagggtcgtcatcaaggggggggtaccggagcttcgaatt

SEQ ID NO: 640029 - DNA, 400 bp, Homo sapiens
  misc_feature (10)..(10): n is a, c, g, or t
  misc_feature (14)..(14): n is a, c, g, or t
  misc_feature (18)..(18): n is a, c, g, or t
  misc_feature (96)..(96): n is a, c, g, or t
  misc_feature (101)..(101): n is a, c, g, or t
  misc_feature (115)..(115): n is a, c, g, or t
  misc_feature (155)..(155): n is a, c, g, or t
  misc_feature (162)..(162): n is a, c, g, or t
  misc_feature (184)..(184): n is a, c, g, or t
  misc_feature (220)..(220): n is a, c, g, or t
  misc_feature (238)..(238): n is a, c, g, or t
  misc_feature (240)..(240): n is a, c, g, or t
  misc_feature (248)..(248): n is a, c, g, or t
  misc_feature (259)..(259): n is a, c, g, or t
  misc_feature (284)..(284): n is a, c, g, or t
  misc_feature (311)..(311): n is a, c, g, or t
  misc_feature (313)..(313): n is a, c, g, or t
  misc_feature (354)..(354): n is a, c, g, or t
  misc_feature (368)..(368): n is a, c, g, or t
  misc_feature (375)..(375): n is a, c, g, or t
  misc_feature (391)..(391): n is a, c, g, or t
tgttgctgantttnaccntgtattgaagttaactgttccccgtggtattaacgtgtcagggctgagtgttctgggatttctctagaggctggcaanaaccngttgttttgtcttncgggtctgtcagggttggaaagtccaagccgtaggacccngtttccnttcttagctgatgtctttggcnagaacaccggggctgttacttgctttgagttggaangggtttgcatttacgccngnaaatgtantcaatcgtaanttatgtaaggttttttttgtacgcnattctcgattctttgaagagatgacgncnaattttggttttctactgttatgtgagaacattaggccccngcaacacgtcattntgtaagnaaaaataaaagttctnccgtttcgg

SEQ ID NO: 640030 - DNA, 443 bp, Homo sapiens
tatccctccctttaaattccccccaccctttccctcatcatcccacccccaagaagaaggaataaagatggctgagcaaaaaaaaaaaaaaaaaaaaaaaaaaaaaaaaaaaaaaaaaaaaaaaaaaaaaaaaaaaaaaaaaaaacaacaaaaaaaaaacaaaagcaaaaaacacatgaacggggccggaagcgacaagcaaacatcgcgaagaggaccaccccatcacatcagcacccaccacaacagaagaacaccaacggcaaacccagacaaacgcacgacaaaggataaaaagggacgcagagaatggcagacgcgacaaccaaccacgaaagagagacacaagaagcatagacaagaagatagaaaagaagaacaacccaccacacacaacactgtcgagcagaacaacagcaacaccaggaagaaaaacaccaaag

SEQ ID NO: 640031 - DNA, 95 bp, Homo sapiens
tcaagcttctaacgatgtacggggacatgtatcagtattccattcttcttttctatggctgaataataattgtatgtatatactgcaaaaaaaaa

SEQ ID NO: 640032 - DNA, 472 bp, Homo sapiens
  misc_feature (162)..(162): n is a, c, g, or t
  misc_feature (209)..(209): n is a, c, g, or t
  misc_feature (247)..(247): n is a, c, g, or t
  misc_feature (249)..(249): n is a, c, g, or t
  misc_feature (351)..(351): n is a, c, g, or t
  misc_feature (367)..(367): n is a, c, g, or t
  misc_feature (389)..(389): n is a, c, g, or t
  misc_feature (431)..(431): n is a, c, g, or t
  misc_feature (470)..(470): n is a, c, g, or t
ggagcaactcgctcagagcctgggaacatcacggcgataagaaggctttcctcctcagaggcctcttgtggctttccacaacttcttgtcccatatttttatggccagttaatacaggcaccccataagcctttcccccaacagataccaagcaggcgtgantaacactggtctctgcctcctgctccctgcaggtgccagggcgtgantaacgctgatgtctgcttccgcagtgccagggcgtgantnacactggtccccgcctcctggggccctgcaggtgtgggatgctgctggctgtgcaccgtgggggttcctgagcgtgggggtcactggggaacgacccttgtnttaatttttccaatcntcagcctctggggattcatttntgatgaaagggaaagagcttccctgttgcagttgcgtgttcnttcaattttttgggttttgatttccctgtttgggttcanat

SEQ ID NO: 640033 - DNA, 382 bp, Homo sapiens
tcctggcctcaggtaagccacccaccttggccttccaaagtggcgggattacaggcatgagccactgcaactggccaaaaatttttttaaaaatcatttttacattacttcattgtgtcccttaattttaaaatttcttttgggtcactgacttgaaaaaatatttcttaattccagcttaacttctatccttttttttcaggaagcagaaatgtttaatgaattgagttttttgaaaatattgaaagaattaaaagaaaagtgagtgttttgtcattatctagttacattatgggacctgaagtgaggaacaattggagatgggcttttttggttcctggttgctttaaccatctgccttactgattaaaatgtcaatgta

SEQ ID NO: 640034 - DNA, 436 bp, Homo sapiens
ggaggcagcgctggcggggggctggggccactgaggaaatcatccgcgccgccgcgcgcgcgccgcgccgcgctccgccgcggaggaagacagcgccgcccggcaccgcagcgacccccgccgagagtcccaccgcacaggcctcgggccagcggcaggagctgcctccccaggaggggggacgcgaccaggggtgcatacgttaggacgttagtagttaccgtggcgtcgttatacaaaggatgcttggtagtagaaacttgtggattcgtcgagttctatagtgtcgacctaaactagacggacgggatctaccggttgacggggactcgaattggcgcgtagaacctcaaagcctgcacctcagcgatggggcatggcaataggccacctgggagctgggagccaccgggggtggcagaccataaccaccata

SEQ ID NO: 640035 - DNA, 553 bp, Homo sapiens
  misc_feature (1)..(2): n is a, c, g, or t
  misc_feature (15)..(15): n is a, c, g, or t
  misc_feature (187)..(187): n is a, c, g, or t
  misc_feature (319)..(319): n is a, c, g, or t
nncgactctagaggnacccctctctcactctgataatagtttcgttgtctatgcagaggcactttagttcaattaggttccatttgtcaatttttgcttttgttgcaattacttttggcgaattcatcataaagtctttgcccatgcctatgtcctgaatggtattgcctagactttcttctagggnttttatagttttgggttttacatttaactctttaatctatcttgagttaatttttgtataaggtgtaaggaagggatccagattcaattttctgcctatgactagccaacgaaactattatcagagtgaganagagagaaaatttttgcaatctatctatctgacaaaagtctactatccagaatctacaaggaacttaagccgatttacaagaaaaaaacaaccccattataaagatggcaaagaatatgaacagacacttctcaaaaacagtcaaaagtcttataataaactttcataagatttgcatgtcaatcccaagaggtatttcacacatgtacacctcccaatatactttgaaaacat

SEQ ID NO: 640036 - DNA, 580 bp, Homo sapiens
caaaggggctgttgctgaacagtgtgtatgaccagtgacagtacctacctgttgtcccaaggcatacataggaggcctcaacgctcatgcttctctaatcaagccctaccaagacagacagaacgacagaccgaaaaatagaaggtatagaggagaacgtcgaagctgtggagctagactctgcttcacttactgaagcttcaacttgatgtagaagattcactgggacccaattcctgcattgtcaatatctgtgtgggtgaaacatgggatctggatttagcccaaatgatgaaagcggatatggcacattgtcacacacgtgagataattacagcttgccccacagcactgggtgttggagaaagggagagatagtcattagtggcagaaatagccaagcgtagcgagtgcgaaagagagcgagagcctgtgcaagctgctgacgagccccactcagcccacaagcttctcgtggggagatcgaggcagagcctagggtatgggacagagctgctggagcctctccttgcctcgtgatctgagccacggagcttgcccactccagtccccctggggc

SEQ ID NO: 640037 - DNA, 98 bp, Homo sapiens
gctgccatgtgtgaagaagcctgtgcagggactcccatgtcaaggacttaaagtttttggttgtaataagccaggaactcagacctgccaacagccag

SEQ ID NO: 640038 - DNA, 186 bp, Homo sapiens
ccccccttaaaggggtttcccccccccaatcctggggggggttttaaaagggttgggggccccccccctccccatttttttaatttgaatttggggcccccttaaatttttaggggggaaagggggtggggtccccctttcctgggggtccccaaaaccgtttttttttttttgaaaaaaccccca

SEQ ID NO: 640039 - DNA, 293 bp, Homo sapiens
  misc_feature (37)..(37): n is a, c, g, or t
  misc_feature (45)..(45): n is a, c, g, or t
  misc_feature (70)..(70): n is a, c, g, or t
  misc_feature (110)..(110): n is a, c, g, or t
  misc_feature (252)..(252): n is a, c, g, or t
cttaaaaagtacaaaaattggccagcgtgggtggcangcgcctgnaatcccagctactcagggaggattncgtgaacccaggaggcagaggctgcagtgagccgagatgntgccaccgcactccagcctgggtgacaagagcgagactccatctcaaaaaaacaaaacaaaacaaaacaacaacaacaaaaaaacccaaatcaatcaggaatgtcacatatttacaaaaagaacagaaatactcacatttancaaaaacttatttgccattaatactataatcaaacatgcag

SEQ ID NO: 640040 - DNA, 425 bp, Homo sapiens
gatacccgagacgctggccggaggatcatggagaataacgccgacgtcctcaccagtcgccatcgtgtatggtcatacactacgactgtttctgatcatctgcgaacctccgacttgtcgtacttgattcatatgaaaacattcttggagtatgcttgcgcatctggatccgtcttgcgaccggtccaagaattgtcagccgtctagcggcgcaatacgaatgccctcgcgtgctgtccctcttaagcatggcctcagttccgaaaaccaacaaaatagaaccgcggtcctattccattattcctagctgcggtatccaggcggctcgggcctgctttgaacactctaattttttcaaagtaaacgcttcgggccccgcgggacactcagctaagagcatcgagggggcgccgagaggcaaggga

SEQ ID NO: 640041 - DNA, 139 bp, Homo sapiens
ggacacctgctctgctatatcataactgaatcttgggcatattttctaagaatttttttcttttagagacagtgtctcgctctgtcacccaggttggagttcagtggtgccaccatagctcactgcagcctcgaatttc

SEQ ID NO: 640042 - DNA, 121 bp, Homo sapiens
ccgtgggagtggaagagaatggagagtgaggctaccacataagcgtcccagagctgctccctgctgcctgctcagagcaccccggatccacttgttcaatctgcactacattcggggtcca

SEQ ID NO: 640043 - DNA, 394 bp, Homo sapiens
  misc_feature (174)..(174): n is a, c, g, or t
  misc_feature (211)..(211): n is a, c, g, or t
  misc_feature (250)..(250): n is a, c, g, or t
gttgttgttgttgagtcggagtctcgcactgttgcctgggctggagtgcaatggtgcaatctcggctcactgtaacctccgcctcccaggttcaagccattctcttgcttcagcctcctagtagctgggattacaggcacctgccagcacacctggctaattttttatattttnagtacagacagggtttcactatgttggccaggctggncttgaactcctgaccttgtgatctgcccacctcagcctnccaaagtttttcagaattttttaaggaaacacttttaacccttaaggctttctttcaaactcagatccccttacacaattgatcagacgtggcaaagttttgcttcaaagtttttggactgggtttccactttaggcttactga

SEQ ID NO: 640044 - DNA, 100 bp, Homo sapiens
gtcacataactgtcggtcaatagtatcaaaattgtactgaagcttaaggggggcagagggatataactcattaaatgacgagattcctagccctcttctc

SEQ ID NO: 640045 - DNA, 124 bp, Homo sapiens
gcttttacctcattgtctactagcaccccggtgtactgcccaggaaggcggccacgatacctgtggggaacaacaattgacgaaaaggtctcacctggaaccgaagcggccaggccaagccctt

SEQ ID NO: 640046 - DNA, 1028 bp, Homo sapiens
ttatgtggtaacagggtaggtgtgtgagtgctgctgatggggctcatccaggctaaaatatttttaaaccatctacaatttggagctcctctgacaagcagatttctccaccacgcagggtatggagtatgctcttggtactctggatgacttccatgacaaagaaagcactagggaaccatgtctacttactggtttacatcatggtagcgtcatctgggcccagctgtcattttcattacatttttggagctagaccaactccatttcatttttgtataggcccatttcatatataaaaatgactgaatcttctatttacagtattcataatgtataaattcatctttttcttcctaaacatttatttcaaaatacttttatataaacagatatttagaatgaataaaattgggtaaacaacttaaatcaccatcaaagttattttgcaaaatataaattgttatgacagaagtatttttcaaatcttgtaatctcccaaataagaaaagaagttgattcagtggcaagaaaaaataatcattctaagttaggactaaaactaagatgaaaaaagtcaaagcatcataagacacacaacactacgtgtctggagcagttaacgtcccaaaaacttaccatctctgtttctaacaaagcattttgtttttggtatccttttaatatagcaagtggctataccataattgaacagttatccttaatcattcttatctataccttctaactttaatggaagcttttagtaagatactcttaaaattgctcagattctatttcattatcccctgtcaaacatacctaccctccaaatcatctcaatgagtggacttgatcctttctctatcagtaacttgttcaaagcacacactgtacagtaacatgatttttcttaccaaacaaggagtcaactatagaaaaagaggcttaaactgggcaaaatccaaaatgatagaagtgcttttgactactataaccaaatatatttaagttgttgaatctatttg

SEQ ID NO: 640047 - DNA, 141 bp, Homo sapiens
ctctcatgcatacatcccttacatgtgaccgggatgatcgatgatttcactgatcatagatcagccactatcatagccgtgttatctttagtgatgatctaggccttcacccacggtacgagctcaatcgtatctgtctag

SEQ ID NO: 640048 - DNA, 285 bp, Homo sapiens
tcctgtactgtggtgtacgtctttctacaaccacttaaatgcagtatttgggaagggcaacaattaactgtatagtaccatccgttagttttaaagtgcttcgttttctgttcctgtgatccctcgaggaccactgagccctcagtttatttctgggtctggctttcttttttgttttcttatgggtggggcggtgggtgagtgtcgagactatgacctgagagcagactgtcgtcagattagtttaggtggacattgctacagggacatgatgttgagaaattc

SEQ ID NO: 640049 - DNA, 469 bp, Homo sapiens
  misc_feature (36)..(36): n is a, c, g, or t
agctgttacctgctcacctgggcgtatgcttgatcntcaagtgatcctcgcctcagccttctgagtagctggaagcacaactgtgagccaccacacctggctttttttttttttatttctaataaaaaaatagagttcctggtcacacgggacaaaatatgcatatataggaaggaaagactttgggacttgagattgcgctgaagaagaaaattggaaaaattaggcattttagtctctcagggtgtaattttggtagctaatacagatatgtcttttaaaggtgtcttaaaaaggctttatggagatagagataaatgagataaattcaccttccatgaaatccccttgagtgcagaatttgggggttaataatatgtccacagaatcacacaaacaagacaggtatctagatcctttcagaccattttcatcagtccacaagaaatcccatacgcccgggtaagca

SEQ ID NO: 640050 - DNA, 110 bp, Homo sapiens
atcaaggtcgataggattcaacaatgtgcatcagcccttcaaagaatacagactgtggtttcctcctgggatgacgttcaccaggacccgttggcaccagtgctgctcaa

SEQ ID NO: 640051 - DNA, 115 bp, Homo sapiens
tacttttgcacagggatattttttatttgttcctttttttgtttgaactacacactgttagactaaaagtattgaatttatttcgtgatagtgtttttaccagaatgcttggagt

SEQ ID NO: 640052 - DNA, 137 bp, Homo sapiens
ccggtgttagtggcttggaattcgccctccacttgccgagcacgaagtcatgccccactacagacggctggtccagagtttcctagcagctggccccgatggacagccaatgggcccatttcttctcgagcgttggt

SEQ ID NO: 640053 - DNA, 1142 bp, Homo sapiens
gcccattgttgtctgcgccctccccttctcgggcgtttgtccccatacacgtttgtgcgggcatagggctctcgtgctctttttcctctattccggtcttcttagcttcatctgttggtggttttcgtctgctttgcctccttgtctagtctgggagtggttgggtcgtgtgtttagtgtgctacgggttgggctttattcctggctctggctcctgtaggtcctcgttattgtgtgtcgtgcattatggggatctctaggggtgtttctgcgcatgtgcgtttatcctgccaagggtgacgttgtcaaggtcatatccctttgcctatatggtttgtaggaatgggtcgcaccttgtaattatgctttacttctctacgtatatttgataatgctggcacattttgttgggactttgaatagaattgggaagggattgcttcagtatactcccgtattgaattggtataatgggatattactaacttgagttccggtcactctgggtcagcttctctcttgctttatctcttctgttctccttttttaaggaatacgtagttaaggttaacagttttgcattacaggcttgtgattcagtgcttactgtaaagtggaagttgagattattcttaaaacttcaaggctcagtaattttgaacaactggaacattcatctaggacataatgtacaaagttcagtattgaccataactgcttaaaccatttttagctttcctgcaagtctagttatgttgtaggagtgtacctaagcagtaagcgtatttaggttaatgcagtttcacttatgttaaatgttgctcttataccacgaatacattgcaaacttcggatgcatgttgagaaacatgcctttctgtaaaactcaaatataggagctgtgtctacgaattcaaagtgaaaacatttggcaatgatttgataattttagttttggttatatatccgtaaggcaagtgagtgtacaattttttttttttcaaggatacgggacaattttaaagatgtaatacctaatactagtagaaatattaggtcagtgatcgttatgtatgaatatatggaggctattggtattacatcagcttccttgatatatgtgatggccatattagatgtaa

SEQ ID NO: 640054 - DNA, 566 bp, Homo sapiens
  misc_feature (9)..(9): n is a, c, g, or t
  misc_feature (26)..(26): n is a, c, g, or t
  misc_feature (55)..(55): n is a, c, g, or t
  misc_feature (69)..(69): n is a, c, g, or t
  misc_feature (108)..(108): n is a, c, g, or t
  misc_feature (119)..(119): n is a, c, g, or t
  misc_feature (148)..(148): n is a, c, g, or t
  misc_feature (156)..(156): n is a, c, g, or t
  misc_feature (208)..(208): n is a, c, g, or t
  misc_feature (556)..(556): n is a, c, g, or t
ggcctaggncagacaatggtaacctnacttttagcctattgagacattaaagggnacccccggaaaaanttttgggcaaggttttgcctttccttataaaaattaggnaactgggcaanggtggtttataccttgtaatccccagcanctttgggnaggcctgagggcaggagggaacaccttgaggcctagggaggtttgaagaccnagccttgggcaacaaagtgagactccatctcctataaaaaatgtaaaaaatttagcccaggcatgccagctgcaagtcgcacgcctgtagtccccatcactttgggaggccaaggctggttgatcacttgaggtcaggagttcgagaccagcctgggcaacatggcgaaaccccaatctctactaaaaatacaaaaattagccggcgtggtggcacacgcctgtattcccagctactcaggaggctgagacaggagaatcgcttgaacccaggaggcggagtttgcagtgagctgagattgcaccactgcactccggtctgggcaacagagtaagaccctgtttcacnaaaacaaaaa

SEQ ID NO: 640055 - DNA, 397 bp, Homo sapiens
tcccaggggcgtgtgacccccctgggaatccagttcttggcttttttgaaggaaataatttccccttaggatccccccttagttattcctgtgaaaacaggtcctccttagtgggggtgcaggagcaccaatgcgtttattgggagtggaacagggcccttcccgtttgcaagttgatccagaaagccccccacccaaagtgttaaaaggcccttcttccccttcagaaaagtaaaaacccctgcgaaaccatggagacctttttgccccaattaaagcaattggctggccaatggaggagctaaaatattctctggagctaaaaaaaacttagttgaaggcaaaattgttgtcaccctccagctgagccaatgtaataaaaatgacccctttaatt

SEQ ID NO: 640056 - DNA, 180 bp, Homo sapiens
atcagagcccagctgagaacctgctcgatcctggaaacaattaaaagatgttaaccggccaggctcggtggctcacgcctgtaatcccagcactttgggaggccaaggtgggtagatctcctgaggtcgggagtttgagactagcctggccaacatggcgaaaccccgtctctactaaaa

SEQ ID NO: 640057 - DNA, 186 bp, Homo sapiens
cagacgtgagcactgtgccagcgatatatttaatagggagcattatttcctattgcaactatttgcacaaaatgctctccatgtacatcttagcctgaaacttgggtttattcacgcagtggctggacgcttattcagccataatcactgtgcaaatagctatcgtgacctcgctataagatgtct

SEQ ID NO: 640058 - DNA, 346 bp, Homo sapiens
tcccaggattccttattcgtgttgcactcgtcatagactaggggattagaacaacctgtcaagggaggggagggggcaaaccctgcgcacatgtcaagcattggcaacacagcatagaggcctcccgccaagaaattttttgctcaaatataaagcagaaatctctcaccaaacaccaaaccagttaactatgccaaataccacttatgatcaagtgaccttgaggcactgctcaatttttccaatgttctttgggtttttagggggtggagtggaggggaaactaggaaggtaggcaacataaggtccctaaaaagccccaagttcaattgtgcaacacgaataa

SEQ ID NO: 640059 - DNA, 885 bp, Homo sapiens
  misc_feature (540)..(540): n is a, c, g, or t
  misc_feature (572)..(572): n is a, c, g, or t
gttttaaagaaagagcaaatgcagtcataaaattatgaagaataattcattaagattacattagtttacatttttaatgatagaaaacctttattcaaagcacaaaatgagttgatatgctttctgcacgcaaacctaaaaagagatatggtttaagtatggaagccactgtcatgtggcccaacatttgagcacatcttctggctcagtcatgtacacttaacctctggatgactttcaggtattcagtttgaatttcttttatttaaatggttactcctgatggattccgtttttctggaatttctgtttttcattagtgcatttcagaatgcttttttagttacggattcttatttccaaaattttagccattactttctattgcctgatcttgtcttcattttcgtaaacaaatcccttcttagatagtgcagttaaaatgatggtactttctactacttgcagaagagaatctgtgtggctggcttatgcagtgcttattacagaaacaaacaagaatcagtgattattcagtgnttagttttctttgcttccctctaccccaattnattactttttctcaaattattcttcaaaaaaggtacatgaaaataatatatggctgacacatgctatgatatttgtttagccgtgggaaggaatagttgctattaactcagatggtttattttctgtgttcctttttgtttattgcatttgtttatttaaagtatttccaaagtgtttctttatagtacaaatgactattttgaagcagtatctcaagaattcagggaaaatatatgttattgaggaagaagagggattttttttcttgcccaaattatctagattaatgatatattcattaaatttcccaaa

SEQ ID NO: 640060 - DNA, 886 bp, Homo sapiens
tgcagtggctcacgcctgtaatcccagcacttggggaggccgaggcgggcggatcacgaggtcagaagtttgagaccagtctggccaacatggtgaaaccccgtctctactaaaaatacaaaaaaattagttgggcgtggtggcgtgcgcctgtggtcccggctacttgggaggctgaggcaggggaattgcttgaacccgggaggagaaggttgcagtgagccgagatcgccccactgccctccagcctgggcgacagtctcaaaaaaaaaagaaaaaaaaaagcattacatctctgaaggtaaagtttaaatcagggggctcaagattggcaggtacagcctgtgttaatgccttcaataagtgcttacgttcctggtctaatgggtcataatttccacatcctcttcagatacaatctgagaacttgttgactaccttggttacttgcaaaaatttctatttaatatggcattatattaatggttccatagtacattccagttctttatctgaatacaagcgtttggctttaattcccagtttctgggaccagaacaataaaatccataagacatcgtttctatatggtcatatacgtatatcgaataacgactggcatgtacaatcattgaatggagtatacagaacctttagtttaagagctaaggtacctcaggggaatcgggtaaagtgattccccttcgtaaccgtcatttggtgtataaaccttaagctttctaaataatacggtatccaatataaggaatagcgggtaggtagaaaggaattaccatggggaattaaatggaactttatggagcgtaatcatatttcctggtaccaggtggtgactgaataagataagtgattggacacgagattg

SEQ ID NO: 640061 - DNA, 302 bp, Homo sapiens
gttttttttgggggggggggttccaagggttcccccccgggggttttaccggggggatttcccccattccccccccccttagggggggggttgggggcccccccggggccccccagggggggttaaacgcaaccccccgggggggggggttttttttggggggggtttttaaaaccccccccccccccagggggttttttacccgaggaattggtttggaaaatttttgggggttgggggccccccctttgggtacccccggtttttttttttaagggttggggttatttttttttttttta

SEQ ID NO: 640062 - DNA, 932 bp, Homo sapiens
cggcttcgctcccgggactgggagccggcttttccgcacatatggggctgctggacggcaggagacagtggcgagcgggccgggaagccgcgcagtggttcccgccgcaggaccggaggcgttcttcaacagcagcgggatcaggacgccagcatcggcgacccctcgcagtccgacgatcctgacgatcccgaaggagcccgacttccccggcagcccggtgaggcggcggcggaggtgtcccggcggcgaggtgcccaaggaccggccagcctgaccgtgacccaaaggcgctggaagctgcgagctcgcccaagcctaaccggtgaccccaagacgccttggggctggggagctcggccccccgcagaagtgcacgtacacccctgtggcccgctccgactttccgcccttccccagccgcgactccggcgcctcagggccggacctcatgtcgtgtgcgggccagcccaggaccggcgatgaggcttggggcatcagtgcctccctgttcagctctctggcctcggccctgcccccggggtccccaagtgccaagggaccggtgtctctccgaatcgggcactcccgccttgtctggtttcgagcctcagtccgtcccgcagggggccttcccaccctcccccagaaaggtcttccccttggacgtgaggcattttgtcccccttgctccccagtgatgggacggcggacgggcggaccgccagtgtccccattggtttggtccaccaaaagcccgtcggccaggcctcacagggacaagttctctatggcgtgtatagaacccggggacccctggggggttctggcggttcgcggccctcggggcgacaattacaactctcctcgtgggcacgtgctgttggtgggatcgcccgcgttccttttgcctccccgcggggtgtggcccg

SEQ ID NO: 640063 - DNA, 252 bp, Homo sapiens
  misc_feature (34)..(34): n is a, c, g, or t
  misc_feature (54)..(54): n is a, c, g, or t
  misc_feature (63)..(63): n is a, c, g, or t
  misc_feature (107)..(107): n is a, c, g, or t
  misc_feature (109)..(109): n is a, c, g, or t
  misc_feature (115)..(115): n is a, c, g, or t
  misc_feature (144)..(144): n is a, c, g, or t
  misc_feature (192)..(192): n is a, c, g, or t
  misc_feature (196)..(196): n is a, c, g, or t
  misc_feature (199)..(199): n is a, c, g, or t
  misc_feature (219)..(219): n is a, c, g, or t
  misc_feature (236)..(236): n is a, c, g, or t
ccctgtgcccttggggggaaaacaaaaggggganaacgcccccgcccctcctgngatgtgggnggggttggatttggtttttaacccgttcctgccccccctgcccnanagttanggcctgtgttttgctttcctggtcccagngccccgtttgctttgtgaactcctccccccaggccctttttaccccangggngtntgtccccctcgttttgtagngtttgtacataataaancaatggagtggagcca

SEQ ID NO: 640064 - DNA, 309 bp, Homo sapiens
cgcgtcgacactccaaataagtgatatttaaagtgatcacaatcagttcagtctagcctggtctggcctggccctttacaacaaaagcaaataagcttttagcaaagcattaaaactcaactgaggccaggcgcagtggctcaagcctgtaatcccagcactttgggaggctgaggtcaggagttcaagaccagtatgccagtactggatcacttgaggtcaggagttcgagaccagtctggccaacatggtgaaaccgccgcgtcgacgtcgacgcggccgcgaatttagtagtagtagtagtcgacc

SEQ ID NO: 640065 - DNA, 359 bp, Homo sapiens
  misc_feature (33)..(33): n is a, c, g, or t
  misc_feature (49)..(49): n is a, c, g, or t
  misc_feature (205)..(205): n is a, c, g, or t
  misc_feature (306)..(306): n is a, c, g, or t
  misc_feature (310)..(310): n is a, c, g, or t
  misc_feature (313)..(313): n is a, c, g, or t
atatagggctgggtgtatggactcagcctatantccacactttgggagncaaggcgtgtggattgtttgagcccaggagttcataccagcctggattaaacaatgtggaacaacctgggcaacatggtgaaaccctgtcttttacaaaaaataaaataatgccgggcaccggtgttacgcctgtaatcccagcactttgggaggncgaggcgggtggatcacgaggtcaggagatcgagaccatcctggccaacacggtgaaaccccgtctctactaaaaatacaaaaaattagctgggcgtggtnaagntgnctctgctcaaaaaataagtaaaataaaataaaaaaataattagctg

SEQ ID NO: 640066 - DNA, 567 bp, Homo sapiens
atttaaaatttagttttaaattttttttcattttgcttcccccccccattccggggggcccaccggacacaccaccgtggcgcgccacccgagaaaaaaaacacgcctgcccacaagcccaaaccctgcccacacccggccacggcccgaccctgggccaaacacccgccccacacactcgctagagcactctccccttcttggcgccccgttcccccaccaaacccccccgaccaccccaccgagaaacccccccacggccttcaccgcgagacacccaaccaaaaccccccggatatctttcacaattgcccacccctggcgaggaaaagccgcggcccctcaccttctccaaaaccccccgaaaaacccggcggaaccaccgacccagtggtcccggggccaatctttctccctccaactccccccccaaccccccggcacaccaggcgcaccccggggggcccacggccggccacacccctcacagcccgggcgtccccgcgccgaacacccggggaccccgcgctcccccacccaaacaccacccccacccgcgcgggggcg

SEQ ID NO: 640067 - DNA, 226 bp, Homo sapiens
  misc_feature (82)..(82): n is a, c, g, or t
  misc_feature (101)..(101): n is a, c, g, or t
  misc_feature (110)..(110): n is a, c, g, or t
  misc_feature (139)..(139): n is a, c, g, or t
aaatttttttcccccacaatttgtggttttttgtttggagggggaacaaggatatttaagctggggtgtgaaagggtagganatatgctggaggtgggggngttgggttntagcccccccatattatcccagggtcccnggccccccttttcccccaccccatgcccccaattttgtggggcatccagattgtgaaaatgtccaataaatgtgtaatgagtaccca

SEQ ID NO: 640068 - DNA, 985 bp, Homo sapiens
  misc_feature (247)..(247): n is a, c, g, or t
  misc_feature (985)..(985): n is a, c, g, or t
ggctgtcgccgccgcggagacaaagatggctgcgagagtcggcgccttcctcaaggaatgcctgggtaacaaggagccaggtgctggtcgtgtcctttggtcgtgcgggggacctcgtctgtaattcgtgtcccccattgagccctctacttgcaagtagctccgtcatgatcaacaagggcatgccctacaactacccagggcccgtccgtgaatgatgggaacatgccacgatcgtggccccagnccatcgcgcacaggatcccgtcgatgggcaccctcgaagtccatgtgaacgtggtctcgaacgacaagctggtagtagtcgagcacctttcaccaacgtgaacgacgtagagacgagacgacttcgcttcacaggattccctaaatatgaaattgttgatacaactcataacaactgctattagaaatgaaagagtactttctcaaggagaaggcgcgaccagtgcgcgcctacagaaatataagtgcgcatctttaaaaccccaggacaagtatgtgtgcgtgccgtgcgtggaaacactgcattggaaaatccaatagtctggaggacatctcttattgtgtacacattccttgctaattcggaggaattcacgaagtgaatgtgagaacattgcgaaattaagataaacctggaaaaaccgtttgaacgcccacagaggggggagaaaaaacacagagaaagcagtgactacgtgagcacaacacaattttgccgagaagagggcggaaattatgcagaaggaacagactaacaaatacgcgggcggtacgttaagacaacacacaccagggagaagagtggagagacagaagggccccagaagtaggagcaaaaatataaggccactaggggccaaggagtcggtgagggacccacgacgacggcaagcaccagcgcgggagcagaagcaaatagagtgggaggaagactaccacccacaccaacaaaacacan

SEQ ID NO: 640069 - DNA, 652 bp, Homo sapiens
acagctgggcacatggccaccttatctgtacaaaagatacaaaataattagctgggcatagtggcgtagcctgtagtcccagcaacttgcggggctgaggcaggaggattacttgaagccagaagggtcaaggctgcagtaagcctagatggagccattgcactcaagcctgggagacaaattgagaccctgtctcatacaaacaaaaaaaggtcatggggctagagaagaagtgtgttgcacgcccgcccttacacttcccccaatgctcggtggcccactgcagctccatctcctccgaagggactgaactcctcgtccagttcttctcagatctcattgtcaccgatgatggcttctcagcctcctacaagaccctgccgcgggccactgccaaagaaggtcaagggcccggccccaaacggggaactgatcctaaagttcagctgccccccaagtcccaacctccggagaaacctgaggactcaccttcagcccctgatgcacccccctgcccaaagcagtgccgccggacagccacctgcagagctgctctgtgcccgcgcttgtggtacttcaatgtgcctcctgttcggaccaggtactcctgccggattgcccttttgggcttaactgcggttactgctttccg

SEQ ID NO: 640070 - DNA, 644 bp, Homo sapiens
gggctggagctcgccgccctccccgcccggagccgcgaatgcgcctcggtgcgtgcaccgccggaggctgggcacgctcgcagcgctgctcggcgctggaccccaccgcggcaggcgcaggccagccacacccgggtctgtgcggctgccccaccgaagacatagcacaggacagaccccaacgacaccgcacacatgacacacaggacgcgggacatggcctggagactggactcggccagaggacaacatgaatcaatcgagatgacataagcatgcatcggagcagccgaaagagacagaaagcacgaacagaacaatcccacacgagacggaagcacacaatcccgaccaaagaaaagacacggcaatagaacccgaaacagaagaccacaccatgaaaccagacaggagaaacgaaccagacaaagcacaagaagacgagaccccccagccagaaacgacacaccaacatcaaaggcgcaacaaacaacacaacaaaacaagaacaaacaacaaacaacaaacaactacaataaaaacacataaagcgacaaaaacaacagcacacacaccaaggaagcagtccaaacgaacgacaacagataatcaccataacccgacacaaaacaacacacaccaac

SEQ ID NO: 640071 - DNA, 302 bp, Homo sapiens
tgagtataacacacaagggtatgttgcgacgtcgtcactaggtagaggacgctgcatgaagtagagggcacatagggcctcagaacctcgggaagtgtgtcaggctggagaaggcccggaaatacaccatgccattggtgggctgggggcagcactgaacagggatatctccagctgggaaaagcgtagcttacacagtgacctgtcaggaccaagtccaattccgtgacaggtatggtgggttcactatcggaaactaagaacgctggcagacaagaggcatcttgaggttagcttgtgga

SEQ ID NO: 640072 - DNA, 140 bp, Homo sapiens
atacagtgatcttatgatttctgtagatcctcttacaagcctatttacagccgtcctgcctaaatcagagaggtatgtggtgtgcaagggctgaatggtgggcatacgatgatgtacgggattacctacttcgctagtga

SEQ ID NO: 640073 - DNA, 729 bp, Homo sapiens
ggacaggacggaggtggagactttggcctttcaggcagaaatggcccaacctcatgtccctcatcatcaattaccttctattccaatcaagcgagatttaaccttgcgggcagttgatctctaagtggcttctgatgcctgtggacaaggatgcgctatggagacgccgtgagcagagcgccgttcgagagttggagcagtggtaggagacgctgtaacaattgacagtcgatccccaaccgctcaggatacgtagccctgtacttgggtagacacacggcattggcatgagcaaaggctgatctcatatatatatagttcgggaaccattgccaagtctgggtactaaagcattcatggaggctcttcagagcgggtgcagacatctccatgattgggcagttgggtgttggcttatatattctagccttacttggtggctagcagaagagtggttgtgactcacaagggacacgagatgagtgactgccaatcagtgtgcttgcggagtcttcttgctggaggttcctttcagctgttcttgctgatgatggtgagagcatgggtaggggtagaagagtgaggcgacgatcttaaagaagatcatacatgatgtagccgtgtgaatgagtagggtgggtcaaaagaaagtaaggtgaaggaatgggttgtcagatgatattgggataccatgaaggctttaatatggactaaaggagtggaaacaat

SEQ ID NO: 640074 - DNA, 681 bp, Homo sapiens
taactgggactttgtggaacaatgtgcgcatttgtagccatgaagatgccatcttgcccaatatgcctctatccacctactgcagaccaagataacccgattgtggacacatcttctgctgggacatgcatccatgcactatctttcacctgatgtgagaatgactgtggagtcaatgtcccatctgcttacagatcactgtgcactaacgaagtgatctcaagagatgtagtatgccacatgagtcacatcagctatgctcgtatgtgttgataccagttacagattgcatgctagatgacacgacgtggacgacaaggggtgttgttctgagtggcctattggccacaaaaatccaaccatggacttgaaatgtacgaactcaataccccaaatatcacttactaagagaagcatcgcaaccatgctacgatggtccaaggtatcttccacaaggtttggcttggcattagtgccccatccttcaacatggtcacagacaaagggagatggcatttggataccctggttgagctaacagataacctttgtcaacagtgaatcgaacaaaatgcatatgcccacccttacagaaacggcatcacaatttagccattggtcacatgactatgtgaggcacaatagcaatcaacttttaccacacagtgaaagataacccag

SEQ ID NO: 640075 - DNA, 278 bp, Homo sapiens
taatgtgatactgtggtctgagagacagtttgttgtgatttctgtttcttttacatttgctgaggagtgctttacttcctttatgtggtcaattttacgagtaggtgcgatgtgatgctgagaagaatgtatattctgttgatttggggtgaagagttctgtagatttctattagacctgcttgttgcatagctgagttcaggtcctggatatccttgttaatattctgtctctttgaatcaccgttatctaccatttccggggggtaccgaagctca

SEQ ID NO: 640076 - DNA, 355 bp, Homo sapiens
ggtaaccgtcatggcccttctttttctctttagctcggcttattccaggggtgtgtttcgccgagatgcacacacgagtgcggttgctcatcgggttaaagatttgggagaagagaatttcacagcctcggtgctgattgcctttgctcagtatcttcagccgggtccattggaagatcatgtttaagtgaatgaagtgactgaatatgcactctttggagacacattatgcacagttgcaactcttcgagaaacctatggtgaaatggctgactgctgcgcataacacgaacctgcgagaaatgaatgcttattgcaacacagagatgacccccctcctacgattggtgagacc

SEQ ID NO: 640077 - DNA, 320 bp, Homo sapiens
tgggggggggcccggacccaatttcccctttaagggggggtattaaaaatcactgggcggcgttttaaaaacgcgggaatgggaaaaacctgggggtacccaaattaaatgccttggaaaaaaaccccctttttccaagtggggtaaaaaaaaaaaaggccccacccaatcccctttccaaaaattggccccccttaatggggaaagggaaaatggaaaccttaatattttgttaaaaatcccggtaaatttttgttaaaacaactttttttttaaacaaaagggccaaaacgggaaaatccctttttaaataaaaaaaa

SEQ ID NO: 640078 - DNA, 227 bp, Homo sapiens
tccttgataaacaaacacacaacaaaagacacatgtcttcgccggttccgggctcaggaagagagcgcccggaagccctggtgggccaagcacatcatggctgcccgtggagtggagggcaggggggtggctgctacagaacagacccctggctctgttgcgtcctccgtctttgggacacttggtgtgcgctgaaccaggactgggctgggcataatctgtaaata

SEQ ID NO: 640079 - DNA, 129 bp, Homo sapiens
cgacctgtgttatgtcagtgtgtctaaagaacgtggtagttccccacaaaaaggttgcagttgccacaccagacaagaaagcagctgtcactccaggcaaaaaggcagcagcaacacctgccaagaaga

SEQ ID NO: 640080 - DNA, 989 bp, Homo sapiens
  misc_feature (1)..(1): n is a, c, g, or t
  misc_feature (267)..(267): n is a, c, g, or t
nactcttgtcactcaattattgtcatatgtctgctgaccccgcctcgtgcttgtcgcgtgcgtccggtagaataccctggccccccggcgcttggggcccaattttaaccattcggtccccggcccactccggctcccttcccccgtgaacccgtcaacgtgtaagctggcattatagtaggtctgaggaataaggcgatgttggggcaaatggggggcattatctggtcacgttatgggccgtcaggacggatcatagcgggcgcngatgtcacataatgaaagcgggcgatcttatacagagcaggtgccaagtctacagtttcgactcggatcattcgtcagtctcacatcatgagggcgaccatttcacccccgcatttcttgccgccccatccgggggctcaccatggatcccacagttccggaggcccctccgctttcaattaatgggatgagattgcgaaatgcatctcatgggggggacaatttcgaggagtttcctctaatcgaagagacgatatcatctgcgaagcatcaaacatattcgaacgggagcattctctattcaataacatctggatgcaattggatagagtcaaatataagtgatcatataaataagaaatcaatgtggagtgcggacattagcatgaaattcccaagggggcgaggaatgagagaatgggaaatcggagatgaaaccccgatgcatgtcgaatataaaaaagcgacatattcggagtgcaatatattattaaattatgagggcgaagagcatgagattgtcaatattggatgtcgaatccgcaagggtccaatttgggatgcaatatactatggagcatgatccaatcgtgaatacaataatgaatgccgatgtaatgctgtgatgcgatgatgcaatcaacgcatgataaaggcaagaagcgaagatcaaatcaagagggaaaaaaaacaagaattaaaaaaaaaatacacaaaaagac

SEQ ID NO: 640081 - DNA, 1510 bp, Homo sapiens
  misc_feature (95)..(95): n is a, c, g, or t
  misc_feature (98)..(98): n is a, c, g, or t
  misc_feature (101)..(102): n is a, c, g, or t
  misc_feature (105)..(108): n is a, c, g, or t
  misc_feature (358)..(358): n is a, c, g, or t
  misc_feature (409)..(409): n is a, c, g, or t
  misc_feature (413)..(415): n is a, c, g, or t
  misc_feature (417)..(417): n is a, c, g, or t
  misc_feature (420)..(420): n is a, c, g, or t
  misc_feature (774)..(774): n is a, c, g, or t
  misc_feature (869)..(869): n is a, c, g, or t
ccgggaggcagaggttgcagtgagcctagactgcaccattgtactccatcctgggcgacagagcaagactccatctcaaaaaaaaaaaaaaaaanaantcnncannnnattcaaggctacacatttactccatgaagtgagcacacttcagacttccagtcttgtgtggcctgtctaccacaccatgagacttcatgtctctcctaaatgaggagaaccaaagctggaaattgtcaccccctgtcagcccacagcactggtttctaaacctactggcctctaccgcttcacttctcactgaatctctctgacctaccttccagcttctcttgagaacttgactcttaaattcattggngagaaaggaaatttttgctccaataaactgggtagctcagtccaggagagngtcnnnancanactgtcctttgctaaatgggactaatgggaagaatagtgtctgccaaataaggtggttgaaggattggatgagactgacatttcatttgcatttagtgaatacttgttgaatgactgaatgaatggttgatgtacagaaacatgaacagagagtagagcagaacattggtgaatggtagtagattgcctcagacgcccccctttagaatcacacaagctgtcatctgtgattgcatacctgtagaagtctctatcatttcgtagtctatgtaaatgttgaccaactgagttgttcagtgtacagactgaacaaccatacagggaatccctaatctcctgcactgtgagtcaaanagtcagacaggtctagatgcatttgcttcaggtgaggccaaggcagtctactcttaatggcacattaggctttggacttgaggccgtgtcttttncatttcgcagcaatcagaaggaatggggtcgccccatgaacttcttaaccacatacaggctcgtggcgtggggtcttcatctggctactagattgtttaaagaaggatttttgtgattcttctaggctgacacattgcctgtcatctgttgtttttctaatcttctagtaaacatttggaaagtgaaggtttaggcatgtatgtttctcttatgtaggaaggggaaataaggccatgagattgcatgagttttctttccaagtttgtgcagatctgcacaatgattgaaatatttgcaacctgtagagcagcagggtatttatttggcagcaaacagtattgatggattcggggaatgccatttgacagttacaggctcccgtgaggcggtgcagctcctccgagccagggatggagctggggattgagtgacacaagactctttgggtatgtctcaaacaatataaatcaccagcaaaatctcactcctacaaggagaacctgcagggagctccgtgggaggcactgctgtttactctcctcattccccactgcaaccacgcaattaaaaccaaggaatggaatctgatgtctaccgcagcggttttttccatctccattccttctgcattgggaggctt

SEQ ID NO: 640082 - DNA, 166 bp, Homo sapiens
ggaggaatgggcctcctacaagaagatctgatttccgagtcttgtttcaggacttcctccgtcaggcagctggcaggacctgaaggatcacactgcgcagaagctggggatgtctgttatgctggtgtgcagaaggatggagtggggatggtcgagtatctcagaa

SEQ ID NO: 640083 - DNA, 1749 bp, Homo sapiens
  misc_feature (1072)..(1072): n is a, c, g, or t
cgccccaaccccggagtggggcctgaggcgcgcagcctctcacacgactcgacgccaacggggtctctcgtgatcgctggcgctgaggcaggagggtgcggggcaggagtggcctgcggctgtggccctgggcctgccaaagttgtcatgcagtggtctgagggcctggacgtggggccccagaagcgactgctgagtgctgtgctgggactcggagtactgtgactgtgagccccgagctctcatgccctgccacgacacgcccctggagccatccaccgcgggagacccctggcatcacgaacacacccagattcgagatcacgcggtgtcctatactaggggccagacgtttctgcgcgcgacaacgcaacataacaagggcacagcatgagaggatgtcagggagagaccaccgcaccaagcaatacatagcccccagaacactacacatgtcacagaggagagatcggatagagaacaccaacagcattataccaacagccaacccatagacaagaaccagaataacaccatgctcacaccgaaacccccacccattataaacaccacgcgcggacagcgattagcaacgagcgcgcacactatggcacgcttgaaccagaggatcacaatcccaccggaccacgcaacaactaggggaccaacacgagcccgagcaacgcactcgaacgaggcacgcggacgagcgccacccaccaacgaaagcagcccgcagcacacaagatcgacgatcggacacgccaccaagccaccattacgccataacgggcgcaacgaggacaccggtcagcgaacacaccgaagacacggcgaagcccgcagaccacacggcaaactcgacaggacaccgcgataaccccaaggcggagacaccacagggcgatggaaaaccctacagcacagcgcacatagcgaaaggggatacacaaacactaccccgcagctcgtctacaggtcaccacaacaccccatcacggacatcacccgaatccaacccgtacaagagcaccggaagagagacaaacgccacgaaggatcgagcctacancacaattctaaccacccactatagagtaccatcctataccgatcagacagcacgatatcagtatggccgacgcgcgaggcggaagtacccaagaacacacactccacacgcacagggtcaaacattcacgccgagctagagctcagacgcgcggctagacagcagcaatcatcgacgcagccccttcagagcaaacgaggagcaactaatacgcgcgcagcgacgaactaggagacgccagcaaccgagagatgcaccaaccagacagatgagccaatagcacgtaatgaagccagcgcaaggagagaaaccgaggcaacgacatgctgcgaagaagaacagaccgaccagagtagtagacaactagaaatgaactatccaaaaactaatagagaagtcacccatacagtcataaacacacaacaatacaactgtaacatatcactaaaaaacacactaacgaacatcataaactataatcatacatcatagaatagcgagaaaccatgccggaagaaccaatacactagacaatcacacatcatcgatacacaacaaatataatagagaaacaagacagacagatacacagataatctagtatcaaacgactaactaagtaacatatagatcatcaaggaacaaaatacgacatccacacaataacaaacagacaa

SEQ ID NO: 640084 - DNA, 83 bp, Homo sapiens
  misc_feature (50)..(50): n is a, c, g, or t
tccagtctagcgtcctggggcagtggctccaccatggcgttgctgggcangttcctttgctgcctactggttgcctggctctg

SEQ ID NO: 640085 - DNA, 311 bp, Homo sapiens
catcaagagagaggcacatgaaagcttgggaaggagagagtttacttctaccccctattcaggtttgtgccctctggtttccagccccctcccacattcaaggcgaacatttaaacctctgggttcaagttccgttgtccaactgcgtgggcgtgagatctggggcaagccccttcctctctcggatcttacgtttccccctttgtacagcagaacactccacaatctgatgtgtttacaacttgacatctacttattgcaagcaagggaaactgaggcacagagcggggcggaaatgtgtctaactctct

SEQ ID NO: 640086 - DNA, 684 bp, Homo sapiens
gaccagcctttgaaacctaactatgcagcagtgcgaggccaaaagatcatggaggggccaaaatattcagatgagacattgggcatgtcttccttaattcactgatattttctacccatggcctaatatcaccgtatgaaagggaaacttacaggacttaaatatcagggaaatattttgagatctttgaataattcctttagaggaattatccaaaattaatatatatgagtccttggtaattaatttttttttgagacaggatctaactttaaccgcccaggctgaagtgcagtgccatgatcacagttaactgcaggttcagccttctgagttcaagcaatccttctgcctcagtctcctaagtagctggggctttaggtggccactgccacaccgtactaattttggaatttttggtagagacgaggtccaaccatgttgcccagcctgtggtcaaactcctggcttaagtcagtcccccaatttaaccttccccaagtgcttgaattacagccgtgagctactgtgcccagccttacggacatcctttggaattatctttttcactcattggatatggatcccttaatttagactttttctagacctttcctggtttccatggctttgcgtcaatctgcaatggcctttacaccctctttataaaggttggggttggga

SEQ ID NO: 640087 - DNA, 188 bp, Homo sapiens
tggtgagatattttgggacatttttccatagtgaatgaaaagctatagaacaattatggcttaaattgaaggcattcccgaggagcccgaaacacaggacaggctataactacggaatttacatttgcttcaggaaggggaattaacttggggtttaattaagttaattcttgaattggaaaaaacta

SEQ ID NO: 640088 - DNA, 249 bp, Homo sapiens
gtgactgactgtcatcctatggagaaataaatgccgtaaagagggccaggtggctaggctatccttgatggttcacattcctatctccagcatcttccctaggtcaccatcagcattaataaggggaagacatatacatccacattgtaatgcccactgtgtaagtctgagacccagatattgtcaaatacctaaatacctaatagaaagccaacttgtctgtggagacacagacgagggtaagccgtg

SEQ ID NO: 640089 - DNA, 409 bp, Homo sapiens
aagatcggcgattatggtctggtttctcggcgtgtgcaatgtggaccgtgaagatcggcgattttgggttgctcagtatggggactcggcgtgtgcagtctggacattcggcgtgtgcagtgtggattctcggcgtgtgcagtatggtctctcggcgtgtgcagtgtggattttcggcgtgtgcacgtgaagatcggcgataacggattggagcctcggcgtgtcgtgaagatcggcgagattgcactcgtgacgatcggcgatttcggactcgcggcgtgtggagcctcggcgtgtgcatgcacacgccgaggggaccaaactgcacacgcaagcgggacagattctgatggccatggtggcgatatctatggatattcggcgtgagtatggaggttcggcgtgtgca

SEQ ID NO: 640090 - DNA, 537 bp, Homo sapiens
caggattaggcttactttgtttgtgttttccccgggaaaaattactttttttggaaatgccccgaaacacatttttgttcttagggggagaggataggttccaaaaccgcggtcaaggctcataaacctaaggggctttatttcccataatccttggttgggccgaatttcatttcaagtttatttaacgcgtcaccccgagtttttttttttttttttcaaaagccttggacttataggaaaaacattttttttacttccgaccttctccttaaaagagagatttttgcatcttaagccccatactggggggtttttttactttatatttttatcagctgcctttgaaactgggctaaacctggggtttcgggaattaaaaaattaaatgtttgccccaccctgttcttgtttttgaaaaaatttcattttttaaagatccccccccccggtgggggccccctgaaagaatcttttccggaagggtgccaaggttttttgccctggagggtccattcataaaggggataaaccttg

SEQ ID NO: 640091 - DNA, 824 bp, Homo sapiens
  misc_feature (21)..(21): n is a, c, g, or t
  misc_feature (266)..(266): n is a, c, g, or t
  misc_feature (301)..(301): n is a, c, g, or t
  misc_feature (304)..(304): n is a, c, g, or t
  misc_feature (320)..(320): n is a, c, g, or t
  misc_feature (324)..(324): n is a, c, g, or t
  misc_feature (327)..(328): n is a, c, g, or t
  misc_feature (347)..(347): n is a, c, g, or t
  misc_feature (405)..(405): n is a, c, g, or t
  misc_feature (421)..(421): n is a, c, g, or t
  misc_feature (441)..(441): n is a, c, g, or t
  misc_feature (473)..(473): n is a, c, g, or t
  misc_feature (475)..(475): n is a, c, g, or t
  misc_feature (528)..(529): n is a, c, g, or t
  misc_feature (582)..(582): n is a, c, g, or t
  misc_feature (595)..(595): n is a, c, g, or t
  misc_feature (602)..(602): n is a, c, g, or t
  misc_feature (604)..(604): n is a, c, g, or t
  misc_feature (618)..(618): n is a, c, g, or t
  misc_feature (653)..(653): n is a, c, g, or t
  misc_feature (796)..(796): n is a, c, g, or t
atcttcaatgcatactttgtngtttatataaactctacattctcttaaaggttttcgttttgttttcactggagatttttagcctccaagtgaacttaacatattgcctatgcatctgattctttatagacttttagattttaaaactaaatttgagaaaccatgcatactgtataccttatttaataatccaaagaattgtttgcactttcaaaaaagttacaaaaaggctgaacacaagttaaataacctatatgatgtaaatnttccatttctgaatactttttcagtattatatatngcntgcggtctaataagtnagantgnnagagacgcttcagtaaatnatctctactttaaaattatatctgaatcccctttctctgagatgaacttgccaatatnaaacattgggccatangcagtattagcccaaaagcntaaataagaaccaaacttgtagactgaatatntnaaccttaaaattatataccgatatagacaccgatgggaggcggcatatgaaanngaacattgcaagtaacatatagagagcaaacattcagccaaatacgctggcangaaaagagaccgncctgaananaaaaagtgaatganaagcgtagggagacacgaatgtcgagatagaaggncgaagccgatgagacttgaagctaaagtctgctgtactattaagaaaaagaagattgattcttaacctactgaattgtgcagatacaaaagtgcttagcatgacaaaattaccaaaataaaaacattttagaggttatttggntctagcaatattaactattctgtatttc

SEQ ID NO: 640092 - DNA, 400 bp, Homo sapiens
acctcagcctcccaaagtgctaggattacaggcatgaatcaccaccatgccctgccgcacagcagcttctgctcaaaaagtagaatgctactccccatcccctgctttatggaatctctttcagctacttttgagtaattgaacactgcatatttatagttctcaaattgctgtggtcaagaatgttggcattcaccagtctggttctcctctttgctgggcacgcagctaaactaaatttctcagccacctttgtatctaagtgggatcgtgtaactgacttctggtctttggaatgtggactgaactgatgtatgtcacttccaggtgtaacccataaaaaattccacctaatctcctatgtgtgtgtttctccatctccgtttggtgctagatggcc

SEQ ID NO: 640093 - DNA, 475 bp, Homo sapiens
gttacatatacgcggtgaacggatttcatgtaaaaactaccgctgggatgtcactcttcgcacaagcccgtaaatcgttcaagccctatggcgagccgccttgcccagctgacttaactggttattttcccggactcccaccgtgcagggtgttagaaaaaaacgaggctgggtcttaaagaaagacaaacacagggcccaaaacccgaaggcaggctctcatggcacagatgctttagattagctctactacttcgttgctgaaagctatgatggcatctacctaggaagtccctgaccgctcaatccaagcattccactggaatctctgccgcgatgtccaacatcccgggccggtcagtaacagtgttcccacagttgctagtgtgtcgtgctcatagatgaacgacacctactcatgccatggcgtgtgctgaaagagcctaacctgccatgcagcatatgcccagtgccg

SEQ ID NO: 640094 - DNA, 92 bp, Homo sapiens
aatctccctatgaagagggtgaggggcctaagggagccgcaccttgtcatgtaccatcagtaaagtaccctgtgctcaaccaaaaaaaaaaa

SEQ ID NO: 640095 - DNA, 232 bp, Homo sapiens
tcatgtttacatgcgtcagtgtgagacctcaatgtattcgtgagcttttgcaggaattaaggtaataggaggtggaggcttcttgacaatctcttcacgtggtgtcatctctttgggctttgacacaacttttttggcatctttcttcacagcctttttggtaacttcaatacgttttggtggtggattcttatcttcggtgtgttggtagcaaaaggtgtataggaggagc

SEQ ID NO: 640096 - DNA, 667 bp, Homo sapiens
tccacgtccacgtcgactggctgtattctctctgggtgtggctgggcgtgtagttcctctttggaatccatggcagctctccctgtataacatgttcacaagtgtatgaggaaggtggggctctgtgggcttaccagtcagattgaatcgtccatgacgtgacctggatgcatcctttggcctgaacagcatccccaatggcaccaggccttgaggggcgaccagagtcgtcttacctctggtgtcctgaattctcgctcgagaggatgatgacccggagtcctaggatgcgcacgtgttctcccgcaggcatcagagcaaggctgaaaagagccctggtcccattgtcgtctcgaacgtcgggagctgggactctgccagtcctgtagaccgtcctgagccagaggcgtgcgtagccccatcaacagaactcgtgcagtgagccgaagcatgggaacatggatggacgtccctggctctggatggtaccatactagccctctgtcggaaagccagagcgagctcgacctctgagtgcctaccagcagttgcggagagcagtcttcccgaagcttcttttgatcgccagctactcgaggatagagactggtgcccttgggtgaagtatcagcagctttggtcggaagaacacgcgaggggagaatgc

SEQ ID NO: 640097 - DNA, 410 bp, Homo sapiens
  misc_feature (1)..(1): n is a, c, g, or t
  misc_feature (100)..(100): n is a, c, g, or t
ntcacgtgagacctgaaaccccattctactctctgctttatgagtctatacaatatggatataaaaatacggggagcgggggcgatggaatattattcangcataaaaaaagaaggagaccctgccatttgcagcaagatggatgaacctgcaggacattgtgctaagtgaaataagccgaacactgaagcttctctagattgatgttcctcccactgtgtttccctggcgggggggctcaccttccatcctcagatgaagcaccacttcacataagctttgcctgattcgtcggttctggctacaccacatatttccctcaggctttactgaacactacgcacatatgcatttattaaatcacttttaacacttttctcacaaaaaaaaaaatgggctcgttggcctca

SEQ ID NO: 640098 - DNA, 341 bp, Homo sapiens
cttgcagccagccaaacccagagagggagactggaggtggcgctggccaccagagaccgggtggctggcgactgaaggctcacggtcaccccacggagctgaaaaggagctgagtggtggcgaaagaagaggccacgaaactgaggcccctgctgaggctttgtggcgtctgtctccccggctgagccgaaatgctcacactgtgagaccccgctccacgtatcccccaggcctgttccctgatctccatcattttcttaccggttttcctccctcaagccattcgacatctcaagtgaagacctggcccctgaagggccaataaagctgctagtttattt

SEQ ID NO: 640099 - DNA, 287 bp, Homo sapiens
gagtctatgaggatcccctgtgtgcggcgctgctgagaagctaggactgcaggcacaagctgctgcgcccaatcaaatttcctcttcttgtaatgagaccaattatattggatcaggggccaacctaatggcctcattttaatttaatcacctttttaacgaccctatctccaaatacagtcacattctgccgtatggggtgttagggcttcaacgtatgaattttacagaacacaattcagcccgtaacaatatcattaagtcacaatgtgtaagggaagaaactt

SEQ ID NO: 640100 - DNA, 478 bp, Homo sapiens
  misc_feature (251)..(251): n is a, c, g, or t
  misc_feature (272)..(272): n is a, c, g, or t
  misc_feature (300)..(300): n is a, c, g, or t
aatttcacttactagctgtgtgacgttgggcaagttacttaacttctctgtgcctcattctccatctgtggaatggagacagaatggtgagctacccccagaggtttacaaggactaaatgaattcattcacaaaaagcctcagagtgttacactgtagcattcagcaatgcttgctattgtatcttcccttgctattgtatcttctagttctggataaacaccgactatacccacagggaggcacagacncagggtgcttctccgcatggntggctttagtgaaaatttggcagccacncagcatcccaccagaggatactgtggaagactacatggtagatgcaggtgcgtctgtgctgattctgatggggaagcctgggtgcagtatttggccccatccatctctgagaggctccagaagccgtcaaaccaaaatcaaaatagtggccggctaaggctgaccattcttaatgaaa

SEQ ID NO: 640101 - DNA, 258 bp, Homo sapiens
  misc_feature (21)..(21): n is a, c, g, or t
  misc_feature (34)..(34): n is a, c, g, or t
  misc_feature (203)..(203): n is a, c, g, or t
  misc_feature (230)..(230): n is a, c, g, or t
  misc_feature (245)..(245): n is a, c, g, or t
tttcctccaagatgattattncatgaaacaccanttatacaaattgagcacatcttaaaagaagggttgccagcatgcctcctcatccccttatattgccacttccatttcatctcttttgtatcataaatgaacttcagctggtaaagaaaattgaactgctctctcccacccaaaattctcgatatttaatgctgtagcancttcaaagaaagcttgcccgggtattnttattttttttatanatgtgaagcgatc

SEQ ID NO: 640102 - DNA, 854 bp, Homo sapiens
cgcggcacagggccagccgcacagtcggaggaagggccggagcgaggcggggcccggggctgtcaagggaataaaacatcccaaggcctgcaaattgctgctctcagcttttttcccccctcctcctgcttcgcggggtgggggggttgggggggggggtggtggggggagaaagcagcgcttcctctggaggcggatgcaaacaaggatgcagaattttaaccatctcctgctaccggcccgtccttcctgagcagggtttgggcccaggcctggcgccgtggctccctgggaagggaaaggccagagcagccgatgccggttctgggggacgccggaaagcccagcctcctctgcacctccatccagaaccgggggccccgcagcacctgcagcaggggtggacgggtgggaggcagaaggggcctggtgctctcggaggctgcacctcacggtaccagtcgctacccagagcagcacgcctgtttgctggcctgctcttgggtgttaaacatggtgtccaggtccccggttggagaccccagccctgtaccgggtgagggtcttagctcccactgacttggggccttcaaacacactggcatcccaggccttcctcctgactgacttctgttttaaaaataattgtggaccgttttctggcatctggtgagggattcacacactgtttactgaggggcaggacttaaggaatgagttcagaaggtatctatcgtggtcacgtggaacaacggcagggcaagccccctgtgctcctcgctggattgagcttccaagagcctcagagatggaattcgcgatttgccgcgatttggggtaacttattgaccccg

SEQ ID NO: 640103 - DNA, 847 bp, Homo sapiens
ggaagagcctcgtcctgtgtgcggcgtgtggtgctggctggtcgccgttatggccactgggctggtgctggctgacctgccctgggctaggaaagtggcccagtgccccgaatctcgtgtgtgcctgctgctccagctgcggcctgcgccatggcctcctccgccgcctcctcgtgagcatttctgatgaagctgcacgagatcttcctgctgtgcctccatgaagacctacaagtggtgtgccctgagctgtgctgctgggtgacggctgtggtgacctgaagaaaatgaagaaatttgatcacgtggcatttctgatcgaacaatgcaacatgtgaacgcaagatgaaactgctggcaagagatggacggatgtgatgctacgttattgcacccctgtctttcctgaaaccccatgatgtctaatgcttctgaaaactaccgtgaagggaccttgctaaactccatcagtggaggtgagaagcacacctttgacagccacaccgtggaggccggacgacgcacatgaacatattggcatatatgcctgtacagaactgacgcctattgaatctggcctacagtctcaaatgggcaatgcttcttgcaggcgcacactgaaacgcgcctgaaaccgtggcccacccaacagctattgaacagtttcctccatcgcgaactaggcccaccaggagtacttgaacccacgacttgggcctccagacgcatccataccatagacgctgtgtgcggcaaccaacgtagaacccactgattgacccgtacccaaggacgtcaacgtggctaaatccacacagtgacaaagttgacgcacccgccaggcacc

SEQ ID NO: 640104 - DNA, 136 bp, Homo sapiens
actagtcacggttggcgtgaaattatcatttcagccacctttcttattctcgtgtgaggagggcacgttatatggactttttaaggttccatgtgccatattgtccactaccggcagtagccaaccgtggactagt

SEQ ID NO: 640105 - DNA, 112 bp, Homo sapiens
ggatcccaattcgacacaaacttttcccaaacacttagaaaggcatacttcacaactcgttttacaacggccagtattacctcaatatctaaaataaagcgaagacattgcc

SEQ ID NO: 640106 - DNA, 359 bp, Homo sapiens
caagcggctcagcaagacatggtgatcttggtctactatattagtgcgttcaagcaaagcacttgagggaggactgtttccaccaccgtctcacaacagcgtgataactgggtctggcatcttgatgtctatctctgagtacatcttccgctcatcatgcgtcacacagtccaggtagagctccccgagtggctcaggatcaacatgctcgccaggactcctccagctcggtggtgagggataaatcagctctgtgttgactcgttgcgcaggccatgaagcatcttgggcagctctgaggggttgactggctccacagcaatcttgataacagatgtggtattgaacttcaagggtcg

SEQ ID NO: 640107 - DNA, 720 bp, Homo sapiens
ctaacaagggaaaagtcatacaccttcttattctgggccaaaaaaacaaaaaaaggggttgcagacaccaataattgaaggccagtgctctaataaactcacaaatagtctttgtgtacggaaatatatagacagcgagcgagacgtcttttcgtgtggcgactccaccctggtgttgccccctctcgctcccccattgtgggagcgccacacacatagtattagttggtctctcccgccctaccacacgcacgcccacctcttttacatgttttcccccccccttcaccctctgcgaccacttcaggatatatctcacgctctccctcttcgtatacgggaaaccataaggaccacacgccgctctctcagcaccactcgtcgctcttttcatctctcgagtaaacaatgcgtagacttgatataccaccaatgcaataaaaataagcggttacaacacctcttcttataatttcgtaccatacataacgttgatgatccatatcttatccacgagtcggcacacatggtggggccatcaataggcaacactctgtctgccggtagaacttataggcccccttttgggaccacctgcggacctctcattggtgccgtggaaaaaacaggcggtttgaatagtccttaatacccctcgttagcccctctgcgggcgcctccttttgagttataaataaaagcaacaacccccaacataac

SEQ ID NO: 640108 - DNA, 993 bp, Homo sapiens
gctctttccttgcctaacgcagccatggctcgtggtcccaagaagcatctgaagcgggtggcagctccaaagcattggatgctggataaattgaccggtgtgtttgctcctcgtccatccaccggtcccccacaagttgagagagtgtctccccctcatcattttcctgaggaacagactttaaagttatgccctgacaggagatgaagtaaagaaagaatttgcattgcagcggttcatttaaatcgatgggcaggtccgaactggattattaacttaccctggtggcatttcatgggattgtccatcaagcatttggccaaggacggggagaagaatttcccggtcttggatcttattgaacacccaaaggggttcggcttttgctggtaccattcggttatttaacaaccttgaagggaggggcccaaggttacacaggtttggtggccaaagtggaagacaaagaatcctttggtgcgggccaccagaagggaaattccccgtcattctgggtggaacttccattgaatggccccggcaccaattcctggcttacccccagaatcgcccttccattcaacaggttgacattgtatacccaattccaggatttggactttaagaacgacttgggcaaaggatttacttggatttccatcaacagttcgacaactggtgtaaacctggtgtacattggtgacctggtgcaggtgcttaaacctcaggaagaatttgcgtgtgaattcaccatacagcagagcaggcacctcgtggatcctttgaccgtggttcacggtgaaaagatgccaaatggcaaacaagctttggcaactcgaacttttccaacatgtggtgatttggcaaagggcaaccaaaccatggatttctcttccccgaaggacagggttatccggctccaccattgctgacagagagacgacccacagaactggccggccaacacagagcaatgggtgaaatgggtcccta

SEQ ID NO: 640109 - DNA, 653 bp, Homo sapiens
  misc_feature (19)..(19): n is a, c, g, or t
  misc_feature (62)..(62): n is a, c, g, or t
  misc_feature (139)..(139): n is a, c, g, or t
  misc_feature (183)..(183): n is a, c, g, or t
  misc_feature (186)..(186): n is a, c, g, or t
  misc_feature (238)..(238): n is a, c, g, or t
  misc_feature (289)..(289): n is a, c, g, or t
  misc_feature (314)..(314): n is a, c, g, or t
  misc_feature (319)..(319): n is a, c, g, or t
  misc_feature (321)..(322): n is a, c, g, or t
  misc_feature (334)..(334): n is a, c, g, or t
  misc_feature (368)..(368): n is a, c, g, or t
  misc_feature (372)..(372): n is a, c, g, or t
  misc_feature (376)..(376): n is a, c, g, or t
  misc_feature (390)..(390): n is a, c, g, or t
  misc_feature (474)..(474): n is a, c, g, or t
  misc_feature (482)..(482): n is a, c, g, or t
  misc_feature (504)..(504): n is a, c, g, or t
  misc_feature (513)..(513): n is a, c, g, or t
  misc_feature (515)..(515): n is a, c, g, or t
  misc_feature (531)..(531): n is a, c, g, or t
  misc_feature (540)..(541): n is a, c, g, or t
  misc_feature (586)..(586): n is a, c, g, or t
  misc_feature (649)..(649): n is a, c, g, or t
agaaaaagaaaaaaccctnattccccggtaaggaaataatgtttacactatttttctgtaangccagctaagatatgcacaagcgagagaaatagaaagcatttgctaaaatatttgtaacaaatacttatgtacaaanaattcacaaaaggctagttcccccttgaagcagagcacatggcngtngaaactggaacagttcaaaccactggctgggattataagccatgccactgantccagaggaagaaagttacatgttgtggggattttcagtttgaacattaanatttccaaagtttggcaacattatnttttntnnttttgcaaattntgttaacaagaggtacattttaaattgttcttcntgcnaaantccttgtcatgcangggcaccaagcaccggggtttttctctcacagacagagcccatgtatgtgcagccactcagttgaaggaacagcgatggcaggnaggttgtnctccattttcagattgatttanccttgattnanccttgcccttttccanctgattttnnaaaccagtttttatagagaaactattaaagggaaagactactgtnatacaaagctaaccaaaatgtttttcttccagctaacagtacctttgcagaaatgggaagggntaag

SEQ ID NO: 640110 - DNA, 181 bp, Homo sapiens
gtagagaatatgtttgattcatttattcagcatgtaaataaaattgatcctgttgagttatcataatgcagttcaactatctgccatgattatctttcacgtatcattcattctgtcatatgtgtcaattgagagtatagcatctatgtaactatgtaatgtatctcgatgagttctcagg

SEQ ID NO: 640111 - DNA, 286 bp, Homo sapiens
ccgctctagaggagcgtcacactgggttcgagttccagcacaggtatacacagtcatgatgggagcatccaaaatggaatctaaatttgccaggcgtggtggtgccacctgtaatcccagctactcaggaggctgaggcaggagaattgcttgaacccgggaggcagaggttgtagtgagcagagatcctgacactgcactccagccagggccacagagcaagactctgacccaaaaaagagggccacttgaacccaagagatctaggttggagagggaccaccac

SEQ ID NO: 640112 - DNA, 142 bp, Homo sapiens
gtctacatgatcctgtctgagatgaaaaatagcttgaaaattattgcaaccaaatctttgatgcaggcacatggtttttttgtagtttttgttttgttgagatggagtctcactctgtcgcccatgctggagtgcagtggtg

SEQ ID NO: 640113 - DNA, 364 bp, Homo sapiens
cagagacgccgtactggccatactctagccgtggatccaagagacgagaggcgaagcagagagccagtgaaagagagtcacatagaaaatatgggcctatgaggatcaagcactccatcatctgccatgcatgcataccataagtaaagctgcagcgcactccatcttcatcctccagagctgacctccagtcttctgatctcgctgttgatcgtcaagatgcaaactgcagggacaggattatgccgaatggacctctacatcctgtgcttttctcctagtttctctccaccctggaacattcgagagcaaatcaaaacctctatccagacaagacaaaataaaactcaacatctccctaaga

SEQ ID NO: 640114 - DNA, 1508 bp, Homo sapiens
ggcgcagccgcgctggccccgggacccgcgcccgcgccgccgccgcgcttcagcctcagcttcggcctcagcccgccgcagagggacgcggagcccggcgctgagccctgcgcgcgcgcctgccggtccgatctggacgaacgcgaggcgttctgcgagagcgaattcgcggtgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggtattgaaactgacctgaatgacgctgcatatgtactttataccaccgtttgtaacgtgggtgccacagcccgggctgtaggtcgcccagcctttttttgggagcgatggggaacaatgacatgaatgggatttagacgacaggcagcaggtatattgtgatgggccacatctaccataagagacggcagctccctacagctctgctccaggtcctgagaggccgcctccgtccaggggatggactgctaaggagcagcagcagctatgtgaaaaggtttaatcgaaaaagggaagggcagattcaaggtgcagttcatacccaatgcatttgaaacaaccatcctggcatttctggaccgcaagagacttggacgtcggcaacaagacatgaaaggtctaccttcatgtaatgggtcctccttcagaagagagccctcagctactctgtgaatgacttgcatagctgcaactgtaatctcgaaggtgtcactttgttatttacaagatgcttcttaaatgggctgctcctgagctcagtgtcaaggtgattcaactgtagtgccagacaatgatttacacagctcagataattgacctgtccagttaacagatcattgcttcataagtttttaaattattttaatttaatattctttagtagaaatagtccacaaaaacattttcttgaatttaaatatacaacttttatatcatgtatcaaaccagattttatattcaaacgatcacattttaaattctgtacataacagtaagcgcactagtcaaaagacatttatgtttgaaatgtcatttagatcaaacacaagggtcaaagcccaggacaagtataaagttttatacttaaagagtactaaagggccagtgtgcagatgggtggattaaaaaaataaataaaataaaaaatagtactaaagggcttacttcaggcaaaagtgttcctgacgtaccaaaaagtaagatatagtttattttcatgcctccctgctcctagtaatgtatgttttgtgctgaactggcagctatcccaatgtgaaatgtattttggatgtatctggtgtcatttttctattaagaccaagtataatgtttgtttgtaaagcaataaatcttgacttgaaatcaga

SEQ ID NO: 640115 - DNA, 756 bp, Homo sapiens
  misc_feature (58)..(58): n is a, c, g, or t
gaagtgcttgcatattactggatggactcgggacgatcgccgggttagcgtacaaganctagatcaagttgaggtatgcgctctcttatgtctattcacccctcctgcgtaataattttcataccttttctttacgttaatcctgtgccttattagttcttccaatgtgtgagtttggttcgtgcatttccttgttttcgagggaacgagaaatgtgggtttcgggattttaaaaggggccaaaaattttaaaaatttggggtttgtgaaaggggcgggttttaatttgggggcaagatgtgcgcaaaagaggttaaacgcgcgaaggagaattcttgtgtgagaaccagtgagggggcaaaattttttccttttggttgagagcgaaaaaaggtttatgagaaggacaaaaaacagggaagaaacttttttttcccgttgggcgcaggagagaaatttaaaaaggggggagctttttcgcccacagaaaattttttttttggggggggggggattttatgcggggcccccttatatatagaggggcgcaagtttaaattgcccctggtttttgtggccatcttaagtgctaaggtacgttttctaacggtgagtcttgtatctcttatattctagaaacgcacatccaacgtgtatagaaccaaactgtgaagttcggtaaacctatggacatccgggttaaaaatggaggtataggaaaaggagaaattctataatggtgccggttttatattg

SEQ ID NO: 640116 - DNA, 228 bp, Homo sapiens
ggggaaaaaagattgagggggggggaaattgggggggcccttcccccaaagggggaaaaaatttttccaaacctcccccggggggggtctttctaagggggggaccccccacccgccttcccccgtttttagcggggtcggggggggggggtcccaaaaccccccaaaaagggggggggggggggatgaacgttttttttttgtttaaaaggggcttttcccttttta

SEQ ID NO: 640117 - DNA, 124 bp, Homo sapiens
caggctcatatctgggctggcatgaggtcgtcgataggctattcctgctaccaagccgctgtccatctacgatgagcagcttcactaccgtccaccaccatactgcaccagctccacctctgag

SEQ ID NO: 640118 - DNA, 758 bp, Homo sapiens
  misc_feature (755)..(755): n is a, c, g, or t
ggcgcagccgcgctggccccgggacccgcgcccgcgccgccgccgcgcttcagcctcagcttcggcctcagcccgccgcagagggacgcggagcccggcgctgagccctgcgcgcgcgcctgccggtccgatctggacgaacgcgaggcgttctgcgagagcgaattcggtgagcccggccgccgcgccgccgccccgccgccccgcgagcctttccgagccccggagaatccgcccgcgagatcccagggcgcctgacccgtgcgggccgtttcgcggttgctaaaaaccacctcctgggggactgggagaggaactcggggtaatgctcttctccaaactgtttttcggaagcagcggtgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggtattgaaactgacctgaatgacgctgcatatgtactttataccaccgtttgtaacgtgggtgccacagcccgggctgtaggtcgcccagcctttttttgggagcgatggggaacaatgacatgaatgggatttagacgacaggtattattccggccactctgtgatttaagccctgtcagcccccaccctcaagggtgagaacancaa

SEQ ID NO: 640119 - DNA, 428 bp, Homo sapiens
  misc_feature (15)..(15): n is a, c, g, or t
tgtatatctaattcngtgagcaggcttgtaattcttatgcaaagatctttcacctcccttgttagctgtattcccaggtattttattgtatttgtggcaaccgtgaatgggtttgcattcctgatttggctcttggtttggctgtttttggtgtataggaatgcttgtgacttttgtacattgattttgtatcctgaaactttgctgaagttgtataacatatcaaggaacttttggagagagactatggggttttctagatatagaatcatgtcatctacaaacagggatagtttgacttcctctcttcctatttggattccttttatttcattctcttgcccgactgctttggccaggacttccaatactccgttgaataggaatagtgagaaagggcatccttgccttgtgctagttttcaagcg

SEQ ID NO: 640120 - DNA, 141 bp, Homo sapiens
ctgcccgcactgttctccctgcctggattctgagcagagcccaggctccagcatcgggtggaaggcaggatgggcctgtggctccaggtggagactccgtctgctttggagaattctggcatacctgccacatgtgtattt

SEQ ID NO: 640121 - DNA, 1365 bp, Homo sapiens
ggcgcagccgcgctggccccgggacccgcgcccgcgccgccgccgcgcttcagcctcagcttcggcctcagcccgccgcagagggacgcggagcccggcgctgagccctgcgcgcgcgcctgccggtccgatctggacgaacgcgaggcgttctgcgagagcgaattcgcggtgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggcagcaggtatattgtgatgggccacatctaccataagagacggcagctccctacagctctgctccaggtcctgagaggccgcctccgtccaggggatggactgctaaggagcagcagcagctatgtgaaaaggtttaatcgaaaaagggaagggcagattcaaggtgcagttcatacccaatgcatttgaaacaaccatcctggcatttctggaccgcaagagacttggacgtcggcaacaagacatgaaaggtctaccttcatgtaatgggtcctccttcagaagagagccctcagctactctgtgaatgacttgcatagctgcaactgtaatctcgaaggtgtcactttgttatttacaagatgcttcttaaatgggctgctcctgagctcagtgtcaaggtgattcaactgtagtgccagacaatgatttacacagctcagataattgacctgtccagttaacagatcattgcttcataagtttttaaattattttaatttaatattctttagtagaaatagtccacaaaaacattttcttgaatttaaatatacaacttttatatcatgtatcaaaccagattttatattcaaacgatcacattttaaattctgtacataacagtaagcgcactagtcaaaagacatttatgtttgaaatgtcatttagatcaaacacaagggtcaaagcccaggacaagtataaagttttatacttaaagagtactaaagggccagtgtgcagatgggtggattaaaaaaataaataaaataaaaaatagtactaaagggcttacttcaggcaaaagtgttcctgacgtaccaaaaagtaagatatagtttattttcatgcctccctgctcctagtaatgtatgttttgtgctgaactggcagctatcccaatgtgaaatgtattttggatgtatctggtgtcatttttctattaagaccaagtataatgtttgtttgtaaagcaataaatcttgacttgaaatcaga

SEQ ID NO: 640122 - DNA, 1696 bp, Homo sapiens
ggcgcagccgcgctggccccgggacccgcgcccgcgccgccgccgcgcttcagcctcagcttcggcctcagcccgccgcagagggacgcggagcccggcgctgagccctgcgcgcgcgcctgccggtccgatctggacgaacgcgaggcgttctgcgagagcgaattcggtgagcccggccgccgcgccgccgccccgccgccccgcgagcctttccgagccccggagaatccgcccgcgagatcccagggcgcctgacccgtgcgggccgtttcgcggttgctaaaaaccacctcctgggggactgggagaggaactcggggtaatgctcttctccaaactgtttttcggaagcagcggtgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggtattgaaactgacctgaatgacgctgcatatgtactttataccaccgtttgtaacgtgggtgccacagcccgggctgtaggtcgcccagcctttttttgggagcgatggggaacaatgacatgaatgggatttagacgacaggcagcaggtatattgtgatgggccacatctaccataagagacggcagctccctacagctctgctccaggtcctgagaggccgcctccgtccaggggatggactgctaaggagcagcagcagctatgtgaaaaggtttaatcgaaaaagggaagggcagattcaaggtgcagttcatacccaatgcatttgaaacaaccatcctggcatttctggaccgcaagagacttggacgtcggcaacaagacatgaaaggtctaccttcatgtaatgggtcctccttcagaagagagccctcagctactctgtgaatgacttgcatagctgcaactgtaatctcgaaggtgtcactttgttatttacaagatgcttcttaaatgggctgctcctgagctcagtgtcaaggtgattcaactgtagtgccagacaatgatttacacagctcagataattgacctgtccagttaacagatcattgcttcataagtttttaaattattttaatttaatattctttagtagaaatagtccacaaaaacattttcttgaatttaaatatacaacttttatatcatgtatcaaaccagattttatattcaaacgatcacattttaaattctgtacataacagtaagcgcactagtcaaaagacatttatgtttgaaatgtcatttagatcaaacacaagggtcaaagcccaggacaagtataaagttttatacttaaagagtactaaagggccagtgtgcagatgggtggattaaaaaaataaataaaataaaaaatagtactaaagggcttacttcaggcaaaagtgttcctgacgtaccaaaaagtaagatatagtttattttcatgcctccctgctcctagtaatgtatgttttgtgctgaactggcagctatcccaatgtgaaatgtattttggatgtatctggtgtcatttttctattaagaccaagtataatgtttgtttgtaaagcaataaatcttgacttgaaatcaga

SEQ ID NO: 640123 - DNA, 1553 bp, Homo sapiens
ggcgcagccgcgctggccccgggacccgcgcccgcgccgccgccgcgcttcagcctcagcttcggcctcagcccgccgcagagggacgcggagcccggcgctgagccctgcgcgcgcgcctgccggtccgatctggacgaacgcgaggcgttctgcgagagcgaattcggtgagcccggccgccgcgccgccgccccgccgccccgcgagcctttccgagccccggagaatccgcccgcgagatcccagggcgcctgacccgtgcgggccgtttcgcggttgctaaaaaccacctcctgggggactgggagaggaactcggggtaatgctcttctccaaactgtttttcggaagcagcggtgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggcagcaggtatattgtgatgggccacatctaccataagagacggcagctccctacagctctgctccaggtcctgagaggccgcctccgtccaggggatggactgctaaggagcagcagcagctatgtgaaaaggtttaatcgaaaaagggaagggcagattcaaggtgcagttcatacccaatgcatttgaaacaaccatcctggcatttctggaccgcaagagacttggacgtcggcaacaagacatgaaaggtctaccttcatgtaatgggtcctccttcagaagagagccctcagctactctgtgaatgacttgcatagctgcaactgtaatctcgaaggtgtcactttgttatttacaagatgcttcttaaatgggctgctcctgagctcagtgtcaaggtgattcaactgtagtgccagacaatgatttacacagctcagataattgacctgtccagttaacagatcattgcttcataagtttttaaattattttaatttaatattctttagtagaaatagtccacaaaaacattttcttgaatttaaatatacaacttttatatcatgtatcaaaccagattttatattcaaacgatcacattttaaattctgtacataacagtaagcgcactagtcaaaagacatttatgtttgaaatgtcatttagatcaaacacaagggtcaaagcccaggacaagtataaagttttatacttaaagagtactaaagggccagtgtgcagatgggtggattaaaaaaataaataaaataaaaaatagtactaaagggcttacttcaggcaaaagtgttcctgacgtaccaaaaagtaagatatagtttattttcatgcctccctgctcctagtaatgtatgttttgtgctgaactggcagctatcccaatgtgaaatgtattttggatgtatctggtgtcatttttctattaagaccaagtataatgtttgtttgtaaagcaataaatcttgacttgaaatcaga

SEQ ID NO: 640124 - DNA, 406 bp, Homo sapiens
caaaaaaagaagagtcgtgggcctcctagccagttacattccagaggatgaggcgctgatgcttcgggatggacgctgggctggggccatttgcagccatcgaccggtactggacaccctggccatgctgactgcccaccgtgcagttcttgcagcgtttctatggcaagaagcagccggtaaaggaaagaaagcagagtgcaaaacatcagaacgaattgagaagggatgaaaccaaagctgaggctcctctgcttgctcagacactacttatcacgcagagtgctacgcacagagctccgcactataacagttgctgccgccggaagtacagaccagaagccctgggaccctctgtctccctttcccctatgccaccctcagaggtcaaactccaaagtgggat

SEQ ID NO: 640125 - DNA, 1883 bp, Homo sapiens
  misc_feature (1462)..(1462): n is a, c, g, or t
ggcgcagccgcgctggccccgggacccgcgcccgcgccgccgccgcgcttcagcctcagcttcggcctcagcccgccgcagagggacgcggagcccggcgctgagccctgcgcgcgcgcctgccggtccgatctggacgaacgcgaggcgttctgcgagagcgaattcgcggtgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggcagcaggtatattgtgatgggccacatctaccataagagacggcagctccctacagctctgctccaggtcctgagaggccgcctccgtccaggggatggactgctaaggagcagcagcagctatgtgaaaaggtttaatcgaaaaagggaagggcagattcaaggtgcagttcatacccaatgcatttgaaacaaccatcctggcatttctggaccgcaagagacttggacgtcggcaacaagacatgaaaggtctaccttcatgtaatgggtcctccttcagaagagagccctcagctactctgtgaatgacttgcatagctgcaactgtaatctcgaaggtgtcactttgttatttacaagatgcttcttaaatgggctgctcctgagctcagtgtcaaggtgattcaactgtagtgccagacaatgatttacacagctcagataattgacctgtccagttaacagatcattgcttcataagtttttaaattattttaatttaatattctttagtagaaatagtccacaaaaacattttcttgaatttaaatatacaacttttatatcatgtatcaaaccagattttatattcaaacgatcacattttaaattctgtacataacagtaagcgcactagtcaaaagacatttatgtttgaaatgtcatttagatcaaacacaagggtcaaagcccaggacaagtataaagttttatacttaaagagtactaaagggccagtgtgcagatgggtggattaaaaaaataaataaaataaaaaatagtactaaagggcttacttcaggcaaaagtgttcctgacgtaccaaaaagtaagatatagtttattttcatgcctccctgctcctagtaatgtatgttttgtgctgaactggcagctatcccaatgtgaaatgtattttggatgtatctggtgtcatttttctattaagaccaagtataatgtttgtttgtaaagcaataaatcttgacttgaaatcagatcttggatgcacctgtttgtttttgttttagccttactgagccctaaaggtttgagaaaaaggctttctcaaattcattccccaaaccttggaaccnatattcaccaatgacggctcacaagcaagcgaattttaaacatttttcagttggttttaaaaaggtttaattggccgggtgtggtggctcatgctggtaatcccagcactttgggagccgaggccagcggatcacctgagggtgggagttcgagaccagcctgaccaacatggagaaacccccgtatccactaaaaatacaaaattagccgggcgtggtggtgggtgcctgtagtcccagctacttgggaggctgagacaggagaatcgcttgaacccgggaggtggaggttgcaaggattgtgaacttggcaggtaaagtataacaggtactgaaaatacttttagccaaggaaatctattgatgcaaattaaatgtatttataagcccaaggcctggggtagaaacatcctaagaatat

SEQ ID NO: 640126 - DNA, 262 bp, Homo sapiens
tgcgctcgaagttgcaatataagtcgtggatgtagaaaggatcatcgaaagcagtaggctggcgtcgtcccccacagacatgccagtaaaggtggccaggtcgccacagtaaccccccatggtctccacgatgaacacacggtgcttggtccccgaggcagaatgtattgatgcggtcacagctctccatagtaccggtcacagggggtcggcgcgccaccctgctgcacggtgagaccaggacattggtcctgccgtcgaa

SEQ ID NO: 640127 - DNA, 409 bp, Homo sapiens
gtacttgggtttagcacgcatagctaggcaacatgacggacccacacgggatgacacagaaaagaggcgagaatgtgagatagatagagcggtcgcaagtgaatacaaaagtcccaggcagcagtttcacatgaggagacgaaggaaacttgaaatagctgcatgcgctaagggccaataagtccctgaaaaataggatgaggaccaagctggctacgaccaaacagacacgaacatggcgctgtatttgatgtaggtacacctaagatctcatcgtatgatcagtaacatatgaaaccgtacacccaccagtgccaagacggctccaggaacacctgtatttgggtgtaaatagtggcaccacggtcttgagaaatctttaccttttcctggactcttcatgaatata

SEQ ID NO: 640128 - DNA, 1201 bp, Homo sapiens
  misc_feature (514)..(514): n is a, c, g, or t
  misc_feature (585)..(585): n is a, c, g, or t
  misc_feature (588)..(588): n is a, c, g, or t
  misc_feature (1085)..(1085): n is a, c, g, or t
  misc_feature (1111)..(1111): n is a, c, g, or t
ggagtgtcggatatgatgtttgcgtctacttcattccgtgacacgcgtgatcttcgcactgtccagtggaaggttacgagaaaggtcctggcggcatgagaagcgggacacacgcaactatcacagagtaattcgaccaaaactcgactaactctatgaagcggggttgcggcagggtatgacttgaaattcgctggaggtgccaatgtatggcgatcatggtagggtctgttggttgatgtatacgtggccacttgaggagtgcgcctaggcatgacaggacgtggtcctggctctctcggtgtcacgcaaagcatcgtatagatggtgtgagccgtgctggcatagacgaagccatggggacaagcgcatatggcccttcggtgtcgcccttagtgcaaagatcgacttgggagagagcatttgaggtgcgcatgaaaagcccggcgcggaccccaacgtccggctgcctcggacatgggcatgtagatctagcttgggcgccatcctagcnattgttcctttcgttgcacttggagccccggagactcggtgatcaacgtggcttgatccatcgaagacgcnacntatgtcgcacacttgggtgatcctatcttcccatcctctgtgaccgtgcggtggtagcagcttagtcgctatgcgatcggcttttgaggttagtcgcccggatcgattgggcaatggaggtgctttgcccatctcataaccaacgaccatatggcgagagtttgaactattcgaccgtgagagctttctccgggccgctcttggggatgcgccctagtgtacccgaagggaacagcccccaggcgaggaaagtcacaacgccgccgcggttgggagtttgaatccgctgtgaaggtgaggcatgcctttttcttacaagttaggcgtctggtctagggtttggtgtgcgcccatttaataatccgcgttcccgtgcaacccaccatggtgcgtttggggaagaggatctgtgttttcaactccgcaggggttggggtcataattaagcgcggcgcgcgaaccgttggccctctccacttcattggtgtcgttggttngactctctgagagaattcgccccatnggaacaaggttctgtatcaagtgggctcacctcaatggtataccgggtgagagattctttctcctcttgtgggctggtgtgcgaggggaa

SEQ ID NO: 640129 - DNA, 936 bp, Homo sapiens
agctgggcatgatggtgagatgtgtgtgtgatgtgggcgggggtggtctccgcggtgagtgagtgtgtgagtgatgtgctgtgctggctgtgctgtgctgtgaatgatgtggctgtgagtggtagttgggagtgtggtggtccctgctgtgcatgcgttgtgacaactcctgtgtgttggtgcgtccattggtagcttgcattgctgcattgacatgtggcttgtgatgcatgcctgtgcttcctgcttctcagccatgttctctgctgtctgtgaatcagactgtgtccattccaccgtgggatgtcacggttcctacccctggagcccctgacgccagtgcccatacgccatgcctgcccccgacacgtgagcacatggttgtaagaggttaacttcatattgagaaggccaacttgacatcaagatggaggcccagagctatcactctctgagatgtagctctttcattccccagccaggcatttagagacaaggtgggagcagacgggactgcatgagtgaattgacttgcacagtctcgccgggtgcacagtccgggccgcggctatcagcaggacacgttctatcgcgcccctttccttggggattgctaacgcgggataactgctcatgacattctccctactagcaacgccagaacttcatcactacggtcgcccactggccaaggcaagatgtcggtaaccccttctaaaagcgcaagtttatgtagttgcgccagacatatccattggaaactttcttcaagcactacaattgctacgccactagcgccctttagcccgcggtcctattagcgtctccccttttaccgccgctctgggttacacttgactcagagcggactattccacttggtcatgcagcaccatttcttggcttcccttgtttgaaacaggcgacaggtcttga

SEQ ID NO: 640130 - DNA, 306 bp, Homo sapiens
aaaaaaaaaaaaaaacccaaaaaaccctcctttttaaattggggctggggtaagtacccccttttctcttttggggggggtttttaaactttttttgttttttttaattaatccccaaaaaaaaatgcataatttgtaaacttaattatatgttttatatttttttagcttagtagttggaaccccttagtctttaggggcaaaactgttgtttaatagtacttaaaaaaaaaaagtttgtgttttgagcctggccatgttttttttaaaaaaccaatatcccataaaaaaatgaattccttggga

SEQ ID NO: 640131 - DNA, 957 bp, Homo sapiens
  misc_feature (7)..(7): n is a, c, g, or t
tcactantcacgatctcaactaagagtcaaaatactgccctgcctgtgaccatttcacaaagtatgccacacctggtctccaccggtttcacacgtgttaaaaaaaaggtctcctcacccctttaatcgcggttccaagcttatcacccgcttgaaagtgcccaaaagcttttaaccccagcgtcgttctcttttcccgcccctccctcaggaatttcgcaaggtccccacctaaattcattgccgatgctgcccaacaacccgcacatcttgtttgtcccgcgaacccacatgggggtgtgttaccacaacgaagcgggttcattggtgggagcccccaacggtggccacgctggtgcaacgtgttcccctgctgcaaaagtatcagggaagccccatgtgcgagagcacagcatcgtccgcgcgttcaccaccgtgaggttttcgatcccaaatattcgcacaggggtacccccacagcattgagccccagtacgtgagaaggatttcaccaacgcgcctgcggttcatgccgcaactcacaaaaacagtagagagactctgtttcccaaggaacacccttcagatgtgggaatcttcagggtacatacgagccttatatatctcacttcgaggagattgatctctcagatgagaatatcactttctgggacacccgtcctaaagagggcctgcatgattcttcctcctggccgccttcaacaagatttatgctccccccagaggcgtgagaacggaagcataaaagcggccccaccttgcgttgagaacacggcgaagatgaatctgtccaacacacacggaggggaacccccgagatccacccctggttctttataaggagaagaaaatgacatcaaagaggtgtccccccaaaatatttttttaaacaggggtgggtataaaccacccggccgtgtccaacacaaccaaaaa

SEQ ID NO: 640132 - DNA, 387 bp, Homo sapiens
  misc_feature (123)..(123): n is a, c, g, or t
  misc_feature (139)..(139): n is a, c, g, or t
  misc_feature (149)..(149): n is a, c, g, or t
  misc_feature (235)..(235): n is a, c, g, or t
  misc_feature (262)..(262): n is a, c, g, or t
  misc_feature (282)..(282): n is a, c, g, or t
  misc_feature (290)..(290): n is a, c, g, or t
  misc_feature (318)..(318): n is a, c, g, or t
  misc_feature (343)..(343): n is a, c, g, or t
gccctcttcccctgcccctgggatcctgggcctgagccctcctgacttgccgttgaccccaacagaatgcagtgaaaagtgatgcccgatacctacccctccctgcccctagacttgggatanccctggcagcctatantccttcccantccctcaggacttgcaaaaacgggtcctcaacatgcccttccccagagcccatgaggtgtttctttgccccattcattgatcctgngaagtgagtgtaaggagtttaaatcancctctgttctgtgctagttnaggtaatncagttgctgcagtaccagggggtaggtncctgtggacggctctgcgaatgggncagttgcatttcttgggaatcaagtgcatccctaggctggcagt

SEQ ID NO: 640133 - DNA, 252 bp, Homo sapiens
ctccacttggtagccaggctggtctaaactacggagctcaagcaatcagccggtctgggcctcccagagtgctaggactacaggcatgagccaccaggcccggccaggaactgttatctggcacggaaacatttcaatattggtatggaaaaaaaaaaagtgttaagctgaaacatttatttctcttaaaagtcctacgtcatgggtccattcctggcactgtaaaacgaaatacaaactggagtcttctct

SEQ ID NO: 640134 - DNA, 215 bp, Homo sapiens
aatacagcataatccttcagcctccaaagcatctttagggtgtgacgccagttgtgagatgtcactgtggcccagggttaccatgggaaaacacatacgctgtgtctgttcttgactggcttcgcatgccgtttctacacatgtttattgtaatgtcaaacgtgccatttctggaggacacttggcacgggacagctatttgtggaacagtgact

SEQ ID NO: 640135 - DNA, 927 bp, Homo sapiens
  misc_feature (649)..(649): n is a, c, g, or t
tggtcagacaaacacatggatttcgggaccacagtagaggagggaaacctttcacaaacttatttattggaaaatacaaatataaaattatacttcccacttctgtgatgtgagagacggccatccacatagtaatttttaacaacggggcttaaagaaaagccacacacaaagaccgtgaaagaggctggagatatatatatagatagatccatatatctgtatatatataaaaaaaatactcactaccaagagtcctcactcagttccatactaaagtataaaagtagggggtgaggctcagccacgagggctagggaaagtttaattagataccgtttattgtccacatgaaacgcttagactggcatcctatacatatggaatccggagtttacaatacaccatgaacggcagatgggctagcccacgctacttaagaggacactcacagatcccacaggggagggtacattatgtccagaatacgtagtagagaccctccgagggaggctcgggaactttggtctctcagccctcgggcgcctccccaatatgcccttgctcccggaaggaaatcgtgtctgagacaatacttccggatattggatacgcccggcgtctgcaatataggtggccccccgggggncccccgaccagcggggaggatacactcaacagggtcggcgtgaggatcactaacttcttggggcagaacaagacacacaaagcaagcacaaacaccaagacgaaaacaacacacaccaaaaaacaacaggggggcggcaaaaaatacatcggggggggcaatacagaccacctttgaaagggggcaaggagcgaaacaagacggcgcggacacacgcagcggaaaggacggctattgacgactcgggggcaaggaaccacaacatgcggccaaaggcg

SEQ ID NO: 640136 - DNA, 352 bp, Homo sapiens
gcaggctgttctcgaagtgcgtgaactcaagcaatttgcatcccggggctcgcaaagtacggggagtataggcataagccacccatgatgcccagcctgaatctgggtttcttccccattcattaaagctataacctgggcctgaactcaatggcacctggcaccaatgggcaactgactctgggtctttaataacctaccttccctagcaggcacggggttgctccctcttcctatcccagggagtcctgtcctctgtgggggctcctacttgatcctctgtgcaatatgaagttctcagctcaagggtgggtggcgcatgactgccaactcttgaggcacagattgcagt

SEQ ID NO: 640137 - DNA, 446 bp, Homo sapiens
aaaaaattaaaggcaagtaggttggcggctagccaggcgaggcgcgacgttgggtgggggaggacgaggcggccgtgctagaagagacgagggtaaagcgtaacggggaagccaggagggcaaggaaataatgcggagattaggggacaggcaaacagggaacgagggcaatgcgggggtaagattgataatagtatgatggcgagctgggcaggcaaaaatgtggggaaggcgtacgcgcaagtcaagaaaaaaaacggcaccaggataactatatgataggaaaaagggagtgcgggagggggcgatttaaacggaaggaaatggcagcaaaaggagttatataagggcaggttttaatgcaatacatgtgaaagagagtgtttggtaaacggcttagaaggcggagataaacgtgacacgcagtttaggtgcacctataccaa

SEQ ID NO: 640138 - DNA, 117 bp, Homo sapiens
ctttacacaatgaagttacacaatcataccccatatactctttcacccacagcacaatcctacctccatcgctaaccccactaaaacactcaccagagtgttcggcttgagcggaga

SEQ ID NO: 640139 - DNA, 895 bp, Homo sapiens
gctgggcttgggtcccccagacggccagctcactcctcccccagcccctgtggggactccgaggctctggcctcagagtgcctccagaaagacagtgggcctctgccgacgaccccctggggtctcactgctgggaggagaccccaccaaggactaccggattccccatgaatccctacctgaaccatacacagcctgcatcccgtgacagcaacctggacaggggtaaggaggcccggggctggggagagcgcacgggagaagccggcgacacagcatgagaggcacacacccaagcataggaagcaccagcaggcacagctgggcagcaaagaagaggaagagacgagagacgagaaagagaggcaaggaagaggaagcagagacccccacaagaagcaagaaaacaaggggcgggacggtcacgagaggaagagcaaagggaggagagtcacgaaggaacaggacagcagagaagaaaaacgcagggcgacacacagcgcgaacagagcgagaaaccaagaaagacacagatgaaagacaacaacaagacaagccggcggaccaagagcaagagcaacaaacagcagagaaaagacagacgagcagaagagacagagagaccatacacagcagaggagacaagcgaagaaggccaaacggagcagaaccccaggagaacggaacgagaaacacacgccagagaaggagagacagaggcagcgggagaggtcggcaggaggcgaaagcagcggaagccaaccgagagggaggagagaacggccagaagaagaggaggagccagacgaaacagagaaagaagagaagacaaccgcaagaaatcagcatagaccacggagaacaaacgcccgacgaaaagcgagagagataccca

SEQ ID NO: 640140 - DNA, 1825 bp, Homo sapiens
ttgagattggtattgtcgaccttcttataccctcttcccagtgccaccgcagaaatgggttacaataggggacagggttccttcagtaacccttgctgacttgtgctcgtgtgagacactttaaactgacagtattacagcttatatctcaggaaaattattcacactcggcggcgatgtccattagtctgcataaccgtaagacctctgagaacctccgacttggatgcccccttctcggctagttgataaagtccatgtgttgtcgacttgttgttccgcacatctatcctctgtagaaggcatctgtgatggcacgagttggtatctggatactgacgatgctaagtactctgcaaacagtgacatttctatcagcatgtgagagaactagatgtgtattacacgacgtaggagttttcctcattagcagtagatgatttctcttccttttgcatgttcttgtcttggatatagagactcatgtaaggtagacatcgtatttgtggcgaatacatacttgggatatgcccttcagtgaagtgccccctggtgttgcgaaaatacattacgattgaatcactctccgcaatccgcacacagttgtgtcccacaaatgactcagcggacactgggcgagcatccattgttgccgtcatgcacaagcgggtctccaatttagccccatgtcactcggcaaaacatatcccacttgccgagctattgggaccaacgcccaaccagggatgtggtcgcgtggcctaagattaccctggagactcgacaccgcgtcgcacgttgcgctccccgtttgcgccaccttctgtctcatccctgtgtgggtggactcaggccttctggcctctgttctctccacggctcccccttcgagtgcaccgctcgcgctcgcataccccaactctcctgggggaacggccctcagccaccttgggggcctgcttgcgatcgcacgcgcacgtcggccccccgtgttcgcactctttatcctggctgcggcgcaaagccatccctctgttggacaccgccacatccccgcttggcgtctaggcgcgtctacccccgcgtgccacgccggctcgggccactttgtaccgccccgcccccgttctcaccgccctggcggcgtgcccacgctgcgcgctctctcctgcggcgccaccctccgcgtccccgtggcgctcgccgacgccctccgctcccccactcgcgctactagtcgcgtcaccccagcgcgccgactcgtacctctaccgccctctctggtacgcggcgccctcgcgcctccgcccccggccgcgcacagacaccaccctcacagaagcgctaaactcaacatctcccacacaccaacacacttgccctctgagacacctttttccgctccacaccagtcgctctttgaccacacacccccgtcgacaccggcgcttatgctcactagcggccccgttataccgcacacagaccgtggtgctctatcatgcgctacccacgaagactccagcgtcgttgctctctttaccacgcctatataccgctacgcttgctctcccgaacaactctacccactcccgccctcggacaactggcgaccagcgacgccgtcctgcactatatctgccaccacaaccaatcgtccatcgcgccaccacccccactgccgcgcgcacacctacgttctcctcgcgcccaacgtactacaccctcacctcgtagtgcgcactctagcaaatattcagaccctcgggcctggctgctcgccatccctccagtcactcatcaacaccacacctcgcctagtgcc

SEQ ID NO: 640141 - DNA, 81 bp, Homo sapiens
cccgaggacacggctgtctattactgtgcaagagatcccaatagcagtggctggtggggctttgactactggggccaggga

SEQ ID NO: 640142 - DNA, 180 bp, Homo sapiens
ctacagtaaccaaaacagacacaaagaccaatgaaacagagaggacagcccagaaataaggccgcacacctacaaccatctgatatttaacaaagctgacaaaatacaagcaatggggaaaggactccctatttagtagatagtgttgcgggacgtgtctggccatatgcagattgaaac

SEQ ID NO: 640143 - DNA, 1547 bp, Homo sapiens
ctatcaagagtgttctgacaatgccatatgagcgtatcatacatcattcatgggagcccctcaaatggcacaagtttcggtgcgtgtatgaacaggcaccctgtatggcagatatgataacggcgatgctcattacactgttgtgtctggacccattgtcaggtacttgcatcaggatcgcatgtaacaattcagccagtacctcgacttagattgagacttcctctgaacagaatactgcgaatgtgagaattaaccatcactgagagacagtcctaatcgggtctgattcagagcttctatgatgattacttggagaggagaacatacgagatcaacgtggattgagacccataaggactgataaaaccattggagcgatggtcgtagtatcgtttgaacccaatgggcacagactggctcttctctcctttgcctataaaacagtgacacccaccatcgcgatgggacctacgagatatgattaggctcacaccccttgtactaggttgtcccaaagacatccccagtgatagccttccctagtagtcttgccctttgacgtacgcccgttgtaagccctttgcaagttccaacctccaaaggattatacaccccatacgtgaaacctttacactgggaaaactcatatccatttaattgcatccgttgttggcacctctggaaaatccgaatacgtggacgtggggtgcttacgccttcggaatggagctctgtctaaaagaggatatattggaggcagccacggaatgtcattaggcacggcattactccttagacattggactcagttctttattcagagaacatggttaccccgttgacttggacgtggggcacactacggctgcatggccgtccacactttcattggatgatcacgccggatacaatccatgaagaagtacccaatgtagattgttcgcagaagtagaagagagacttggtaccaccagactagcaaccctggcaacacgtcccaatcaatggagtgagactaggcaaatgcccggtatgtacccactcggccatccattgcatcctgcggtgtacagcacatgtcatttgccccttgtcagcaccccagggtaggcgcaccggtgaagaaagctgaagaagaaagctcaaaatccagccgtgtttgacacacagggctcgtgagcgcaccaggacatctcgcatagtgaaagaggagggaaactcaaatacaactgcaacccacaacgtgtacattcaccacaagaagaataacccagaaaccacgggtaaacaccagccacaccaggacgagcgacatagacagtgaaggcgagaagacaacagagaagaccaaaccaggggaatccagaacaggtagaacggggagaatgcacacccaaacaagcacgcgaaggagagaagcaccggagagagaaaactaaagcgagaggagcacactgcaagcagcacgacgcagaacgaacggatactatacgaacgagcaacgctcgaagcctttccatcccatctccatccaacaagaaagg

SEQ ID NO: 640144 - DNA, 487 bp, Homo sapiens
aagtaggagtgagctgtgatgcgggtatagagtgtaagatgcagaagagagccgtgactagagggtgggtggatcgagctggagtggacctggactgcatgcgggtccccatacatcgtggaggggatgcctactccatccatgcccccgtaatggggtggatcgtcgtacctttgcgccatcggcctctctggctcccttcctacttcaacttctaagtatatcctcgtttaaggccagtgtgaaaagaaacaaatattcaaactcccccggaaaaaaaaaaaaaaaaaaaaaaaaaaggccggaggaaaaatctccttaagggttcccacgaagcgcggggagccacggggcccccagaatctctggggactcagggggacccggaacgcaagggcgccggagttcagcggagcttaaaggggcccggtttccaagagaaaagcaggggggggcaaaaacaaagcaaaattttctcccccccaaa

SEQ ID NO: 640145 - DNA, 253 bp, Homo sapiens
gttccggccaaaaaccctgtggtgggtaaaaaagaaaaaaggcctctggtggggtttaaaaaccaaaaaaacccttgggggggaaaaaggcccccggttcccaaaaacccgccccttaaaaaaagccctccaaaaaaaaaccctcctccaagggaaaaaaacccggcggcataactttttaattttgtttttcccaaaagggccaaaccttttgggccggctttttttaaaaaaagcccggtttatccggcca

SEQ ID NO: 640146 - DNA, 570 bp, Homo sapiens
gaccagactgtacaagtcctcggtgttatgctacgctgatcaccactgaatacagaggactcatcatggagtgcgagctgagtctggttttccctcatcgttgctctttcccaaagtgtccatccgtcaggtgcagctggtggcggtctggggggatgcgcggtgtgtccagccttgggggggtccctgtggactctccgtgctggcagcggtcatggtaatgtcttccgcgtctctggtaccgctaatggatgtttgcgtgtggggatccgcctgggcctccctggggcatcggagggcgtgcgcatctgcggtgtcctcttctctatgcgcgtagtgatgggacagtaagtaaatttagctagtggagtacttcgcagttgaaggggtcggagtgttcagcagtgcgtgcgcatgatgaacatattcacgaagaggcatgcctgtgtgttctggcaaatgaggcagctgctgaagcagctgtggtggagcacggtgtgtggtattaactagatggtagagacaggtatacgtgggtgggagtccgttgaatagattgggttaaagaga

SEQ ID NO: 640147 - DNA, 1112 bp, Homo sapiens
  misc_feature (883)..(883): n is a, c, g, or t
  misc_feature (1007)..(1007): n is a, c, g, or t
caatttcatgcacaacaagttatcaattataaataccccctgccataacccaataccaaacgcccctcttacgtgctgatccgtcctaatcacagtcgagtcctactttctcctatctctcccagtcctagtcttgctggacatcacttatactactaatcagatccgcaaccgttaactaccagccttcttcgatcgcccgccggaggaggagaccccattctataccaacacctattctgattgtttcaggtcaccctgaagttcatattcttatcctaccaggcttcgcgaataatctcccatattgtaacttactactccggaacataaaagaaccatttggatacataggtatggtctgagctatgatatccattggcttcctaggggttgatcgtgtgagcacaccatatatttacagtaggcaatagacgtagagcacacgagcatatttcacctccgccaccagtaagtcagtcgctatccccaccggcgtcaaagtatttagctgactcgccatactccacggaagcaatatgaactgatctgctgcagtgctctgagccctaggattcatctttcttgttcaccgtagggtggcctggactggcattgtattagcaaactcatcgctagacatcgtactacacgaacacgtactacgttgtagctcacttccactatgtcctatcaatagggggttgtattttgccatcataggaggcttcattcactgatttcccctattctccaggtaaccctaaaacaaactaagccaaaatccatttcgaaatcctattcatcgggggtaaatctaactatgttcccacaaaaattttccgggcaatacacggaaagggcccccaggtgttaacccagngaaaccccgcagggagatacacacctggagaaatccgaccacacgtggaggggcccacaacatctctcctacacggggacatgatataaacccgcgcttggcagaagcccgcgcctcaagaganaagctatatagtaagagagcacacacacggaagggcagaaagagcgcccccacacagtagcagcacatagaaaaagaacggacaagcatcagcgtagcccacgtt

SEQ ID NO: 640148 - DNA, 205 bp, Homo sapiens
aaggttgttgaattttattggacccaggttaatcggttttccttaaatttagaggagtttttaagggacctttaaggaaaggaatgtatatctaactgtgtacccaactcacatctctaagagagtattctctctttgaggagattctactatacacttcgtcccccgcgtcatcttacacggtctcaggagtaggctcacggca

SEQ ID NO: 640149 - DNA, 201 bp, Homo sapiens
gagcggtctggtcagaactacccacacagtgtaattaacaatgaatctaatctactaatggcaacttgcctggcctgttacaataaaactcactgatggttttccacactattccagcagaatcggaatatttaaggcaatataaagaaacacaatgagatgcttggtaaaaagaacagaaatggaaacaaactggaaatg

SEQ ID NO: 640150 - DNA, 369 bp, Homo sapiens
  misc_feature (238)..(238): n is a, c, g, or t
  misc_feature (245)..(245): n is a, c, g, or t
  misc_feature (257)..(257): n is a, c, g, or t
  misc_feature (260)..(260): n is a, c, g, or t
  misc_feature (264)..(264): n is a, c, g, or t
  misc_feature (301)..(301): n is a, c, g, or t
  misc_feature (332)..(332): n is a, c, g, or t
  misc_feature (346)..(346): n is a, c, g, or t
  misc_feature (357)..(357): n is a, c, g, or t
atcaggatcaaaacaaacggggggtgggtggggaaggggctttgggaccagacccccccactactgggtttttgtttttatcagtctttgtaaaagcaggtggtggtggaaattccagcaggtgggtcccccaaaggccctgaggcctcacttttcggattttctgtcccagatcctgctccctccctgttgagcctggggttcccctggcattggccccagccttttgaaaaccggngctgcanccaaaggccgcncgntgcnctgtcgcgacccaaaaaggcttttgtgcaggctgggntcgggccccatgtttgtgctgtttagtttgngttcaaaatgtcanaataaacccanaataaatgttta

SEQ ID NO: 640151 - DNA, 843 bp, Homo sapiens
  misc_feature (1)..(1): n is a, c, g, or t
  misc_feature (122)..(122): n is a, c, g, or t
  misc_feature (178)..(178): n is a, c, g, or t
  misc_feature (292)..(292): n is a, c, g, or t
  misc_feature (312)..(312): n is a, c, g, or t
  misc_feature (318)..(318): n is a, c, g, or t
  misc_feature (328)..(328): n is a, c, g, or t
  misc_feature (335)..(336): n is a, c, g, or t
  misc_feature (345)..(345): n is a, c, g, or t
  misc_feature (348)..(348): n is a, c, g, or t
  misc_feature (351)..(351): n is a, c, g, or t
  misc_feature (357)..(357): n is a, c, g, or t
  misc_feature (482)..(482): n is a, c, g, or t
  misc_feature (488)..(488): n is a, c, g, or t
  misc_feature (497)..(497): n is a, c, g, or t
  misc_feature (515)..(515): n is a, c, g, or t
  misc_feature (517)..(517): n is a, c, g, or t
  misc_feature (520)..(520): n is a, c, g, or t
  misc_feature (523)..(523): n is a, c, g, or t
  misc_feature (526)..(527): n is a, c, g, or t
  misc_feature (532)..(532): n is a, c, g, or t
  misc_feature (535)..(535): n is a, c, g, or t
  misc_feature (538)..(538): n is a, c, g, or t
  misc_feature (557)..(557): n is a, c, g, or t
  misc_feature (565)..(565): n is a, c, g, or t
  misc_feature (570)..(570): n is a, c, g, or t
  misc_feature (573)..(573): n is a, c, g, or t
  misc_feature (577)..(577): n is a, c, g, or t
  misc_feature (579)..(579): n is a, c, g, or t
  misc_feature (582)..(582): n is a, c, g, or t
  misc_feature (592)..(592): n is a, c, g, or t
  misc_feature (611)..(612): n is a, c, g, or t
  misc_feature (624)..(624): n is a, c, g, or t
  misc_feature (632)..(632): n is a, c, g, or t
  misc_feature (637)..(637): n is a, c, g, or t
  misc_feature (641)..(641): n is a, c, g, or t
  misc_feature (646)..(646): n is a, c, g, or t
  misc_feature (650)..(650): n is a, c, g, or t
  misc_feature (660)..(660): n is a, c, g, or t
  misc_feature (665)..(666): n is a, c, g, or t
  misc_feature (671)..(671): n is a, c, g, or t
  misc_feature (681)..(681): n is a, c, g, or t
  misc_feature (687)..(687): n is a, c, g, or t
  misc_feature (711)..(711): n is a, c, g, or t
  misc_feature (726)..(726): n is a, c, g, or t
  misc_feature (732)..(732): n is a, c, g, or t
  misc_feature (740)..(740): n is a, c, g, or t
  misc_feature (752)..(752): n is a, c, g, or t
  misc_feature (755)..(755): n is a, c, g, or t
  misc_feature (766)..(766): n is a, c, g, or t
  misc_feature (774)..(774): n is a, c, g, or t
  misc_feature (805)..(805): n is a, c, g, or t
naaaaaaaaaaaaaaaaaaaaaaaagaaaagagttaggtgtcacattgaataacatgttgatagcctgtgtatggttatgggttctaatttctctacaaaatcaaccagccatgatggagtnaagaaagtgagaaagagtaaatatggtcatataattttttgaaacacttccaagtncaaaaagcagcatgctaatttttaagtgcaaagaaagctcataataaaatagacttttaaaattacaaataaaatctgtacatcaaggatatttttaaggctttcccgtgtgcntgtcactatgtagacaatgnagaggnattgccaagngagggannatcatgtgnggngtnacaggnctggctcatttcggcttgtaggaccatctcttcttttctcaagggaaaagtgtcaatcaggttgaacagggccacaggcatcaccagggagacatagcgctctttgtccatgccatgcttatccnctagcnccatactgngggggttgggtggggttngnagnaanagnntgagntgnagngctagggctgggggcctcntctttgcncctantcntgcnantgngggtcgggancacacccaccagctccacnncggtggtgtgtngaagatcnaggcnacantgtgnttgntgcagcattnatagnnggagnaggtaaaggnggtttnaggcagtgggtgtgggcacaatgnggagtctcattttcncataanactgatcnagaagtgcagcngcngttcagacacncacattgncgttcatggctgcacaggtgggctcagtgcnagaccaagccaggttggattgacatactcgggcagggc

SEQ ID NO: 640152 - DNA, 489 bp, Homo sapiens
agttggccggctgatgaggactactggaacagccagaatgacatcctggaggcaggagcgggcagtcgcgggacaggatgtgcagacacaactacgagctggacgaggccgttaccttgcagcgcatagtcccagcctagggtgaatgtatccccctccaagaagggggcccttgccagccaccacaaagctgcttgtatgccacgtagacggatttctacccaggcagcattcaagtccgatggtccctgaatggccaggaggaaacagcttggggtccgtgtccacccaaaccttgatcccgtaatggaagactggaccttccagatcctggtgatgctggaaaatgaccccccagcaggggagatgtctacacctgccagagtggagcacaccagccttggaatagtcctgtcaccggggaagtggacggcccagtcttgatcctgcccggtacatgcaaggggtccggtaccccggtacaatgca

SEQ ID NO: 640153 - DNA, 589 bp, Homo sapiens
ggataacttgtcttctatcacaatcttgctgaagttattcctggtcattctactgagaatcttcgtatttgcctcacaatactcagcacatctctagcccagtccagcaacagccaacagcaattcatgtgagcctgtcatggcacagcagggcaataccaagcaaataaggcagcatgcaagttcatttcatcttcaatcagtcaacagcacacaacaacaataaggccaactgtcctttgctcaacgcttgttaacctgcttctaccgacttgtagcctatagcagccagcctggagggaagacgtgggaaacgtgagtctggacactctcgaactcgactccatcactacgtctctgccgacgacaaaccagctacttacgctagccacttaacgcagcaagacacaccctggtacacaaactatccaaccacaggctacttttcctacgactctggaatactaactgaatgcgcactgctcggacgaaactacactctcgtatccgctgagactgcagcacttacccgtccggcacaccctcgactcacccctcaaacccttaaccttcctagggcaccgcccac

SEQ ID NO: 640154 - DNA, 436 bp, Homo sapiens
cgctgtggtcgtctctagcacggatccccggctttcgccatgttccccagtagtggcttcctgccgtctacagggtttgccctctcccacttagttttggtctgttcatctctgttctgactgccctctctttcctctcttttggagaaccaatgatttatattctaggccttttcgatcacagtaatagtatcagctagcttgttttcagttcattccctgtgcttcaccacatatgtcaccatcctacgttctttatgatcacctgtttctttatgtactactaagtcatttgatgctcattacaacaatctttcttcttctattgaagagcacagaggaatccatattcttactattacaagagtttattctaacagttcatggaaagaattaaccgatatcactttgtgggttagactgatatttcataatg

SEQ ID NO: 640155 - DNA, 119 bp, Homo sapiens
  misc_feature (14)..(14): n is a, c, g, or t
ccttcgactggccntgaaattcggtgactacggctccatcgattacggccgtactacgtgtagcatacacatcggtgcgtggactgacgtctgccagaattctttgcttttaccctggg

SEQ ID NO: 640156 - DNA, 589 bp, Homo sapiens
cgaaggttcagcagggagccgtgggccgggcgcgccggttcccggcacgtgtctcgtgcacgtggcagcgcgcctggcctgggcttggaggcgccggcgccctggatccgccggccgtggtctgccgagtcggtgtcgtccttgaccatcgccgacgcgttccccaattttttggcatggcctggccgaggagctccagctccagagccccgccgcgccccgcgcttcccaggaggttcatcattgcttccatatcgccctggacttgcagcgccaattacagccaaagcctggcaagcttgacgcgcacctgtgcaagcacacgggggagagaccatttgtttgtgactatgaagggtgtggcaaggccttcatcagggactaccatctgagcctgcacattctgactcacacaggagaaaagccgttgtatgtgcagccaatggctgtgatcaacaattcagacacaaaaaaaaattccaaaccttggaagaaacatttgggaacggcaaaaacatgaaagatcaacaaaaacaatatatatgcagtttgaagactgtaagaagacctttaagaacatcaggagctg

SEQ ID NO: 640157 - DNA, 275 bp, Homo sapiens
caggctggagtgcagtggcatgatctctgctcactgcaacctccacctcctgggttcaagcaattctccggcctcagcctcctgagtagctgggattataggtgcgcatcactatgcccagctaatttttgtatttttagtagaaatgaggtttcaccatattggccaggccagaccagcctggacaatagagtgagaccctatatagggatctcactatatagagcaatacagcggggtcacccgacctcgggtgatccgctcgttggcctccc

SEQ ID NO: 640158 - DNA, 433 bp, Homo sapiens
aggaatttttttaaaggagaaaaatttttgggctttagatttaaagtaaattgaaatgttttaaagaaaaaagtattcccagatttaatccctattaataatataagagctgaaaggtaagtcatttcttcagtccttctcctcggggggaatcttttttgttttcccataaattcccctgacgagggccctttgagatagccctgctttggggccatctgatccccatcgggagcaaatctttgacccccttgcctgcagcttttacttaaccctgtagtttttggacgtttgggcagtattgaaaagccaggagaaaagaaaacagaaaccgggttataacctgacgctaaaactaaaaacaaggaaagggccctcttttttcagaattaaaactaaaattttaaataaaacagaaaacttgatgatgcca

SEQ ID NO: 640159 - DNA, 581 bp, Homo sapiens
gagttcaagacagcgtaggcaacatagcaagaccctgtctctacaggaaaatacaaaaattagccgggcctcgtggcacatgctggtagttccactactcaggaggctgggtgggaggatcacttgagcccagaaggttgaggctaaatgagtcatgattgagccactgcagtccggcctgggtgacagagcaaaaacctgtctcaaagaataaaaataaaagtgtcagcaacttcacagatacttccctgattagccagtaggcaaccttgagcaattctgttatccagtagacctttagcaagataatttaaagaagtctgtttgtaaccatagcctttgcagtagaatctggctatggagcatatcatgaggaacaaatttcttttttttttgctttttctttctttttttttttttgggaggacggggtctcactctggtggcgcaggctgggagttgcaataggggggtgaaccggtccctggaacctctggcctctggggtccaagcagttctcccacctaagcctcgaaataggctgggactacgggcacaggccaccagccccgtaatttggg

SEQ ID NO: 640160 - DNA, 671 bp, Homo sapiens
  misc_feature (189)..(189): n is a, c, g, or t
  misc_feature (459)..(459): n is a, c, g, or t
tccataaaggttttaactgggaaaaaaaagttttacaaaattatcttcccaaaaaaatttccccatagaagtccaattaatccaggtagctttctcttcctcttaaagagatattaccagttaggaactattccagagagggggcgagaggttctctgtgatatgagcccaatctagagccgcgccaanacactctacagagagagaagagtagatattcttttctaagaggtgctctttaaataggtgagaaacagccacatgtatatggtgatatgtggtgtgagatatctctctattgtgagatatatctttacaaatattttctctttaaacataggggtccctatatatgggtgttatggcccaatatatcacaacagtctgggcaccaaaaatcggcgctggttatttaaggttgtggagacaccacaaaaacacatatggctattattgaancgcagtatactccttgtgggaaaatgtcatatttccaaaatatgcctggcccagcgtgctatccataaagagggcaaaatcttagagatataagagaggtggtggcacagtatatccagaagaatattcccacacaaaccaaagtcggtattattacagagttatccagaacgagttaccctgggatttttttccaatatccccggggtaag

SEQ ID NO: 640161 - DNA, 427 bp, Homo sapiens
gactcctagaggtatccccaagtatgggtcagatgaccaacacataagtttatttcggaagacgtctacactgacatgtactatcccatgcagagtcccagtcgcatacatcgctatcttagtctcgacacgctgagccaggccagtgttccctacacgccactggcacagccctgtgcaatcctacgtcccacacgagtggatgagcgacggcagtaagggcaccactaacacaggaggtggggacagtcactgtcacagggtacacgggctgatatgcgtgcgtcctaggagtgtagacctagacctagcttaggaacatggagctccgacccagccacgggtcggcactgtgggcaccacgggtgaacacctggaaacacagcctacttctagagggcagacactgggcagcgggggtggccac

SEQ ID NO: 640162 - DNA, 131 bp, Homo sapiens
gcttctctcctccgtcgtggtcttcttcaggtcggccagctcctccttcaggctctcaatctgcatctcctggacagagctgacctggagatgcagattgagagcctgaaggaggagatcctctagcgtcg

SEQ ID NO: 640163 - DNA, 987 bp, Homo sapiens
aaaaacagctcacagtctgaggaagatgatattgaagagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgtggattttaaaaattatctgaaccttaatcagctgaaggtaccttatattcaaaagaatggacttaccatcgatactacacatcggtactttaggggttgggtccaaacataaatattgggggcctatttattcacaccattgcgaaagcactattactaaaggtcccaggggctccaaggaagacctttctaacctcgcatgggtaccacaaaccacaaaaagtaacacgcggtcccgcccaaaccctgctcgctcaaggacactcgccaatacagcacgcgaagtcgaaagaccacactcccccacacaggcaaccgaaggtgcaccaccacgcgcgacaagccaaaaacagc

SEQ ID NO: 640164 - DNA, 178 bp, Homo sapiens
ttttcagcccctccaggcttggaggacccggcggccacactcttggagcctcggtgaagtggctgggatgacgcgtttcttgacgtcccccatagatttggtatggagcaacccagcgccacccggagtacaggtggcgcgtgtggaagcagtcggtggtcgagggccggaatttagt

SEQ ID NO: 640165 - DNA, 333 bp, Homo sapiens
  misc_feature (26)..(26): n is a, c, g, or t
  misc_feature (83)..(83): n is a, c, g, or t
  misc_feature (103)..(103): n is a, c, g, or t
  misc_feature (197)..(197): n is a, c, g, or t
  misc_feature (295)..(295): n is a, c, g, or t
cagatagcctttttctgtgggttccnttgtattgctctcgaacaggataaagatattgtctaactttaggctttgctaagttnaatatgaaagttaaattttntggccaggcgccattggctcatgcctgtaatcccagtactttaggaggctgaggtgggcggatcgcttgaggtcaggagtttttaagaccagcnctgccaacatggccaaaccctgtctctactaaaaatacacacacaaaaattagtcaggcatggtggtgtgcacctgtagtcccagctactcgggaggntgaagcacgcaatcatttgaacccaggaggtagaggtt

SEQ ID NO: 640166 - DNA, 169 bp, Homo sapiens
aacagccatgattaaactgctaggacagccaggcagcaaaattccacgatgggatggtggactgggaagatggcgtcccatctcagggtgaggggctatcggaagcctcctcatgctgtacatggcatgtgtatctctgctcttctccagaatgcaccaccagaggcaa

SEQ ID NO: 640167 - DNA, 943 bp, Homo sapiens
tgggcccatgcccctgtctgctgatgccctgcgcgcccagtgactgcctcctccctgctgctggcccggccggtggccctgactgctgctgctgctgctgctgctggtgccatggctggcgtgtgtggctgcttgtggtgcgccctggtgcaccatgtgcatggctgtgctgtgctgtgctgtgctgtgcgtgacggtgccccccgtggcagacgtgcgaggacggacaggaacctgcacagcaagcacctgtacacggacggacatgttcaccgcactgggatccatggagctgccgcgcaacttcgtcatgttcttcgacgccctggtgtggacactgccagcggctgcagccgacttggaatgacctgggagacaaatacaacagcatggcagattgccaaagtctatgtggctaaagtggacttgcacggccacctccgacgtgtgctccgaccagggggtgcgaggataccccgacttaacgctttatcaagccaggccacgaagctgtgacagtaccagggtcctcggggacttccagacaactgcgaaacgcttggatgcttgcagacacttgaacgaggagccagtgacaccagcaggccggaagtggaagcgggccagatgccccccgaagctcaagcaagggctgtatgagctctcaggcaagcaactttgagctgcacggttgccacaagggcgacgcaagttttatcaaggttcttcgctccgtggtgtggctccttgcaacagccctggactccagacctgggagcagctggctcatgggcgcttgaacatttccgaagatgtcaagattggcaagggttgattgtacacagggaatatgaactctgcccgggaaaccaggtacgtgggtatcccatctttctcatggtaacggagaatggaacaaaggtggatcacgttacaagggaag

SEQ ID NO: 640168 - DNA, 290 bp, Homo sapiens
tggagagggacaggaggaagaaagaaaggaaggaagaaagaaagggagggagggaggaaagaaaaaaagaggaaagaaggaaggaaagaaaggagaaagagaaaggaggaaaattaaaaagaaaaaggaagaaaggaaggaaggaagaagaaagacaggaaggaaggaaaaaggaggaaagaaacaaaagggcaagcaaacaagaaaggtcaaaagacagtaacggcccaatcaaagcttccatgacgaatctgtgcctttttggatcatggtgtactcaggaaatgcag

SEQ ID NO: 640169 - DNA, 745 bp, Homo sapiens
gcaccgtcaggacgcggactcgggaagtgcgcacattcgcagcccgggcagcctgctgcgcaccgggcctcgcgccccggccccggccccgagcccctagccaccgaccggcctccaggatcatgtggtatgtaagacaccagaggctttagtcactacgagcgtcaacatttagagagggaagccactcattctctggacataatgacatccgtgacagggtagcgctctttatatgcccttgcatgagactatcccacagattggaccaagaggtgacccttgatgccacgtgtaaagcaaacaccatctccatatacctgagcctggataggaaggaagctgtggtgcaccatcttcacttggcattctgacacatcacttcccaagaagactgaattaaaatgatctgaatcgacaccgatgccgtacagacagaataaccgatacacagagaaagtgggatccaatcgtgatccagggattgaagagaatgggagctgacacgtgtatgggcaagaatcgattggcagataggacaatcaaaccatatatcgcagactttctataaggggacccgttgatcacacattgtcaccttagcaaataaacaactaagttctcctttcacaatgaacctttcaccaagggaagaaacagaaggggacacaacgcaacgtaccagcgagtgagagtcatagacggaaagacaatcatgggagaaccaacatgcaaccagtgaagg

SEQ ID NO: 640170 - DNA, 536 bp, Homo sapiens
  misc_feature (378)..(378): n is a, c, g, or t
  misc_feature (398)..(398): n is a, c, g, or t
  misc_feature (433)..(433): n is a, c, g, or t
  misc_feature (471)..(471): n is a, c, g, or t
  misc_feature (535)..(535): n is a, c, g, or t
ttaaatgcagagaaaaagaaaacagcatccaagactcttggaaaactaacacatatatatcaagcaaaacaggaattaattgcatagactgaactaataaaagactgaaataatcttttatgactttttgcttaaaatgttgttgatctttctgttttgtttttcagagtcaagtaacccccccttcttgagctatttacagcttttaacaattgagtaaagtacgctccggtaaggattataaaacaaagttttgtccaaaaactttggaatatgtttttttctctttacctgatttctgcagaatttggaaactatttgtgagtgttcttaacttacagcaatatagttatttgcataagtgcagtaagaatctgnttttccttctttcttctttntttttttttgtacaggcacaattggagaaactggntatttaacaagggtttgactggaggggcatgctttctntaacagacttctttaaggaattaaagtgcttagagccatagctcttggctggcttgaccttggnt

SEQ ID NO: 640171 - DNA, 334 bp, Homo sapiens
  misc_feature (93)..(93): n is a, c, g, or t
  misc_feature (100)..(100): n is a, c, g, or t
  misc_feature (115)..(116): n is a, c, g, or t
  misc_feature (140)..(140): n is a, c, g, or t
  misc_feature (149)..(149): n is a, c, g, or t
  misc_feature (156)..(156): n is a, c, g, or t
  misc_feature (165)..(166): n is a, c, g, or t
  misc_feature (185)..(185): n is a, c, g, or t
  misc_feature (198)..(198): n is a, c, g, or t
gaatcacaagctccgggtggataaggcagctgctgcagcagcgggcactacaagccaaatcagcatgagcaaggcggcggttgcaggcaagangcctgtngtaggtaagacaggnngacggctgctgttggtgttaagangcagaagangcctctngtgggaaannaggcagcagctaccaaganaccagcccctganaagaagcctgcagagaagaaacctactacagaggagaagaagcctgctgcataaactcttaaatttgattattccataaaggtcaaatcattttggacagcttcttttgaataaagacctgattatacaggcagtg

SEQ ID NO: 640172 - DNA, 228 bp, Homo sapiens
tatgatccccggtcgttcggattgggttatggcaggtggttttatattcgataagttgttgtgatgaaattagactggctccctaagatagcacgagacacctgctatgatgctataggagaaaatgtgttaggtctaccgaggctccaggttgggagtagttccctgctaacggagggtatactgttcaacctgttcctgctccggcctcaccgtgcttatctcaat

SEQ ID NO: 640173 - DNA, 161 bp, Homo sapiens
ccttcagtccagattttgtgtaatactttagtgtctacacagacaaatctttaaaaaaataaatagtataaattactaaatatttaggagataacagtgcattaagggtctttttatataatacatacatatcacccctttgcagtgaaggcgtaacgtgt

SEQ ID NO: 640174 - DNA, 825 bp, Homo sapiens
  misc_feature (1)..(1): n is a, c, g, or t
ncatttctcgcctgttggacccccccccctgcgggtcctcatggttctcggtctgtaattctatcccctctttagaaccgcctccttacttcccggccccgccctcggtttggtctggtccaagcagggcgggtgctagttctctttcctccacctcacatgggggtcagccccccttccattcccgtgcacatgtctattccatgcgatgacgttcagttctacttccgtgcgtttcatggcactccccccaaggcgaggtcaattccaacacgatagtatctatctgtggcgcctccctgcgtgcgcaaaacttttcgttattatacaacacaatactcatggtgttcaacaccccgctttgtgtttccaagaagaattattctcctcaaggcacttatttgtcaacaattctcttcgctacaccaccctccaatacatttctgagccttcttcccctttcttacacatacagcatcacagacataagataaaagctttttcccctcccaccttctagttatttgcagacataaaaatcgtcttgtccccccgcagtctttccttgcccccacaagaattcttctgggtcccgcaatatcccctttgtcctttctatgagaaagcgcgatatgcccccacccatatccatgtgtttcttaaattaatcatgatggtcgaactgttaaattatagaagcagaccacatctgttaattgtccgtgccctacataacacatgcgaacaatggtgcgagcatcacccccaaataacacccacgcctctcatataactgacccgcttagtttctgcccacatagacgc

SEQ ID NO: 640175 - DNA, 143 bp, Homo sapiens
tgagggctgcccggtgctgttggcacggacgcaggttcgtgcgggcaggagcgatgcgtcagcctgcaaactggcagagttgtaggttcatagtaacgcgtcttcctgccttctacgacatttcagtgtgccaccagctgcgg

SEQ ID NO: 640176 - DNA, 434 bp, Homo sapiens
ctagctattactttgtacctctagctattacggagttcctcatgttcaattttaagacaaagcaattttaatactaggcgcacaccacatgccctcgctgcagactgcttttcttgacacgttatgaagtatgtcaaggaggtatgattctgtctgaattaccgactggcactcatacatactactcaccgttgtttgacacgttgcagactgttgtatccaatgcagtgactgctgctatgaaatcagatagcatcaacgacagcattattaggttctgaactatgagctaggagcaacttaggttcccaattttaaccccttgtcagcaagatccaagctgcctcatttgcacattagcacctaagtgtcaagggggtaaataaccagcacataagatactgcacttctgattgtagcatttggcagaactg

SEQ ID NO: 640177 - DNA, 1021 bp, Homo sapiens
ggagctacaccaagctggggaaccccacgcgctctgaggacctactgggattatgggcctttcagagatgtgcctgcctatagatcaggatacttttaaagctacattatgaataacaacagcccctttcctgagcccatcaccagcatgacccgagatcatatgaacgatctctcactggcggagtaatattgctgtggaagaaaatgtggactgtaccagcacacagcgagctgtgcttagacggggcctttctcacagctatgattaccagagaacgagccagatagatggaatatcctccatccgtgtcttttaagacctatcggcttcctgctgctgcccaggatgtttcattaccgggatgagattaggcaaatgttgctaccagccacgcgtccttattgggatgactctgtagagatggaaatccgggcctcgctgccctctctttggcgggtggaagacccattacatcgttggctacaacctcccaagctatgagtacctcttataatttgcggtgaacagtatgcactgaagatgacgttgtggcaccatgtgtgccgatgaacaggtgatagattctctgacgttgtgaagatcatcctgcctgagggagccaagaacattgaagattgatagttccctatgaaatcacgccgtgccccaatgagctgcctacacctatctggacacatttgggcgccctgtcattgttgcctacagaagatctggtcgaacagcgctccaggcctcgtggcgccctacccgtcaccaggtgccatgcggcagagcctgctggtggtgcgcctcaaactcccgtcctcccgtttcacaaggtcggcggactcatccccagatacccccaacagcaaaaggacgtacaaagaggtgtgccgtaccaagaatccccgagtcacacagtagacaacaccactgccccagggaacgcggtacggccatacacgaaagattacagcaagcaagcgagggcgaatacctcggacggtggaggggc

SEQ ID NO: 640178 - DNA, 144 bp, Homo sapiens
aaagatctttgcactctgtattttctcgtcacttaaaggtttgcatggtttctaataaaggattcaaagcataagtttgtagtgaaatggcccgggagcattccaagtggcttctctgcgcagggaggattggcatgcgagtgt

SEQ ID NO: 640179 - DNA, 171 bp, Homo sapiens
tatgatttgttacgccagaatcatataaagtggtgcacgcaggcagaactcgacagcaggcatacagatagaaaatcacaatatcaagaacaaattcctacctaagagcagaatggctgaaaggaaagtctctcttgatttcaagtttttgaccatcaaatctaatggact

SEQ ID NO: 640180 - DNA, 233 bp, Homo sapiens
gcgatacccaccccaggcggtatccagtccgaaaccggcgctgatactatcgccaacgatcaggacagtacccgccgctgcttctgggccatgcacatcaaggccaggcagcactcaaaaaccacacacgcatcggattctccatgggcgcaagcattctcaccgcgaagaacctcagcaaagtgttccagcgcgaggtgactgactatctgcacgactcagctgactgacca

SEQ ID NO: 640181 - DNA, 253 bp, Homo sapiens
agaaaaggcagggagcaggaggctcatggctgaaaatcccaaagcattgaatggctgaggagggaggatcacttcaggccaggagtttgagatcagcctgggcaacatagcaagactccatcttggaaaaaaaaaattaaaaattagccatgaggggtgatgcacacttgtagtcctagctattcaggaggcaagagaatctcttgagcgcaagagttcaaggctgcagtgagctatgatggcaccactgcac

SEQ ID NO: 640182 - DNA, 272 bp, Homo sapiens
atgattgttgccggctggtggtgctccgcgtttctccaagccccccatcctccccctttgctcctcggtgctacagtgcctgctgggttgaggggagaggcagggcaggactgtgggctttcagagcctcctggcagccaggcagggctgcccgtccccctgcatctggcgaggcatgcagctgtgtgcgcagtgatggagactaggaggaggatacattgcgcagacaccccagtgatacccgctaccccaagtgtctggagcgtgacaag

SEQ ID NO: 640183 - DNA, 209 bp, Homo sapiens
tactacccccggggtaggtgccataataagataaaattcatctccaaatgtctacagagatctagtaaagccgcctgcttctctgaagctctaagcagtctagttgagaagtaacatgataccctaccatgaaagctcagacattagattaaggctcggaaaggcttcattatacctatccaggtcgacccacttgtcctagattactt

SEQ ID NO: 640184 - DNA, 335 bp, Homo sapiens
  misc_feature (3)..(3): n is a, c, g, or t
  misc_feature (14)..(14): n is a, c, g, or t
  misc_feature (33)..(33): n is a, c, g, or t
  misc_feature (107)..(107): n is a, c, g, or t
  misc_feature (134)..(134): n is a, c, g, or t
  misc_feature (147)..(147): n is a, c, g, or t
  misc_feature (257)..(257): n is a, c, g, or t
  misc_feature (289)..(289): n is a, c, g, or t
agnaccccgaatgncatgcgaaagaggctgagntttgtgcagtcaatagaaaagcattaaataattttgtttggccctgggtatgatggctcatacctgtaatcccnggactttgggagatcgagagaggaggntcacttgagcccnggagttcaagaccagcctgggcaacaaagtgagaccctgtctctacacacacacacacacacacacacagaatcaaaaaattagccaggtgtggtggtgtgcatctatgntcccagctacatgggaggctgaagcaggaggntcgcctgagcccaggaggtcaaggttgtagtaagccatgactatgc

SEQ ID NO: 640185 - DNA, 370 bp, Homo sapiens
atctcacattcggatgtcatagtagtatatccaactgaatatcaacgtcttcaggctgtgagctattaagtcattacagctcagaatgcagtgagttacttcttgggggcatcctcatcatggaacaggagcagggataaatattcagcctcctgttcagtcagacaattctgggaagcattatattatccacacctccgtaatacctttctattgatttttcttctgtctctctaccatctttcccactcctgcatcctggagccaaacgccaaataaactactgcactcaagttttttattctactccttgcaaaatgttgggggggtacccgaggctcgaaattccgtaaattcatgggtcataagc

SEQ ID NO: 640186 - DNA, 230 bp, Homo sapiens
gtcgacgaattagataatgttctttctgtttatattttgtggactaatttgagtaattttggtgttaactcttctttgaaagtctgataacccccatatctggtaccaacttctgtcttagggttttactgatgagaacactatgaccaaggcatcttttataaggacaacatttaatttgggctggcttagatgttcagaagttcagtctactattatctaggtcgacg

SEQ ID NO: 640187 - DNA, 321 bp, Homo sapiens
agcgttctagaggatccctgatatgcagtctcagccatgggatgtccgatgtagcatgaatacagacagagagaatagaggaggaagtgctgggtagaaatctggacctttcccaagaaacggcttctatagagggggccctgtcttctctctagtcggtggcctctcaaggacagcgtcagatgtgttttgaactcatgtgttaacgagacaacgattgtcaaacaaggcatgtgtcaatatattctgtaggtttttggactacacacacgatacacacagcacactaccgaaaaatattttagtggtgtttctatagta

SEQ ID NO: 640188 - DNA, 562 bp, Homo sapiens
  misc_feature (382)..(382): n is a, c, g, or t
  misc_feature (394)..(394): n is a, c, g, or t
  misc_feature (410)..(410): n is a, c, g, or t
  misc_feature (452)..(452): n is a, c, g, or t
  misc_feature (475)..(475): n is a, c, g, or t
  misc_feature (484)..(484): n is a, c, g, or t
gtacgtgtatgtggtgtcggtatggagaattcattgaattggaccttcaagtcttccgttatcgactcagttattagcggcaccctcaagttttcttttgattgcattgtggaggatttcgaggatgaactcattgaattcttttctcgtgtatgttttacaattttatatgacaatctttgtctgtatgcgaacagattttttgttaccatgccctgcatatatcgtatgatgagttatgatccactggagctgcccacactggcttgtatttatttctctcaggaggggaaattggtggcaatgccttttatatattatgtttttttctgaaattatcttgaaaaaatatgaaaccaaataataaaaaaatatattttangggggggccggnacccttttcgcttcanattgtgtcgtattatatttctctggccgtctgtttacaacgntgttactgggtaattcctgtgtntactaattnaattcgcttgctgcacatctcccttttcgcagctgggctaatattgagtatgccgtactgatcgtctttctaacagtg

SEQ ID NO: 640189 - DNA, 358 bp, Homo sapiens
  misc_feature (245)..(245): n is a, c, g, or t
  misc_feature (259)..(259): n is a, c, g, or t
  misc_feature (283)..(283): n is a, c, g, or t
  misc_feature (323)..(323): n is a, c, g, or t
  misc_feature (352)..(352): n is a, c, g, or t
ggtcattgtagcctgagtaaacaatcaagcttcagtgggcaacctttttttcttttgccattttctgttttaggaatttccctggggaactaaaaaattttgcagaatttttcctaattttgtttatcccgttttgcccaaagcaaagcccctgtttaacccagctgttaacgaatgataaactgacattatactttaaaaaatgggggatttgggcattaaatttgcctgaaaaactttatccntttcccttttttanacaaaaaccatgtaatggggacanatttaactaaaaagatttatagtcataattattttattgnaaagattttaactaaagtttttccttttntctcca

SEQ ID NO: 640190 - DNA, 566 bp, Homo sapiens
  misc_feature (435)..(435): n is a, c, g, or t
aaaggggattattcaaagtaccgaaaaccttctcccgggatcaggcgtcggagagacccccaggccaggagcacctctggtggggcagaaggtgattgaattactcagatatgaagatcatcatctaggtttagtgtaaaaaggccctggatatttaaaggtggccatttgtggatttacagtgttctttggataattttggccgccgagaagtttattaaaattggcaagaatcgtcgtgtgaagtgaatggatagtagtgaacaattcagcaagctacttaaaaagagacccgaggcagcagtttctgcagtatttgcggttcaaacgggacttatataactgggttacagtattctcagctgcgtggtaattttgtgcctccccttccccaagcccgtggtaggggtatcttcagccgaaagtgagagacgntgattggtgtactgagtagtttcagcagtttcaaatgactgagtatgctgaagtttcatggcagtttatttttacctttatggaaagtttaggaattttgacttcagtctttcatgtcacaatgggacact

SEQ ID NO: 640191 - DNA, 1019 bp, Homo sapiens
gcttgacagtgtgatccctggggatctacgctgagttcggagatgctccagctcgggccgcccctgtctgagctgatctattgcggcggctgaagctatacagcgggaaggaaaagcctctgctccggacgtctgtattggctggataccgcagctgccgcgcgtcctgggattccctcaggggcccctcccggacgctgtcgtgtctcccatggacttgcccggggactccagcccgtctgtgccagccgcgtctgtgccgccagcctctgactcgagcatttatggggagccatggagcccgaaacggccgaggctctgcagctcccgggggtcccattcttcccgctggagcaaggcctctcggcgggtcctggccgtggtgctagaacgatgtcatggcgtgtacacattggtccccgtggtgccctcacatgcaggacctccataccacaggcaccagagataccatcaggatcctgtccacaggcaggcgactgcctcgccaccccggcaaggccgggtggtcctcgcaggccaggtgagcatggcaggatgggggtacagccgagggcccaggtgagccatttaaatcttcctgttaacatcgctagagcctcccggacctctgtgtaagtgtcagcgagcccttgaggccgaatccagcggaccctcttccaccctgaggcggggaacaaggacaacccttggccagaaggagggccctttcacaaaaggtggaccaggagccacacaaatccaaccatgggtggtgatgcttggaagacatcggcaagtccatagaaccccatcgagtgtagaggccttcgattggagtagcgaaccccgccaagttcacgtccattgccaggtacacggaagttgaagcccatgagcgaatatataggcccagaacaactgcatacaacatgggagaccatatggaaccaccattcaggctaaatttgcgtcatgacttgacagaaccctctgtgacagggccctgctaaagagccgca

SEQ ID NO: 640192 - DNA, 148 bp, Homo sapiens
aagcatcacttcacatattttatggagtaagatgtgattttttccatacacatattgaagtgattaaatcagctaattaacatattaatcccctcaaatacataccacttctttgtggagagaatatttaaaatcctttttttttttt

SEQ ID NO: 640193 - DNA, 591 bp, Homo sapiens
gtctactgtctagtcatatcttgggcacttttttccaggatagggcactttgtctacatcaaaaagcggtttagacagatccttgtctccaagattttctgatgggtctgggaactgtctgcgcctcttcaaggcagaagctacttctcctattaccttgacattttttaagccaaacttctttctaaaagtatcaaaccatccttggctggcattatattctccagctttagatccttcaccttcctttgactttgtcatataatgacttggcttttcttaaatcatattagaatcagtaggtatacttttcttacagcaatcctgcacccacatacaagctgcatattcaatatgagataaaaaagtattttgcaaaaagcacaaggttttcgcaccagctggcacaggtgtagcgatggcttcacaaacttccttttaacaatggtcctggcttcatttaccttgaaatggcaggtaaccacagctgcagaacttaatctagtacacatcaagcaattcaacaatttcttgtaacgtcatcactttgctctgctttttgggagcactccaggttcacgggggccgtcg

SEQ ID NO: 640194 - DNA, 101 bp, Homo sapiens
atgtatggcttccccattaggctgcgtgtgtgcctaagggcgagccatacatagaatgcacctcatttccctgatcccaaggataaaccttatcagaagat

SEQ ID NO: 640195 - DNA, 96 bp, Homo sapiens
cacagagatcatgcagtatgcggtgtggtgttgtcttaggagtcagaacttagggggccgggcccctccccacaataaagatgctctccgaccttc

SEQ ID NO: 640196 - DNA, 175 bp, Homo sapiens
tcacacacgtacgtgtgtcacgtctacgtctcacaggctgctgacgcaagagtcaagtcaaggctcacaaaggctccgtctccatgagagaacaagtctcagcgcagggagaccgagagcacacatgtcacacgccccatctagagagagacacaacacatatcatcatcatctt

SEQ ID NO: 640197 - DNA, 679 bp, Homo sapiens
tactttgtccgtggtccgttcaattttctaaacattttaaaaataacaaactaaaaaggagtcctagatggaactagtggcaatgattacatacagctgtttggttttgcaaaccccacaactggatattaagtcaggatagcctccgtgctaaattctaaccctcaaggctgaacgtgttctgccctattcacttacagattcagagcattaggcaaggacaacctttcttagcccctcacttctgaatctctccttctaagctaagaggctcagagcagaacgaggaaattgttgtgctattcggtgccagaaggagatggtaagaacagccctagtaatcttcatttactcctgaggctctgtgcccaacaaactgattctaaaagcccttcctgtatatatgcgaataagctcctaagtacagactatttgggctgtgcattgtggagtttcatggccaactacacgggtaggctgacatggtctctaggcccggaagcaagagttcccaaatgcgcgtgtcttcaatgaaatacggtaagtcccttgaagcatggatgtaccacctgagtaatgcatccccttgagagagtcaattctacccttggcccaaattacactctgggatactgggtccccctttttggtgaagcccagcccatgtcacactgttacg

SEQ ID NO: 640198 - DNA, 107 bp, Homo sapiens
tactagaggatccgctttattatctcactgaatgtcctctcaacgctcatacttttcctctctccatccctcgtcaggtgtgttgaacctagacccaaggagatatg

SEQ ID NO: 640199 - DNA, 381 bp, Homo sapiens
tgctattcgtcccaagagtaccaagtaacattcttcacaaaactagaaaacactatttcagaatttaaatggcaccaacaaagatgctgaatagccaaggcaatgccgggcaaaaagaaccaagctggagacatcatgttacgtgactcccaactacactacagggcaacagtaagcaatacagtagagtactggtacgaaaacagacacatagaccaatggaacagaattatagagcccagagataatactgcacacctacaaccatctgatcttcaacaaagctgacaaaaacaagcaatgggaaaaggacttcctccttaataaatgatgctgggataactggctagccatgtgcagaagattgaaccggatagcttg

SEQ ID NO: 640200 - DNA, 941 bp, Homo sapiens
ggccgggcgcggtggctcacgcctgtaatcccagctctcagggaggctaagaggcgggaggatagcttgagcccaggagttcgagacctgcctgggtcaatatagcgagaccccgttctccaggaataacaggagcaaaaaaagagaaaaccaaaaggacaaaaaaaaaattaagggttagttttcccttaagttggaaccttcaacctctccggggttccaagggaattttctcggtgcttaggcccccaaggagggggaacacgggttccgttgccaccattgccgggccagttttggcttttaggtaaaagaaacggggggttttccccccatgtgttggggccgaggcgcgggtttcttgaaattcgtgaacctgagattgatatcccaccaaccttggggccttcccaaaaggggccgaggaaccaagtgcgtgttgagcccaacgtggtttcgggacctggccttaacagttttttgtgaggacaaaacttatgcagtttcaaaaccgggcttccaaacagcgttgagtcggcgcgagagcacggggcctcacacacctgtgaaatcccagagccgggggggagggcgtgaggccatatttgcgggtcctaaaatcggtaacactaccaacgatccgcagaaacatattgggggccgactgggaggccgggagcagaaacatgccgaaacctgtgtgaggcgagtctttagtgacccgaaacgtgtgcccggtcactccgagcgggcgacacgagggatacttctttccaaaaaaacacgggtctgttcccactgttattcccgcgagggcggaagagaccgagtgggagccaaccccactgcgttcggggagacacctccacgcggggtcgggtgacccaactcgggggggcagacagaggaggaggcgggccgcgcacactcgagacagactg

SEQ ID NO: 640201 - DNA, 325 bp, Homo sapiens
  misc_feature (277)..(277): n is a, c, g, or t
tcctaagcctcaagcttttagtaatagtgtctgatcctcaaaaaataattaggaatattagaagacaatatgatatgatagaaaaaaaaacaaaagaaacaacaggaaatagaaacagacccctagtgatccagaaaatagagttatcaagcagactttgtttttaataagttaaaaaataaaagataagatggagaatttcagtatagagccagaaactttaaaaaataatcaagtggaaattttagaaatacaaaatatgataatcaagtgcaangggtaggcttaatagtagatcaggacagtgaaggagaagggtcgggta

SEQ ID NO: 640202 - DNA, 295 bp, Homo sapiens
gtcctttacagacacttacaataacggcaacgatcaatttgctctttccaaagatggtcgagtaaggtgttaatctacgttctctgttctctgtttgttggtattggtcttggtgtggtgttttggagacagagtcttgctctgtcacccaggctggagtgcagtggcgtgatctcagttcattgcagcctctgtctcacgggttccagtgattcttctgcctcagcctccggggtagcggggactacgggtgcatgccaccatgagctcgctaattttggtatgttaagtagag

SEQ ID NO: 640203 - DNA, 728 bp, Homo sapiens
gcggctgtttcctgggacgccctcccggacacccccgctgcagtggttacggttctgggcccccggcagaaggctcctccgggtgacccccgtgcggggccctgcgagccgcgtggagcctgacccctgtgtggcctctgatgcctgggagtgaatgtgggtgcttcctgtgatgtgctggatgtgtgcctgtgtggtgcctgatggtgatgcctgtgtgcctctctgtgactgctgtgtggcatgtgtgcagctgccctggtgcttgtgagactggtgactctttgggacccctcgtgcttggcggggggtctcgagctgaaccttgccccctgctgtggcaatgcctgctgtggcctgctgtgaatgtttgggccctaacctgtggtggacccctttccccccaagatgtggtgaccctgtgcccctgtgtggctgggtgtgacgaattgaaacggtggcttccatggcatctgtgatgtgggattgtgaccattgccctggccgacattggttgtccccccctctgtccccgcgcccccaatgctttgccctgtactgcccccggggtgcataacgtggccagggagggcttggttggcccttcaactctgaggggaccgtgcagatgctctgcttgcagtcccgtgggccccagctgggtgcaaacgtgcctttccttttcaaggcaaacgaagatggttcccatggaaaagaatggcattctc

SEQ ID NO: 640204 - DNA, 172 bp, Homo sapiens
  misc_feature (59)..(59): n is a, c, g, or t
  misc_feature (87)..(87): n is a, c, g, or t
  misc_feature (96)..(96): n is a, c, g, or t
  misc_feature (133)..(133): n is a, c, g, or t
  misc_feature (152)..(152): n is a, c, g, or t
cagcagcggaagaccccagtccagatccaggactgagatcccagaaccatgaacctggncatcagcatcgctctcctgctaacagtnttgcaggtntcccgagggcagaaggtgaccagcctaacggcctgcntagtggaccagagccttcntttggactgccgccatgaga

SEQ ID NO: 640205 - DNA, 200 bp, Homo sapiens
ccggttcgcgcaaggcgaccacaaaagaaaatagcctctggaagacgctctccatggcttacccaggctaacgcttgactcctggacttaaaactatccaccagcctcagcctcccaaggggctgggattacaggcgtgagctaccactagtggcctcttctaagaggaaatttggatatgcacagagacaccagagatg

SEQ ID NO: 640206 - DNA, 100 bp, Homo sapiens
ttcaggactgctgagatcagagcgatgctgctgaagacagtgctcttgcatgggacatgtggcccagagtgctgaatgctggacaaatgggcatcctgca

SEQ ID NO: 640207 - DNA, 302 bp, Homo sapiens
  misc_feature (34)..(34): n is a, c, g, or t
gtccgacagtggagtgcagtggcgcgacatcgancaccacaacctctgcctccggttcaagcgattctcttgcctcaggctcacgaggagtagctgggattacaggcgcccgccaccacacctggctgatttttttgtttttagtagcgacgaggtttcaccatgttggccaggctggtctccaactcctgacctcaggtgatccacccgcctccacctcccaaagtgctgggattataggcgtgagccaccgcgcctggcccccatcactttcttagcacataccgaaccttggataagtg

SEQ ID NO: 640208 - DNA, 171 bp, Homo sapiens
ctggacattccctggggccctatgtccttcctttctccccagcttgtccacactagcatcttcctcacctcctggtttacagcagggaaacacttatcgggcatctgctccacagaaaacaccaggccaaccacagctggtgataaaatagcacaaccacacccggccctc

SEQ ID NO: 640209 - DNA, 312 bp, Homo sapiens
gggcaaattttgtttcaatcttttttccccccatgattttcctatgggcttcctctggcattccctgtggttttggtaaaaaattgccctttaaaggatttaacaaatgaatgctccaaagtgtatgttcaaaaaaatttaatggggcccctcttccccagtttggaataattttataattgtaaaaataaaaattatatttataagtaaatatgtaaaattgtaaatatgtaaaaaaaaaaatggggtttgctgggcatggccttttatatgttaattttttagtttaaaattaagtatattccctgttta

SEQ ID NO: 640210 - DNA, 149 bp, Homo sapiens
cgttctgagtactgcaaccgtctgcgtgcagcccgactatcaatacgtcagaatagtatgataccgacaccacactttacctgcctatattttctgcatgattcagtcagtagttgaacgatcgttactctatgccccccctataaaca

SEQ ID NO: 640211 - DNA, 328 bp, Homo sapiens
ggattcttcatagacaaagtgaactcatgcttaccaatcaaatctcaaagcacagaattattgacttgaatcatggtttttacagtcttattaaatgctcaagatttggatattatagattttattttaaaatattaacacatgcgacagcatcagttttgagctcattttcaacaatcaaacatttcaataacattcacacacaaacatccatggcaggtgctcctaacatcacacttttcagatttccgtctctactgtgtgcattaccgaatcatctcaagtgtaacacattcaactcaaattggtatttgaattccctggcaaa

SEQ ID NO: 640212 - DNA, 921 bp, Homo sapiens
taacacttaaagggtttcttggaaaaccctcctttccttaaagcacatttttctcgtgaccattaaacgtcatgtgtacataattctttgtgtgtgcaactcatgtgaaccttttggcaccaatataatgtgggtggttgtgggtgtcagctctccagccatttgtgggtccatgtgttgtgtttagacaattgggtgccttttagaggaagccttttagtgtttataaaaactgtggtacagaatgtgtggtgtgatatttgtcttttattcctattataaagattattattattatattgtttgttatttgtgaaaacaccgaggtgtagtatatgtgtggtgtgtttagataagggagaaaacgcgtggtcaaatatataatctcacagatgtgtgatttaaaatttattttgtgttctcacacgtgtgtgtgtgaatatatataaattttatagtgggcatatgtgggggcaagagatttgcggggggtgttataaattatagttgtgtgtgtaacactctcccatatatttataagtgtggtcattctcattattatagactctttgtgacacagatggggggctcgtgtgtcacactcctgttggtgtgtacagacaccgagtatacacttatatacgcactttcgagacacaagaatttttccccggggggtgtaaatgaaaagagtgtgtctctcacaggttatacacatcagtgggtttccagcgagagacctctttatagacaacacaacacaacaacagaggggggagggcccgcgccacactatgaaaaattatactccccagcagagagggggggacccccaaaagtttatgacggtggtttaccccagaacgttttcctgtgtttacaccaaagggggggtccctccttatagagggggagcgcgga

SEQ ID NO: 640213 - DNA, 175 bp, Homo sapiens
aagtcgatctctagcacgatccccagagacgaagtaccagtagacacgcacaagcacacacacaaattcaaaaacttctacatgaaaaataaggataaacatcatccatctattttgtactgtgtaatgcaactttttatatacatcaatttttatatattatattatttttttt

SEQ ID NO: 640214 - DNA, 975 bp, Homo sapiens
ggccagtgactgccccctggactggccccaggagtaacgcagcttcctacagatggctgtctccttcaccgtaccgacacctggtcactcttcacagacatcatggctacagtctggtagtggggacaagcatcacttcaaggagtaagctatgtgaggtttcagagctgtcaacctagtccaggggcatcgctcccaaagcacgatgcgtcgtggctgcaggccagattcctcggtaggcaatggcacgacgagttgcccgtgtgtaggtaggaccttggtgcaaaaggtcgtgcgtgatcggtcggttgtgcgctgatagctacccttgaagagcattccaagttacgttgctcgtggatagaggtgagctcctaccctgggttgctctcgagactcagcactaggggtgtccgtgcagtcttactccgcgcgagagctacacctacggaagtatcctggcgcatgaaggcttccgagacaggccaagcagcaggtaaacatctttctagaaattggccgttcgaatgggacccacgtgggtcggctgctccttgggaggctcaagaaagggagtatgagcacaagacgaagccccagacagcgcgcgacggcagtacgcatagcggggcagatccgagcgagcttgggccgagagttgaccctagtgccaggagctagcaaggtgccgttcgaaggctagcatgcgacattgagcaacagccacgaacattgccaagcaaggagtcctgctccagggtcctgcgctccgttcggaaaagtgtatcccctgggacaagatttaccaacccggacaggcttcgtgaacattgtgtcagggcaccctggcgttgtgatccaagtgcctggtaccgggagagtatacacagtccggatccccggttcacctatagcccaatataagcaggtcaccatccaggtgctgctggacacggtcgtgtgagaaaacttacc

SEQ ID NO: 640215 - DNA, 198 bp, Homo sapiens
gaaaaaaggggggggccccccccccggggggggggggggggcccggcccccttttggggttcccccgggtttccccccccttttttgggggggggggggggggtttcccccgggggggggggggcccgggttttttttccccttttcccggggttttggggggggggggtttttttgtcccccccccgttttttttta

SEQ ID NO: 640216 - DNA, 160 bp, Homo sapiens
acacagggaagaatcttaattatccccttcccaagatgggatggggcataagggcacaggactgagactgccaagtgaggaagctgctctgcctccagtgtggacctggggtgtaggtggtttagtgttgcctcccctgctagaatctatccatgaccat

SEQ ID NO: 640217 - DNA, 167 bp, Homo sapiens
cctgcctctgccacagcaaggctggtcggggtcaagctggaaaggccagcagccttccagtggcttctcccttaaccattaagtatattggtccagagtgggaggctgagggagagggcggtccggcggtacgagggaggagtgcggagtccgcctagtgcaaaatc

SEQ ID NO: 640218 - DNA, 111 bp, Homo sapiens
actgtgcgtcacaccggatctacagaatatgtcgaactataaactgctgtgattgtgaatgacttgatctttgcttgtgtttacaatttcctataatgcacatcttccaat

SEQ ID NO: 640219 - DNA, 292 bp, Homo sapiens
gtcactctaaggatctcaaattgaggtcggttggaatccacgcgatcactcaccgtagatatagagtaaataaaacacatcgatccgtcccgcaggcaatccatcccgtaacctaacgtctctatcttactaacgcaagcaaatcgttcatcaatgaatgtattgccttgccttgtaagtaagcatgcgccaaggaaggtcgagccacttactctagcttgtaattaataactagctcgtcgctgtcttattaatccaaccgacagtcagcagccatccatcaagcatagta

SEQ ID NO: 640220 - DNA, 82 bp, Homo sapiens
tcggccggctcctattggactttctcagtgaaaagttcactatgttaatcttttgaattgaataaaaaaatgcattgaaacc

SEQ ID NO: 640221 - DNA, 1543 bp, Homo sapiens
  misc_feature (365)..(365): n is a, c, g, or t
  misc_feature (712)..(712): n is a, c, g, or t
  misc_feature (970)..(970): n is a, c, g, or t
taagggggaatgatggtggtcttgggatatactacagcgatggctattgaggagtatcctgaggcatgggggctcaggggttgaggctctctgggtgaggtgtttaaggtggggtttagcgattggaggtaggatgtgggtgctggtgggttgaacagagttatgagtgggggtgggtggtgtggtggttaaacttttacataggtgtcaggaacgctgatacggtggcattctgtggtagaagtgtgtggtgttgtgacaatatttctccgtgtgtagtgttctctccacctcttatgtgtggactgaaaggggctccttttaaaaaacaaaaaacacaacaaaaaaaacacactctcgagggnggccctctctcataatatgtgcgcgggtgtgcgcggcaaaacaagagacggtcatacatcgagaacatcgtgcgcgccaaatgtggggcgtcaaaaagcgcggtgtgttcctccgtgtagaacccccccaagcttctttctgttgtgtgtcccacacaggtggggtgtgcgaaacaactctcgcgcgcgggggggtctctcccctaatataatgtagcgagcagcgcgcgcgactatataataaattttcgcgagaatataaacgcccccaggtgtgtattaaccccgccggcggggccatattataaagagagacaaccacggggggggcgaacaacaaaacagtnctcacaacccaccacgacgcgggcacagcaccactctcacacacaccccccgcgccgcgccactccaacaatacacgaccacgcacgagcgagcgcaccatactatacaaaacgttgaggcagcaccaccacaccaaagcgggacacaacaccactcccccagcaggaggcgaacccacccccacacagtcgaccaccaccgggacgccagacccaacgaacaaccacagtagacggagctgagtgatgtagctacanccaccacccaccacacaaacagaaacacaaacacacccccgacccggataccaacacacaccaagcaacgagcgagtgtgcaaacagtgatagtatagcaagcgcgaccggcacacaaccaaccagacaagcacaacctcacacgccccacacagccactgctcataacacgcgaccgacatgacgcagggaatcaacagcctgcgggtacactcctgacgcacgccagcgaacgcacggcgccgacaacgaaactaacccaacacagatgctcgcgcggcagggccccacccaacacgagcgtgatcaccccccgactgaacatagaatgaggaggcccacaccacagacatactcagaaaaacaacgccagcggaagcacaacgacagccgcgacaaaacaaatcccccacatgacgaccacagcgaagcaacacccgcggcgtaaccacacccgaaagtggagcgaacgagacccaccagaggacaccagcacaagcaggaagtagtctaaccacgggcgagagcaagtagcacacacatagaaagaccagacagcaaccccgacagaat

SEQ ID NO: 640222 - DNA, 1195 bp, Homo sapiens
  misc_feature (478)..(478): n is a, c, g, or t
cattggcgggttggcaaggaacaaggcgtcctgtacgatagagtgcggtacatataggggagccgagatagtaagattggtagatccattttctaagagagattggtatgatggtgaagaggcgaccgtgcgtagtgttcgattatagagaacactattgggaaaggacgctcgtcggcaggagccaaggagccaaaattgcatcgtgatggtctcagagggttcgtgtgtttcgaatgtgagtcttgcctgattttgcatgaagtgatgaagttggcagttctaggaaatattcagagtcgtgagttacgtgtaagggatgtctcatgggggtacagaagagctgcgctgagataatcgttccatgggcagtggaagtctatacccggtgaacaaacatgatagttgcatatgtgtgtcacaaaaaactggcagacaaatgatgtgaatgctcgacgtgtggactggtcataggacntagccgaatggctgtaccttgccattcgatcgtgtgtctgtggttggttttactaatacaaatcgcagacaaatcagagtacggaagacctcttatgctcagtgaccaagcaggtccgccaaagtccggaagaagatgatggaaatcatgagccgagaggtgcagacaagatgacttgaaacgaagtggtccactagaattgattccagacagcattgtggaacagacatagaaagggcttgccaaagtctatttatcctctccagtgatgtcttcggtccgacaacgttgaaacattgttgaagcaaggcgcaagtttgaattggggaagagtcatggagttccatggtgaagcagaagtctggagaaggcatgggacgagacagtgctaagttgaggagtgatgtttaagcatagcgagaattgttaagggtcaggaattttgatctggtgcaattcaacaggtgcctctgggcgtaaatacgaaagaacctcggggaccaagacggggtcgaaaaaagggcacacaatggcacaggcgacgggtaccgcaccactctgacaaggggaaaggggggcccgatggggccataagcaacgggaccgaagcgccaacgaacagaggacaacgagaccaaacaaggggccacaggccagcgacacgtggagagactattcgcgctacacaagccagcacggcgcggatcaagagaaatg

SEQ ID NO: 640223 - DNA, 228 bp, Homo sapiens
ctgaacagaaaaggcttggaacagaaacttgatacggcgaggagatggaggggggaagagggtgcattctgatcattataaagaatacctgtcagggctctatcattttctccctttctctaatcatccagaatatggcgggtggcccagtgtacaacagtatcatgctaatattccatttgagcgagagtccaagatctttggccagatagcgcaattctttcacac

SEQ ID NO: 640224 - DNA, 169 bp, Homo sapiens
cttagaagaggcacgataggttgtcttctcagtatggtgttccacactctagaaagtcaatcagtcttccaggtgttgcaatacagatttccacagcctctctccaaatcacgtatttgtaggtccgcttaggagcaccaccagtagatacaacgtagacttcaagtcg

SEQ ID NO: 640225 - DNA, 1601 bp, Homo sapiens
gtctaggagaattgtcaaaaatatagaccaatgtatcaacgtgacgtgttcgagggctggcctgatgcttataagtgtgactacccggaaagttatagaggaaccctactaaaggactttcacatgtctgaattatcctgcaacataactctgctgatcgtcaccatcgtagccaccatgctggtgtaggctgtgactgtgacctccctctgcatctacttggatctgcccgtggtatctcaggatggtgtgccagatggacccagacccggcgcagggccaggaacatacccttagaagaactccaaagaaatctccagtttcagtgcatttatttcatatagtgggcacgataactttctgggtgaagaatgaattattgccaaacctagagaccagacggtatgcagatttgccttcatgacgagaaactttgtgtctggaaagagcatagtggaacatatcatcacctgcattgagaagagttacaagccatcttcgtttgtctcacaagctttgtacagagttgactggtgcctgactgaactctatttggccattcacaaatctcttcgcatgcaggatctataggtaacctggattgtgggaacccatcagaagctccaatccatcacgtttacaagcccacagcgtcttgccaggcgacttttggcatgaccaggaaaagcaaggtcgtgggccaaagcgggttaattatcgagacaccaacaacacccatggacaacccggataccctcggaccgcaacattgtcatcaacaacgctagagttaatttacactgcttcatatattacttattttgtgtggtttatccaaaaagcgcagcagaccaagccccacactacaaaccgctacctaccacctgcactaccctaaccacaactcctaccctacgaccagccacacaagcaccgcaaacctcccacaacacgctcaattcccccaaccactaccaaataccacaagcagtactcacacactccatcaacgaacccagcacggcagcgtaggcgggaggatagagtaacgagtgtagagcggagtggtagcgcgagacgagtagaagtacgcaggaggagctgaagaagcggggcggcgtatgcacgagaggagacagatcgatgccgctgctgagctcggtgagcggaggaggcagcaaggcacacgtggatacgagtcgatagagagccgctaagacaagaccagacgagacgcgaggagagcgcacagaggaagaagcagcgagcagaagcggcagtggcgcacagaagattccaaacggtggtgagctgacgcggtagccgaagacaggacggccaagggccgcacgagcgcagccgcgtcgcagggcgacacgtgcgtaccagcgctccagctctgacgcacacccagacaggacgagacaatgacacgtcgactaacgatgcgtagtcgcatagacatgccggaagcgcacagcgcgacacatcgagcgatgcgatgcatgaagatagagagccagcatgagacgacccagaacgagggccacgccgccgcccatcgcccgcacacaagcctaacgaacgagggaaagacacca

SEQ ID NO: 640226 - DNA, 404 bp, Homo sapiens
ggccccgtacccctaaaaatctcctacgcggaagggtttggtttaccggtgattgaagcgctgagcgtcggcacacctgtggccgtggccagcggtacctcgctggatgaaatcaccccgccgtcggcgccgcggttttccccgaccgatggcccggcgttggtgcaactgatgctgagcctgggcgagcgcagcgacgagtcttctgcagaacaacgcaagcaatgggccgaacgctacaacccaaacgcctatcgtcggcgcctggccgaactgatcgaggaactgaaatgagactctccctggcaagcctcgtcgccatcctcttcggcgtgctgtttggtgcagccgccctggcgctgtcaccggccaaggcctttctcgctgtgatggatttttagggg

SEQ ID NO: 640227 - DNA, 163 bp, Homo sapiens
tgggccgtcattgagagtgcccggtgtctgtgcaatatgtggtgtctgtggtgtgtgtagcgtgtgcacgtgtgtgtgtgcagtgtgtgtggtgtgtgggtgtgtgtgcacgcatacatagtgtgtgtgcagagtgtgtgatgtctgtgtgtaggtgtgtgtg

SEQ ID NO: 640228 - DNA, 1505 bp, Homo sapiens
  misc_feature (195)..(195): n is a, c, g, or t
  misc_feature (436)..(436): n is a, c, g, or t
  misc_feature (1505)..(1505): n is a, c, g, or t
ggcttcgagtcagaccgtcttgtctgtgaccagggcttgtaaccactcaagtgaccagtaaagcttatgcccgctccgatgagattccacaagtgattccagcgtccttccgtcagtctaatggatatgttgttctaaccgaactgacgacgaaagcactactttgaaacgagtactcatcgtagatgttaatcnacctttccgatcgtgtatctcgacgatcaaccatggtgcatgcacacagtacggcagcggcccattgcccggcacgacacatgatctagcttgtctgtacttccgcagagtctttgtgcacccttgtgtacgctacgcaaagtcttcattggcttgcacattattctgcgcaggggatcccatttgcgagcccccacaggacgtattgttcggcttgttgagcgaagagggccttgcgtcngtagttgcacccttagcattcgtgcagtcatttgacccccttaggacacatccggggacccgcattgggtacgaagtggccttgggagaggcaaaacgaatttccgaagcgccggtagttgcaagattgcctacctctttgtgaacgcgtctttccgagcccgtcgctggagagatggcgatgaggcccgaaagggttcccctctgtcgcaagggaccagccttgcggaaagcatattggggcacacccttccacattgcatgggctccgcccgcggaccggaagccctagggggggtacgaccactgcccattgacccgggagcgcaatctcttgtattgtatgtccatttgtctggcgcaaaagggctgggttcgtttacccccggtaatcgcccgacctcctatatgtcactcattgtccctttcccattgctttagccctggctgtggccagcccgggtttctttccacattgccttgctttaccgaccaggccccacggtgggatctccgatggcgatgggtcggggagccttggattgaccacaccattcccaattgcggattgccccttggcgtcctgtgaccgcacaaaatttgccccttacaaacgttgtcccccacgcggggcaaggcttcggacactggaaatgcacacaggccgtcgtttaggaggctcagcagaggaagtccaaacgacgttgccaaggatttggggtcggtgcgaaccacaggccttgcgccaaagcggcgctgaacgccacttagttgtaccaccgcaattggggcacgagccatttttttcctcccgcaacacggcgttgaccccctggagagccttctagggccacaccaccggacttttctcggacctattcgccggctagtgtttgacacccccacgtcgcattttggagttgggggcatccccgagggtaaggactggccgagggcttccattttacatcggggctcgtgcgcggtagacgcttgcgttccaggggagcagagggcctcatacatcgcgggggcggacacactgcgggtgcgctgtgcccaagcgcagn

SEQ ID NO: 640229 - DNA, 236 bp, Homo sapiens
gagtcggacctgggtcacaactctcccctcctgcatccatgatacaaggtggatttcttatctaaaatgcttgggaccagaagtgttttggacttcaaattttttcagattttggacctttgccttacttaccagttaagaatccctaatttgaaaatccaaaatgctccaataagcattttccttgagcattttttttggtggtcaaaaagcttcaaattctgtgcccatttcaa

SEQ ID NO: 640230 - DNA, 195 bp, Homo sapiens
cccgactagcccgacaggcaggagatctactcaaggagacagacatctccaatgccagtgaagggcgacagctgcatctgaatggctcacttgaaggcctgccttactttaattgtgagcatgctgcagcttgtctgggctagtctggggtgggtacctgagtctctgaattctgtacatcatgtgtctatagct

SEQ ID NO: 640231 - DNA, 190 bp, Homo sapiens
taggatataaagcagacccccacccccgccagcccacgcagtcagtgagcacagcaggacactaactagtagccttagctgtactagccggacctgtgacctactacagggaaatgaggctatatgccgcgggatcctactaaaagtacgacctagcagtgcatagcaaagctataggcacttgtgccgt

SEQ ID NO: 640232 - DNA, 107 bp, Homo sapiens
aggatcccagcgcaagtctcacacgcacacactacatgtctcactgccagctgggatgagcccagtagccaacaggcatgcagcaggacaaggtgagagttgcggtg

SEQ ID NO: 640233 - DNA, 868 bp, Homo sapiens
acgggtctgtcattctcttggctttcaacacgtaagtttcttggtacggaaacagtatccttgaggggacatcttcttcaccgaggtcctccgaacctgtcacacatcctggattttccctctcccggacttctgtgccaattccctccgtgtgaaccccaatcatttctcaggagaccagtcatcacttggctttccttgggtacctgcctagtccaccagttaattgatgagattaggctctcctatctttgccctaaacctatatcattgtagcctttcctcagtaattcgttcaccaactagagttccccacccgatcgattggaagtgccaatgccctggtgaataccacgttcgtagggtactcaatcatggtcatcccttgacaaggtacttctcttataaggccgtgacttcgtcattcttagggggtgactgtacctgcgtgtaacagaacccctggcggaattggacttgttggggcgttccctcgtgtaaacagaggagggttggtaggccccaaacgtttcttatacccggcgggacaaagttggtgacctgagggggatggatacacatagcagaagggtggcataaccgcaaggtcggatacattcccttgtatccgacgccgcagcctagttcaagcaggtggtgtcgcgttccaggagaacttccatcggatgccatagtgtggaaaatttccataggtaaacgccccttcgttaggtcaagccaatgtaggtgttgacggggttcacgaatagcatcccccaaataacgccctgggtgtaacagcacacttgtccacttgtggaccctcttgcgaagcacaacgacgacctgtggagccatggagttcaca

SEQ ID NO: 640234 - DNA, 363 bp, Homo sapiens
  misc_feature (97)..(97): n is a, c, g, or t
cgttgaaaagtgatcaggttcattttattgactacacagaagcaattccattttccactaacaaaacactccaggttgattaattgtgattcagggnctccacaggaacctgttccttatttttttggatgtcattgtttctgacatcacaccttcctagacaggtatttctggaaaaggatctggtaagaggatgaatttgggtctaaacaaatgcccatggccccggaagacctgtcggggccaccaagttagtttctgtggcaaaatttgatttcttccatctcaccactattgtaactgttggtgttatgttaccaggagccccacgagaggttgacccatcaaggtggtgcctgttta

SEQ ID NO: 640235 - DNA, 169 bp, Homo sapiens
gtatattccacagtggacaacctagaggaatgataactgataccactctagtgcctctatcgtgtgattaacctctctcttagatgcttgcatcacctatagtctaatggctttcaaatgtaattaccatttgctaatggtgatcttgccacatctggcaagtagacgt

SEQ ID NO: 640236 - DNA, 346 bp, Homo sapiens
  misc_feature (247)..(247): n is a, c, g, or t
gtgtgtggctagagcacatggagcaccatttgcaggatgcagggagaaagaagaacccatgagggaatctcaggacaaaggcaggtgactaaggtgcaggatgagagctgggagagagactggtagtgtgggagagtgaacagtctcactcaccttgagtggcagcaatgtcctcaagtagtcaggttttcagtaaggtaagaaactgaggatgttcgtactctgtgaggacagaggtgaccttgtntatcagggaaaagggttccagaaagccctgtggccttccttctgtgttcctctacctctttgaacttaccctttcggcgaaacatttgtcacactgtcc

SEQ ID NO: 640237 - DNA, 536 bp, Homo sapiens
gacctagaggatcccgagtgctcttcagaggaagcggaaaccagtggccacagcgtctttgtctagcccctagctgcagtacacataggatgcagtggagcctaagacacacccagcatcacaagcaacagtcctgtaaattgagccgtagtaaatgttgagacagcgattacaaggtaacaaatatagcagagtatgaccttcctgtcctaaattgctgccaccatattccactatttaaaacagagattcccactacatgatcttctgatcataaagaatccactgctgtgtttgaaagaggagttgtttctgctggtgaaaggactgggaatgtcgatcacgatatgctagactatcttacacaaagtccaacattcgtcttacagacagacccattcagctcctggaggctgaagtcctgctctctagctgtatccagggctctcttcttgtcggcatttgaaaaaatgtagcaatactttcgtctgtggcttcctctgctgcagaggtcctcaccaagcattcagaactgt

SEQ ID NO: 640238 - DNA, 483 bp, Homo sapiens
cggcctgacttggaaaaccttgcgactgtcttattagtcatatgagatgtgagatatatccatatgtactgacttgctccccttgatgataatgatgctgagcatctttttgtatgcttactggccatttgtgtatcttctttagagaagtgtctatgccgattctttgtccatttttcaagtgggctttctttggggtattgagttgtaagaattccttacatactgtagatccaaatcccttaccagacataatttgtaaaaattttctccaattgtcttttaagtttcttgatgctgtcttctaaagcacaagttttcaaatttgacaaagtccaatttacttctattttcttttataatgtgtgctttttgtgttacatgtatgaaaatattgactaattgaagttcacaaagatttatatctgtttccttctcaagagtattatcgttttggctctaacatttaggtctttgatccgt

SEQ ID NO: 640239 - DNA, 787 bp, Homo sapiens
  misc_feature (378)..(378): n is a, c, g, or t
tgacatacctttaaatgtctccttgatgaacagaatcatggtctttaaaaacattttcatgggtgatggcattttcaagctctaaaggatggaaagataaatcttcacgttaaaggtaagagtgaagtatctgctcttgggttacagaaccagatagtactagaactaagattacagggtaaagctgcttttatcttttttctttttctttttcttttttttttggacatggggtctcacggtatgggcccagggtgaatgcagtggcttgatctcagctcacggagcctcttgcctctggggctcaagcgattctcctgcttcagtttcccaagtattgtgggaccacaggcgcacaccaaaggcctggctaatgtnggtagggttggtagagaagggtttcaccatgtgtgccaaggctgtctcgaactcctgagctcaagtgattcacccaccttgtgctcacaaagtgtcaggcttacaaggcgtgagccattgggccgggctcacgaggtagggctcctgcggggggtgtggaactaacgggattgtggtaaaaaaggccacaggtgagggcatcaaaaaggaacactccaagtatgcctgtagaagggatactccgtgttaaaggtccaaattgccgccaaagatgttcgagtgggccttttgggtgccttgtgtccttatgtagatgtgtatgaccaggggaggtgctcttgggacttccttgggggggctgattggggttacccggctattcattttaaccttttctggagcacaatgg

SEQ ID NO: 640240 - DNA, 1434 bp, Homo sapiens
  misc_feature (354)..(354): n is a, c, g, or t
ggttgcccttgtgtggagacacatttatatattaagtgccgacttccctactgtctttcaaatctttatacatctattctttgtacacctgtctcctcacgatatacatatcaaccttattctgaatatcacaaggtcacattggtagtactcttaatggcttaccgattacaacataccatattgtagagtgagtgagtaatacttttctacattatagtctcagatggctaacggatactagtggccaggaattcatacactagaccactagtgtacctcacattaggtgtttcatactgcattattactatacactatttacttctttacctgttagcataatagagacantagacagcatcgtttcttgactcaccgatatctctatgaattctatatcaacattgtttttatgaacttcgcccaaagctagcctttacctagtattggcataaacgcaacgttggtctatcactgtagttaagttagatgggcaattgtggcttcgtataagacgattacaacatcagcgaggtagccatgaagcaaactttattctattttactcattaacgaccatcaaaggaattacacttggacagtaaattgcccagtatatttcctgatttagtcgcccagtacggatggttaagcctgtcatttcccttgacagtccccaagatacacacgggattggtcccgtcgggttactttgggagtcaaaccttatacaaatcttccagttgcttactgcttttagttacccttgcgagtccgaaagtccaaaagggtaacagtgacaatcttgtggtgcaccagttcgtaagacggccttagaatgttgaacttgccaaaattggctcgcgaagggcagctgactgcgtctacacttaccttcggttcacgcccttaaccggaattccgattcgccagcttgttgaccttcgttacaggttccggcggctgcgctgcgtttactttccatcattccgccgcatctaaactcttggtttccatcgcggccacctttccggcagtctgcaacctgtcctacgttcgccacctggggttttctagccagcttgccccctcacttcgggtagactcgctgcggcatacacttgtttagtttcgccgcctcagtttaattacacatcggttctcttcaggcggcccacccttctggggggcccccccgtctccgctactgtggcccccctgtgtgtcgctcttacggcccccggcagttcgttcagccactctccgctgtgcgctatcgaaggatctcggagaagacagagtcgctctctccgcgcagccccgtgcgcggcctctggcacaggccacgtcatcgcgcgcgcggcggctcgtacgccgtgttgctccaccgctctctcgagccgtgtctcgcttgcgcaatggccactcggc

SEQ ID NO: 640241 - DNA, 299 bp, Homo sapiens
ctcttaaatggcttattcttgttttcctggtacctgaaacactctaggttttaaatgagttacctatggaaggaagacgaatatgtgagaactgagggataagtaagtggccatattgtcagtatacctttgaattaatttatcgaggaaaggaaataaaatgttttaatttgtttttttcttttttcactgctaactccatgaaaggctttaaatcttcattttctcagcagcttggaatgagcactgatagggtgctgctcagtctgctgtgccttggggaaaagagacaatgaaaa

SEQ ID NO: 640242 - DNA, 762 bp, Homo sapiens
ttttattatttatttatttattattattatttctttgagatggagtttgctcttgtgcccaggctggagtgcaatggtgagatctcggctcactgcaattctcggcttcccaggttcagacgcaattctcgtgtctgcagactacgtcgggaggctgaggcaggagaatgcttgaacccaggaggtggaggttgcagtgagccaagatcgcgccactgcaatccagcctgggtgatcaagtgagactacatctcaaaaaaaaaaaattatttaattaaattagaaatatatttatcacatattttgacaagggataacaggagataaggctcggtaacacggtatttagaacaagtggtctggacaggtcctaaggtgctcagtaatggttatacatcaccatcgttggtccctggaagaaggggaccatcacatttattctggtagccccatttaatccccttggcttgggacggtactaatatatatgtgacaggctttacaaaatttccagggtcctctaatatttattctggtggaggagccaaacctgtgaatatatgggtttgttacaatccttaggtgaattgacatttctttcctccatacattcattccctgtggaggagggagagcaactaacctggtgaggagttggtccccaactgtgcccataaatggacgtcatatcctatagacctggggacattcctcgacttcagaaaacgagaatggaggacaacaaatttaggcgggcaaaat

SEQ ID NO: 640243 - DNA, 127 bp, Homo sapiens
gatctataggaccccagttgtctcaagagtaattaagatattattgtgtgtttctggtgttttgttctggtttgctattttcccctatagaaacatggaattgttgctaagtatttcatgtttaaaa

SEQ ID NO: 640244 - DNA, 103 bp, Homo sapiens
tctttgaagagaacgaggtctggcagctctgattgtgggtggcatcgtgggcatcctctttgccagtcttcctgatcctactgctcatgtaccgtatgaagaa

SEQ ID NO: 640245 - DNA, 475 bp, Homo sapiens
  misc_feature (108)..(108): n is a, c, g, or t
  misc_feature (111)..(111): n is a, c, g, or t
  misc_feature (448)..(448): n is a, c, g, or t
ttcagaaaccgaagctgaaagactggcgtcctcctgggggctttattctgggatcatgggcacttattatcatggttttcgtgaaagcgtggggggtataaacatatnaanttcattttttaaagtgtatgatgaatgaagaatgcatggaggactgcaaacttggataataatttatggggttatatatttttaaaaatggggttctcttgtatgaattggaaataactataaacgaaaccgggggggtggttcaactattaattttataacttaaagaaaaaataattgtaatgcaactggttaaggggactaaatatattccaggtttgtatttttggggttataaaagcgagtgagacaagatccagaatacatgtgggcttggtttgaaaattacggagttcccccttatccccctttgatttaggaaaagagaccatgtggnaaaaactttaaaggtctcactaacagg

SEQ ID NO: 640246 - DNA, 126 bp, Homo sapiens
  misc_feature (17)..(17): n is a, c, g, or t
  misc_feature (50)..(50): n is a, c, g, or t
  misc_feature (96)..(96): n is a, c, g, or t
gatcgggagaccccaantccccctgaacaatccttttcagtattatattnttattattattatgttattattacactgtctctttgccatcaaacngaggcctgtgaaatacaaggttcccttctg

SEQ ID NO: 640247 - DNA, 446 bp, Homo sapiens
  misc_feature (186)..(186): n is a, c, g, or t
  misc_feature (194)..(194): n is a, c, g, or t
  misc_feature (224)..(224): n is a, c, g, or t
  misc_feature (232)..(233): n is a, c, g, or t
  misc_feature (236)..(236): n is a, c, g, or t
  misc_feature (243)..(243): n is a, c, g, or t
  misc_feature (262)..(262): n is a, c, g, or t
  misc_feature (310)..(310): n is a, c, g, or t
gcacgaggttgaccgcagcgtctatcttgaatgcagattatacgaaaagttctttttgggaaactatggttactgactgtttgaatcaatacgaagaaaaatatcttttacttagagtggaacagatgtcctctcttttgatactattttttgcaagatcagatagagctatacataaagagtagnggtctacnaaaagactgggttggtggtatactggaaanaaggtgcnntanccattanattcgattatggggcaacntcattctgtttcgttaatacacatttatcagcaggtgcgagtaacatngacgaacgtcgcaatgactacaacaatatctacaggaacataacctttccaagatcaaagacaattccacaccatgattcgttgttttggttgggtgaccttaactacaggataactttgacaaatgatgaagtta

SEQ ID NO: 640248 - DNA, 897 bp, Homo sapiens
gaacacattatctggatgttggtaagatgcctgagaccaggccaagtctgttcccgtcccgatagaagggctccatagaaggcagtgaccaataggcgcaggtagacgaagagatggtcaagaagcgcaagcgcagccgcgaggagagttacgtctgtgtacgtgtccaagtgtgcttgaaagcaggtcctatcccgactactgtgcaatcatcttccaaggccatgggcatcatgaattctttcgttgaacgagatatttgagcgcatcgcgggcgaggcattcccgcctggcgcattacaacaagcgctcggacatcacctccaggcagatccagacggccgtgcagcctgctgctttcccggagagctggacaaagcacgccgtgtacggagggcaacccaaggccgtcaccaagtacaccagcatccacagtaaacatttccaagggggagacaacaagtttaagacatatctttttccaaacagtcgtcaactgctgggacaactgttatcatcttgcaaataagcaaatgaaaaatggagttgatccttagaagaagataaatggagcgtattattgaaccaatcacaggaaggacaaaatgaacaccttggttgagaaaaaattagtacttattctatgcattaaaacgtatttaccaaatacttcctttcccgtgaaaaacatttaatggagcacaagggaaaaaccatagaagaacaaactataaaaattagcccccgtggtaattctcagcaattacttgttgaataagtgtagtagtgaagtattataggcgcgattgatttactttgtactcaatgatatttcacgacattagggtattacatatattgagaatacacattagagagggtcatggcattaaattg

SEQ ID NO: 640249 - DNA, 124 bp, Homo sapiens
ccatgattaacacagccaacagccatttacgtacagtcttatagggaacagccatttagggaacagccatttaggtaacagccatttaggtacagccatatataggatcacagccatataggga

SEQ ID NO: 640250 - DNA, 1049 bp, Homo sapiens
tgttaaggttggcttgttttccaccacactactcaactgactggtgaacagttcgactaactgcatagccttgcctgacccacatgtcccttactctcgcgacatagacactgtcgggatgagttcctctcccatgtgttggcaattgcccctcctatgactaggactatctaagagagccctaacaacttgcctactcatatggcccccttagttgaggtggcgacgccaactagatgcgagcacgacttctctgttcgcccatcagtgcctcctcataccgtgtgtgtctgaccaatcggagatgcatggccacatctgggatgaacaatatcgcatgcattgctgcaaagagaaatgacattataggacctaggttgattgtccggaccttttagtgtcacaccgaaaaccaagcatatttgttcctacccgcgtcgctatgaaaaaaaggtgccttgaagacgcgtcacgttaagtgggaagactcacaattcgtcttaactacccctccacacactcgattccctagaaactagcatcgcgttccacgggcagtggagacacaatggtacctggaattattgagtagaacagaggcgctcgacacatagcggcctataatgcgtattaacagactagcgcagaaaaggttcaagagcttggggaggacaccctgggcattagcaactatgtcccttggagagatcagaatatatgacgctgaccattttcaaggtctatgtccaacaagtactagggccgatgggccggcttggcccgacctcgttgtttgccatttacttcaatccaagcgtactttggtgtcaggctgagatggcgcttaccgtgattcatcgccagggttcgaacgacgagtccgcatagaggtcactccctgcgctttagaacaacttagtgcaacacagcaatgactcttccctatctatcggaattgaaccaaaaagacattggtagggccgggctttgaaagggacccacccaaggaaaagccgggccggcgaagaattaagacacagttctaccca

SEQ ID NO: 640251 - DNA, 444 bp, Homo sapiens
  misc_feature (225)..(225): n is a, c, g, or t
  misc_feature (270)..(270): n is a, c, g, or t
  misc_feature (326)..(326): n is a, c, g, or t
  misc_feature (371)..(371): n is a, c, g, or t
  misc_feature (428)..(428): n is a, c, g, or t
ggcccgtgcaatacacagatataggatgtaaaggctgtgatcatagaggtacaacaatgaagtgtagaaaatatgatgtacattgtgatagatgatcattacagaagacaagagtgactgcagcagagatgaggacagtcctgacgaatgaaaaacgtgtgctgtggctgaggatcagcgtatgtctcagaggctgttgcttttggtattcagctgagagtaggnaattgtactccagagccaagtatggtaaagtggccgctgagacanttttgtgaaaccatgagtggggctgtaggttcatggtcctttcaagcctatacganctcagagtgagaggggtggtggcatagtttggatctgtagggtcnatgacatttctgtagttctttcaaagtttatcacgcgatggtatctgccagaacagnttcagtatagatgtga

SEQ ID NO: 640252 - DNA, 746 bp, Homo sapiens
ctgccggaatcttttgggaaatttcccccccctttctctgtgccgtctatccctggaaaccttttttgtgacactgtcacctctttggcccatgctcaaccctaatcccacacttggcgctaaatgggtgggtcacttgagccccagagtttgagacccgcctggaccactctggtggaaaaccctctttcccaagaccatacccaaatttaggtgggccctggtggtacgccaacttatggttctaactactcaggaggcttagatgggaggatccattgagcgtggaaggtcgaggctgccaatgggctgtgatgaccaccccctgtaactgtactccagcctgggcatccagagtaagaccccgtcttcccaaaaaccccacccaacccaaaaaaaaaacgccaatctatcactgtcccttctcacctatgttgtgctcctgtagcaccacctacactgtgtctctcatacttatccgatttccttgtaaatgttttgggttttctttttcccttttgcggggaaggatacataccccactaaatagtggtgttctctgggtagtggggattgtgatggaaggcttcttgtttctacctttattatttgaatattttataatgagcaagtattattttttgccgtccaaaccatttttaaagaaacatactataaacggtacttaatggccactaagtatgtcccttattttcatactctaataaatgattttctccagtcca

SEQ ID NO: 640253 - DNA, 594 bp, Homo sapiens
cctcccaaaaccgtggagtcttcttgaaacccccaatgggcctttctttcttgagaccactctttaccccgttcttccccccccatatgcacaaacgcggtgtttcctcacccccaacggggaaccccacctgctcgatttaattgcaaagcctctccctcccggtgcccgtcccccacaggacgataactctctataaatcttgcgcccatgtgagacaattcctctttaaaaacaaatacagttataacaccagcctcgtaaaaaaatcttacgtgcctaatatcatcacttcttctaacaacctcatattctgccgcttcttctatgatagccgatgtcgtcagatctctcaccccctcacccctctctaaaaatgatatccccgcgtcttcctccacaaaaacctgctgtccccaatagccccgtttccttctttaaaataaagaccacccccttcgtattctttgaaataagaatgttcggcacgcattcttatattagacaaaatgtatgtcgcccgcgagactaacaacacagcaatgctgcaggagacccaaaaaaaaaaaacgaaaaacccggtttaaaaccaca

SEQ ID NO: 640254 - DNA, 910 bp, Homo sapiens
cgcgatgtttcacaccatgtaatcccagcacttcgggctaggcagagagccaggatcacgaggcgagagagatcgatatcattgtgttaacaactgagtaccccggtgtctgtgatatcttgaagcctcctgatttcatgcagctcttgtgtgacagtgtgcacgtttttgccaagtgtagtgctacacagaacttagatgtcagtgcactaaagacatactccaaatctttccaccccaaatttatcaaagacgtgagagtgattgaggagtggaccacactgcgccaacacaggccctggttgtaaagctttcttgatggaagagagctctgtctggaccccaaggaaaaacgtggtgtgcagacagggttggtgccacaaaagtttttcgaagaagtggctgagactccctacaactaggaatccattctctgttggtatccaagacatcagtgacagatgccagtgaaacttcaagcaaattctacttcaaacacttcatgtatgtgtgggtctgttgtagggttgccagatgcatacaagattcctggttacatttgaatttcagtacaacaatgaatagttttcattggtcccatgaacttatccagaaacatactttatatgttaaagtattattaatttgaatctacaaaaaacacaaataattttacaatttagggtcttcctaatatgccgggaggattttcaatgccaaatttgaggcaggcgcaaagaattcgaacttattcggaatgaatggttgctcatgtgatttggggctccttaccagttggcacaaatttgcgcaggccattgcgggagccggctttgtgaactgtgccccatttggcgcgcaccagacttccacggcggttctatacgggagaaaacactcccggtggtgg

SEQ ID NO: 640255 - DNA, 312 bp, Homo sapiens
cgtacctttttttgccagctgtgtgtagggaaaggacatggacggtagctgggttgtgagttgaaattgacactttgggctggtatgttgtgtggtgatgggatattgacacgttgggcggtaagctgggtggtgaggtaaagtgatcacgtctggcggtaggctgagtggtgaggtgaaaggaccacgtcgtggcggtaggctgggtggtgagggaaaggaccacgtcgggcggtaggttgggtggtgagggaaagtgaccacgtcgggctcatgatggatgggattaatggcagcctgggctgacagaca

SEQ ID NO: 640256 - DNA, 210 bp, Homo sapiens
ggttagtgccaactcagcctggctccctggggtcgtcgctctggcttctgcagcagtctccgtgtccgctccagcggcagtggtggcctgggtggctgcatgtggagagagctggctttggtagccgcagtctgtatggcctggggggctccgagaggatctccattgggggcggctcgtggcctcgggggggtgtaccggagactcgat

SEQ ID NO: 640257 - DNA, 924 bp, Homo sapiens
ttgtgcgtcttggctctctccttatgcttgttgtctgtcgctcgcacaatgtgtgtgccgccgtcttggtgtgttaaccaacgtcgttgtggtggcgccaatagagtctgggctcggttgtctgcactataattttctcctgtgggtgctttagtgtgggttggcctagccacgccggtttttgcgccactttttggtcttcctgcggtgctgtcttgttctcacagagtgttgttcttggctctcctctggtcatgctttcgggtggtgtgttttcgcacttgctgcgtgctgcccaatatccgctcggctcgttagccctggtaggctgggcccacttgtgggtaatagacccctccgtgggtggtccactttgtgtagcgccacgcgtggttgacacacccgtcaggagcccatcaaagtattagtgtcagattgtcagtcaactttcgcggccggcacatcgcaagcgtgttgtccgcgagtacacacaggggcgtccatatttggtgcagtcttagagtgtcctctcggtcgctgcacgggcgctcaacggatcttcaccaaggtgtttgtcccttgggttgccgcccacggatgtgtacgatccgcgcattctgtccgactaatagaagctggtcgggtgcgttcgcaccacacagtgtgatcacaagctcgtgcgccagtgtgaacgaccacctgttgcgtgataatacgcgcgtggctcagtccactcgcaggttgacgccgtgtcgttcatcataggacgtgtcccctctctgctggcgcgcctctgtgtggccaatctggtgtgcggggtcctgccacctctcgtcgtgggcgtcctcccacaatgggtcgaccccccgcgctttatacagtgccccctaagattttaacttgatccgtcccccctcataacaa

SEQ ID NO: 640258 - DNA, 124 bp, Homo sapiens
  misc_feature (81)..(81): n is a, c, g, or t
  misc_feature (122)..(122): n is a, c, g, or t
tcacaatataataggtatgctataaaattcaacacactctaaaattcaaccaatttgttactttactcagaattgtgaggncatcaatacacaacttatttatagaaaacttcaattacacnca

SEQ ID NO: 640259 - DNA, 114 bp, Homo sapiens
cctgagttctctccctcacctggcatatctaacgaggcctccgactgtctatacagcttctgtaacatcttgaaatgcacctgccttcctctgcctctctcgctacagcagcca

SEQ ID NO: 640260 - DNA, 131 bp, Homo sapiens
caaaagtgcactcttctatatctacaaatcaaaggagaacatcctggcctgtccattggtgatgttgcgcaagaaactgggagagatgtcggaataacacatgctagcagaatgcacaagcagccttatga

SEQ ID NO: 640261 - DNA, 842 bp, Homo sapiens
gtcccatgccaagaaaagcttgttttgaaggcttcttctcaagagttagcaagattttagattgtacttcaaatattggggcctctctttgcaatatgtttgcagtatatattatgaggaaatgtagtagagagtttaacgattaaaatttaatcctagccaattaatatatatttcattaatattgctgtactgcagtaaaattattacagatacctacactaaaataaagagccatccctatttctatgtttagaaagtttaagtttttattataacataaatacatgttaaaaaatattgaaagaacaataataaatatgaaaaagtctatcattctgaaataagcactgttaacatttggaatgtttctgtcactcttttgtctgtcctctctcttgtgtatacatgcatgaaattattcacctacataaaataaagattattcattcttattaaaaaaaaaaaaaaaaaaaaaaaaaaaaaaaaaaaaaaaaaaaaaaaacaaaaaaaaaaaaaaaaaaaaaacaaaacaaaaacacacaaaacacaccaacaccacccaccacccaccacccccgagacaaagcaaaccaacaagcatgccagaccagcggcaccaaccacaggacgacacaggcacgcaacaaacagaacgaggcaagaagacaccacgaagagagaaacaaaacaaaacccggagccaacaccaccaaaaggccgcaagacccaggaagacaccgaacacaaaaaaacacaacacccgacaccaccagcccgcacacgaacccgcacaaagccaccccacgagcgaaacagccgcacacagcggcaccacaaat

SEQ ID NO: 640262 - DNA, 97 bp, Homo sapiens
tcgatacgacttttctttttttttccttctcttttcctttcctaccttccttcctcccttccattcccccttcccttctcccttctgtcgtcttctc

SEQ ID NO: 640263 - DNA, 198 bp, Homo sapiens
ctgtacataagatattgatgtcttcttctgccaggcttgtatgagacatacttctggtgggcactgtgcgagaaacttgaggatgaaatcagtgagctgcatgcactataaaaggcatggcctgtactcctcacttgagtgcaaggtccatcgaaccaaagccctgttctagatcaatcactccatgtacagcacagg

SEQ ID NO: 640264 - DNA, 704 bp, Homo sapiens
tctatgaagaaaatttttacaaattgcttgggcggtgacgataacgtggtaaatgtggtcgttacctaaaaggttgccgggttggcccagctcggttcgaataaggaggtttagagctggtgcctaggactccagctcagtgcgccgaataataggtatagtgtcccaagtgtcttgggggttggtagagaatagtcaacggtcggcgaacatcagggggggtgaggtaaaagggctgagtgaagcatgggacgtgtaaatctaaagacgaggggttaggcctctttttaccagctccgaggtgatttctcatatggaattggcaaattcgaagaagcagcttcaaaccttgcgggggcttctcccgacctttttccccgggcgggcgggagaagtacgatggaaagccagtggataaggggtgcttcagctgtaaactaagtgtcggggggttcaagtcccatgggtctagtaggggctaaaccttactaagggggctgattgcgcgtccagttgatgcaaaggggggcttggagatgaccccttaaaggcgccctctcagcctcctaatgacctcgggcctacctggtgattacactccaactccataaaggctctaaataataggctataaccaaaacttaaccatataccactgatggccgatgtacacgaaaaagcacatacaaggcaccaaaaccacg

SEQ ID NO: 640265 - DNA, 986 bp, Homo sapiens
  misc_feature (670)..(670): n is a, c, g, or t
gtctgacatgactatcctcatgaagattctctccgtgcgcgtgtacggcataacagcaacacgaggttcggagccgtagacttctgcgtgatgtgcaatcaatgagagtgctagtgtgttacgattgcttgcatgaaatggcgtgcgacatagagtagttagtgccacggatggtgtccagtcttcatcgctcatgggagaatgatggctatagacctatagactgattgtgacacggatcaataccactagacagagcaaatagtacgctgtgtatcgcacgtatagggcgcatcgcattagcggcatcgtatcaccatgttcgtacccgactcactttggggcagtagcgagatcacttagtgtccagtggccagctgagataatctagctctttctatagcctacgctagtcgaattggaaaagatgtagaacgagctagggggaacaatcgcgagctacaaaaagactcataggtaattgggtctctaaacttactaagattgcgttgaatcctagtgagggtgacagtcactaatcgatgggtttaccactctgagtctgtacgcgacggagacctggtggcagtgactacgcaaagtgaatggaatcctgcattgcccatctttgggggtacgccccgatgtcaccgaaagtcgtaaaggatcntaagaaatctattatgctttcaccttcctgaaagaattaagggttactacgcgtgatgatgagatattgcgtgagaatctaaatttaaccatagtgcgaatcgagtttggtttgatcctctctaaggcatcgaaaagaaattgcttgggatatccaaggtggaagcctaagggattttaaatggactgaccggttggtgggagggaccatatctggaaatcaggttcactacttagtaataatagatattgtaggaaggtgtgacccaaagtggtgccgtggacagtgggcaggtaataggcctcggttttccatg

SEQ ID NO: 640266 - DNA, 1616 bp, Homo sapiens
tgcaagagaccagtaactccctcacacggttcctcataggtcaacggcagtggctgaggtggcgcacatacggcgagcagggcagcagcagcagcagcagcagcagcagcagcagcaggcagcagcagcagcagcagcagcagcagcagcagcagcagcagcagcagcagcagcagcagcagcagcatgcagcagcagcacacacagacaacagcgcagcagcattcatcgtcgatgacgtgcgttcagtagtgcgtgcgcagcatgcgttctgcgagcgtagggggagcggaaccacacagcgcaggcgtagggcgcgtgcttgcatacgcagctagcaattgctgattgctgctgactgcctagttgcatggtcgaacgggcggcgcttgctgctcgcacgcgcggcctgctaggccgctagctaactcgcgcccgacgagcgatgcggcgcgaggtaggtcgctagctaagcagagccgggacgaggtagcaggcggcaggacacgccgctcgcgagtagtcgtcgatcagataagaatacgacaggcctgcatggcgtgacagtgctggcatagctcaaatcagatatagtaaggtttagattgcagtaggttcggttggtgtgagctgggctaggctctcggttttagtttcttagttatgtataagataatggcagtagtattagacttggccgatatgctattcgcagttggaatgtgcatggacatggcgataggacatggtccgatgctccgctagtagtataggcatggcttatgatgcgcagacgagcagcactacaactcaactccagccaagctcaagctacgagcttctgatatcgaccactgccgtactaatgcattggcgagtcgcaacacaccacatacaacaatttaacagatgcaatgaattggaataggaggcgactgagtggacactcacgagacgagcgcagagatggctacgcttcgagttgtagttgagaagacgaacagacaagaggtgtagatagacattgagcgccgagcgtgacaggcaccgatgtcaggtacatcgaccacgtgatgacgaccgtggggggagagtgctaacgataccgatagcgtgcgcgtcgcgtcacaggtgagaagcgagcgaaatggcgccgggaccttggactaggctatgcattagtatcagtgccccgagtcggctctagaggagagacggcataggtcatgactcgacatgaggctttggacttggcctcggcttcgctataccgtaggacaggatacagaacgagttgtgccatgtacactgggcgacgaatgtgatagactcgtctatatcattctcgattcagatacgatcctctcatctgctcctgtgcgtgtcgctgtcggagtgcctgtagtattgcgtatcatgcaccgaagccgacgtaggacgataatgacatatgctcagaaccacactgagacaacggtggctggacgagccagcaggtcgacacagatacagtatgaacgcgtgcactcataatcactccgctcgctcagagtcccgtccgtcagagcggattgagctggattgactgacacatatcatgtaactcagccagctaa

SEQ ID NO: 640267 - DNA, 276 bp, Homo sapiens
ctctagacggatcgggacgcttacctcgggagccttcacctccgggagccttaacctccgggagccttaacctccgggcagagggacagcgccaggccgcggagtcagcagttttcttctcagtgcccatgtgcaagcactgcacgagttttactgcacaaacgggcacatcaagtccagctcctcattttcaggcaggtggcctactggcttgtgtctcaatggcagggttcacgggctccctgggggtcaccgagctcgcaattcgtcacatcc

SEQ ID NO: 640268 - DNA, 667 bp, Homo sapiens
  misc_feature (135)..(135): n is a, c, g, or t
  misc_feature (365)..(365): n is a, c, g, or t
  misc_feature (468)..(470): n is a, c, g, or t
  misc_feature (497)..(497): n is a, c, g, or t
tgccccttttttttgcacaccgcgagtctttttttaaaagcctgtgtttccccccccttttttttgtgcattacaaaccaattaatgttttttccactgggtgggagaaatttgttgtcccccggcccacccacnttttggttttttggttttgcccccaatgggtgttacaaagccccgttgggggcccccccttgtccccgggggggcccccttgtgaggggggtttctttttccctctcgggaagaggtggggggacccccccagggtggcctttttttagagggggggtttttaagggggctcccagcccttcccggggggttggtggggaaaaaaattccccgggccccccccccacccnttttattaaaattttttggggggggggcggccctttttttttccccaccccccccggggttttttgggttttttttttttgggcccccttttaaaaaaaaaannnccccttttgttggggggggaaaaaaanggcctttttttccaagggggtttcttttccccgggcccccctggggaaaaaggggaggggggtttttttttggggggcccttttttcccggttttttttttttttttcggggggtttccccccccccccttttttttaggggccccccccttttaccccctgggggggga

SEQ ID NO: 640269 - DNA, 699 bp, Homo sapiens
  misc_feature (513)..(513): n is a, c, g, or t
attggacgttaaaacacgtgagtagccttttttacctgtcagcagcatgggtgtgtgcagccactatgctgagacaataaattaccaaaaattataatgtaccgagctgaaaatgctcagtacattatgtggcatattctggatgtgacgagagaactcattggcatttgggacactgacattccagaagtaattcacaactgctttgcaaaagcaaagtgactgctcagatgaacagagcagagtactcactcactatggtggcatcagctgcaaagcgaaatgaactgtgccatgatcatgttgatgggtttctagatactgccaacatgttagctctttctgatgctgatgagattcaaacacgaacagacacccttgatgtgggtttgctaagaacatagaagaacaggaagaaaagttgccacgttcacacattccaggaaaaaagaagatataaaagcttatcagtcagtgactgatgataatgctgcaataatgggaatgggtttnggttttaaccacaatatttctaaatcaaatcatataattgctttgttcttaaagggaatgagcactaaaggtgtgaactgtgtgagaaacaattagaattggattctgtgtttaacagaaaaggcaccaccgtgccatgggtttttgctcgttattccacttctcaggaagctgcgcggaggagtt

SEQ ID NO: 640270 - DNA, 364 bp, Homo sapiens
gagaatgaccaactgccgtgactttttctgaatggacttcataaccggaagacttaaccggtggcctcatcaccagagcatcccaggatttctaatgcactcagtttcctacatagcagggattcttagctaggtgtcccatgaacccgtaaagtctacacaagtcttgcatacaggagcctttacaagatgatatacagggtcgcagattgggtgactgacagactgtggggtctggatgagtgcccggctgcaaataagagtcagctagtcggggtgcggtgaggacgaaatgactgctgctttctgttcgttgcttataccagaggcagttatctatgccaagtctgtaactgtgcaccca

SEQ ID NO: 640271 - DNA, 850 bp, Homo sapiens
  misc_feature (672)..(672): n is a, c, g, or t
  misc_feature (692)..(692): n is a, c, g, or t
  misc_feature (712)..(712): n is a, c, g, or t
  misc_feature (739)..(739): n is a, c, g, or t
  misc_feature (746)..(746): n is a, c, g, or t
  misc_feature (748)..(748): n is a, c, g, or t
ttgcttccatgcagtgtgactctacgaggatccccacgataactgtagagaaagcttcgaatagttccatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctagcatagcacttaaaaaaaaaaaaaaaaaagagaccaaaaataactttaggaaccaccatattatttcactcccaatagcactggacctgggtgatcaaaaacacttgaagaagacttctattggccatctctggccaattaccctaagaaacatatcaaggggctttgggcacaggtgcccacaaatacggatgcagtgctgagatagtttatgagacttgtaccatttcacaaacctctgaaatggggtcccatattgggcaaggctgccacagcttgttaacgaataatcctctattgtttcttcctcacaaaaccatattctcatttatattccagaccattacttcactataattacagggacacaattattagcaagaaataagacatagtattnacgaagaattgatcctattntggaacccctctccagtatnttcacactctggtcaactctccagggnctctctntngccctggagttatcagcctgtggtggtggttaactaccttagaaaggtccaacgctaaagaattgtacacagtatcaaccctcccagtggcttaattatacc

SEQ ID NO: 640272 - DNA, 1088 bp, Homo sapiens
  misc_feature (22)..(22): n is a, c, g, or t
  misc_feature (35)..(35): n is a, c, g, or t
  misc_feature (61)..(61): n is a, c, g, or t
  misc_feature (910)..(910): n is a, c, g, or t
  misc_feature (930)..(930): n is a, c, g, or t
  misc_feature (950)..(950): n is a, c, g, or t
  misc_feature (977)..(977): n is a, c, g, or t
  misc_feature (984)..(984): n is a, c, g, or t
  misc_feature (986)..(986): n is a, c, g, or t
aagaacttgaatatgaccctanataatggggcgcnacccgcgtcgttagtagccctggaanacgacgacgccagacgtacgagacgcgatactcgtatgcataatatcgagtacatcgacgtcgaatatgccggatcggcatacgcggggcaggttctctctccatgttactcaaagtagtgaaatagtcatgcacgtgaagacccacacttggggatctccttaatctttcagccagggactgtccctccctttgaattaatatgggaagaaattatacaggatgactggaagaagggtgatgtgatactttctgaaacctggagctgggaattgcggagaagggaaggtctagactagttacatcacatagggattactgtaaatcaagtcatctcaagtctagtgaagacagccaacagaaacaaaacctagcatagggatagaaaataccatgcacgtgtgcagccccacctaattcctgcatccaaggcaggtgttgttaatctagcatagcacttaaaaaaaaaaaaaaaaaagagaccaaaaataactttaggaaccaccatattatttcactcccaatagcactggacctgggtgatcaaaaacacttgaagaagacttctattggccatctctggccaattaccctaagaaacatatcaaggggctttgggcacaggtgcccacaaatacggatgcagtgctgagatagtttatgagacttgtaccatttcacaaacctctgaaatggggtcccatattgggcaaggctgccacagcttgttaacgaataatcctctattgtttcttcctcacaaaaccatattctcatttatattccagaccattacttcactataattacagggacacaattattagcaagaaataagacatagtattnacgaagaattgatcctattntggaacccctctccagtatnttcacactctggtcaactctccagggnctctctntngccctggagttatcagcctgtggtggtggttaactaccttagaaaggtccaacgctaaagaattgtacacagtatcaaccctcccagtggcttaattatacc

SEQ ID NO: 640273 - DNA, 370 bp, Homo sapiens
ggttccccgacgctctctctgtgggggaggccggctcctcttggccggcacacccagcccccccatcccatggtcatccgccggaaagcgtccctaccaggttgatgacaacagcagagcgtgggagcggacgcacctgggacgcctgggagacctgggacgcctggggcagtggagtctggtctccagcacccggcccctctgtgctgccaagggctgaacggccttcactccttctcctgggtgtgctaccgccctgtccttacgtccctgcagtggaaggacgaccttcatgtggatgccccgttggccttcaaggtcacgcctcaaggacgcagcagctgtcgcccttgccccacagagagagcgt

SEQ ID NO: 640274 - DNA, 244 bp, Homo sapiens
ccccctcccccccccccgcccccggtttggccgccctgggccctgttttttttccccccctcttgggttttgggtttggcccccctctttggccccccccagtttcccccccccgggggggtgggccccccgggtttccccccccctttggtggcccggggggggggttttttttcccggggggtttttgggggggggggggcccctcttgccccccttttttttttggggttcccccccttta

SEQ ID NO: 640275 - DNA, 493 bp, Homo sapiens
cggcgatggcggggctgggaggggggcggcgggagtggggtgggcgacgggggtggcccagtccgcgggccccccagcccacgcccggctggccccacgccccgcgggccacggtcgtcccggctgccgccgtcgcgcagccgctggagccgggtcccggaccacccgagcgggcagggggcggcggcgcggcccgctgggtcaggctgaacgtgggaggcacctacttcgtgaccaccagacagaccttaggccgggagcccaagtcatttctctgccgcctctgctgccaggaggacccggagctggactcagacaaggatgagacaggacgcctatctgattgacacgggtaccccacctactttggtcctatcctccaacatacctccgcccacgggcaaaactcactcatccactaacgggagttggcaacgaaccacaggtctgccaggcaccgcaacgcgcaactttcacaaacactcgactccct

SEQ ID NO: 640276 - DNA, 185 bp, Homo sapiens
cgaggttgggttaataacgtctgatctgcttgcagagccaacgtgtcaaaatgaagcgtttgcgctgctgacaataacccataggctgttgtgcctaacgcattagtctgcgtcaattggcgtcgtgaacaagcgctggagatgtcccatagtgggcaataaccatggctagggctgccagtcca

SEQ ID NO: 640277 - DNA, 850 bp, Homo sapiens
cttgccatcccataacaatggaactagcagccctgagccctttgagtctcatcccctgactgtcggctctaagcaagcctcagcgagtgcccggaaaacacctgagtccttcctgggccccaacgcggccctggtgaacctggactcactggtgaccaggcctgccccaccaggccagtccctcaaccctttcctggcaccaggtgctcccgctcacctcggcccctgttaacttcctttccaggtgaaccagccccatgccgctgacactgaaccagctttcgggggagcccatgtccgtgggtgaccagcactatcctttgggcctggcccaggagtggagtcctatggctgtggcctcgatgacctccgcggtcccactgtcagctctgggggccacgtggttcctctctgacaccactgggccctgcatatgatgaagcatggtgggcatgtgtgggtatacccccatcagcatgcccaggctcactgaaacgaaacaaccctttccgttctctagtgcctgggcctgggacccacctcatgagcagctgtgctggaggatgccgagcaatggactcctcgatctgtggtgacgggtatccaacgagtttggggattaggggtattagggctatttgcaggctccagcttcctgtatgaaagggctgtcgtttacgagcccccataccctcagaccctcgccattccaaggcaggccctcagtacatgatgctgtctcaccattctcctcaaagcactgaggtccttggcaggggtcctctgaggccttggacgaggacgtggagtcatcagtgttgccctttgcccctaacctcagcccgaggtc

SEQ ID NO: 640278 - DNA, 446 bp, Homo sapiens
gacgggaggaccgcatgcaggaaacatgctctgagtacatgtcccgaaggacaaggcagccccaggaaaaggaggagatccaggaggcgtctacaaaaatgctcaaggaacaagggcataggagcacaccatgttggcagggaaacagacaaagaccagacatcagcgcttgctcagaatcctctgctgctctcgaagggctgtgtcctccacaggtgggaggatgccacctgggctgatggtccaagcagtgtgggttcagccagcgctcttggcacctgggagcatgattccaaatgtagacgtaatccagacctgcagcttcaaaaaaaggagccaccgtggtcagggtcagggctgacacagggccaggggaagagagtttgcaagtagcaattcaatacttttatttcagaatgtgtagcaagtatttgacatatatgtat

SEQ ID NO: 640279 - DNA, 257 bp, Homo sapiens
aggatcgcacctgcctaacttatgcaatatgcgcatcaaatgtcggtggagcacgaacctgcttctcaagctcatggaatcatctggcccttatacaatggagcatgactcgcttatgggacatagaaactcggtagtgagtcatgttgagcatgccgcagtgaacggtggtctcgccagtgaacggcagtatgggcgacacggtcatatcaggcagataggggtcgacttggacatggcgaacgtggcacatgaac

SEQ ID NO: 640280 - DNA, 262 bp, Homo sapiens
ttaaaccccttaaaagggatgaaggagggggggtagcatgggggggggtacaaccttaacccctgggctttttctgggggggggggaaagggattttggaaccccccttagaattcctttgggtttggaatcaggttgggtttatgatttgtctttgcctattccccgataattggaaatggggggtttttaagccccagtcctttttcctttggttttcccaaatggtttaaattgggatttttttatcccttttttccca

SEQ ID NO: 640281 - DNA, 174 bp, Homo sapiens
ctgacgtgcatgacgaggctgacacgtccccacagagggaagaatgcctgtgcacattgcatttattcccatggctagaaagccaacttgtgtgaccccttggcctagctaacctgggtgtctaattgagcctgcctgtgctgacggctgcagccctgcccatgctcctgccct

SEQ ID NO: 640282 - DNA, 401 bp, Homo sapiens
  misc_feature (67)..(67): n is a, c, g, or t
  misc_feature (70)..(70): n is a, c, g, or t
  misc_feature (137)..(137): n is a, c, g, or t
  misc_feature (146)..(146): n is a, c, g, or t
  misc_feature (150)..(153): n is a, c, g, or t
  misc_feature (165)..(165): n is a, c, g, or t
  misc_feature (172)..(172): n is a, c, g, or t
  misc_feature (174)..(174): n is a, c, g, or t
  misc_feature (206)..(206): n is a, c, g, or t
  misc_feature (210)..(210): n is a, c, g, or t
  misc_feature (215)..(216): n is a, c, g, or t
  misc_feature (220)..(220): n is a, c, g, or t
  misc_feature (240)..(240): n is a, c, g, or t
  misc_feature (256)..(256): n is a, c, g, or t
  misc_feature (259)..(259): n is a, c, g, or t
  misc_feature (276)..(276): n is a, c, g, or t
  misc_feature (285)..(286): n is a, c, g, or t
  misc_feature (303)..(303): n is a, c, g, or t
  misc_feature (310)..(310): n is a, c, g, or t
  misc_feature (316)..(316): n is a, c, g, or t
  misc_feature (325)..(325): n is a, c, g, or t
  misc_feature (336)..(336): n is a, c, g, or t
  misc_feature (345)..(345): n is a, c, g, or t
  misc_feature (377)..(378): n is a, c, g, or t
  misc_feature (381)..(381): n is a, c, g, or t
ttcattacgcaaatacaggcatctcaaggtggtcagaagaacattctggatagcaagcccactgcanacnagaagtgcgacctgatcagccatcccccagaaaaccactgacacggccagtgtgcaaaatgaagccnagttggatnagannnnaaaagagatctnatctatnanagacacaatctgcaatctagactcagcgtatntccnagttnngaanagcatattgcatagatcgcngtcctgaaggtcccanccnccatccctacagaatanatgggagcnngaacttgtgctttgganctggttnttggtntggtcctanggagggcgganagggaggcnctgccatctggagactttccatttccgatttnnctntctcaagggtacccagctct

SEQ ID NO: 640283 - DNA, 274 bp, Homo sapiens
tcgagaaactgcagtaggctcttggaagtagaccaagggtgtccaatctttggcttccctgggccacatcgggagaagaattgtcttgggccacacatgaaattcacaaacactaaggtagccgatgagctttaaaaaaaatcgcaaaaaagaatctcataatgcttccagaaagttacgaatttgtgttgggccacattcaaagccgtcctgtgccacgtgcgggccggggttggacaagcttgaagtagactgtccatagtcagtagaagag

SEQ ID NO: 640284 - DNA, 364 bp, Homo sapiens
agaagtccgagcctcataccgaagctacctcataatgggcaaatggtggcaactggagtcggtagtgcgaacacccagtccgatcctgttctgacttctagctagtttcttctgccctcagtcatgaggggctaccctatcctcccatcctatggtacccaggtgcatggaactagagagaggggaagggaagacgacgacggaagacagtttggtgccaggtgaaggtgtctctgctctgcatacttaattgggccctggccatgactaccagcaatcgtgggtgcagattggctgggccaagggttgggggcatggtgctgatactccctaggcatggtacgagcatgcagattctaggaga

SEQ ID NO: 640285 - DNA, 104 bp, Homo sapiens
ctcaccaccctcgaatctcagacacatatctccacttttaggaaaagaaactctacaatttctatgcaaacatcgaataagaaggggagcggacagatcccctg

SEQ ID NO: 640286 - DNA, 131 bp, Homo sapiens
tggcccggaggcgttctgcaggccatcaggctgaggagcaggctgtgtccagtgcgatgcagggccctctgaagtcgaagaagaaggagagccggttggccattcaacgcctccgggccatcggaggcgtt

SEQ ID NO: 640287 - DNA, 317 bp, Homo sapiens
gatgaggtgagaaggatatgaaaaaggaggatgatgtggaggaggaagaggaggatgtggaggaggaagaggaggatgtggagaaggaggaggaggatgtggagaaggaggaggaggatgtggagaaggaggaggaggatgtggaggaggaggatgtggaggaggaggatgtggagaaggaggatgtggaggaggaggatgtggagaaggaggatgtggagaaggaggatgtggagaaggaggatgtggagaaagaggatgtggagaaggagggtgtggagaaggaggatgtggaggtcgacgcggccgcgaattta

SEQ ID NO: 640288 - DNA, 82 bp, Homo sapiens
ttctgcaccaggcaggagcgggcgctgtccaggctgggccgcccccttggctcttcctcctgttccaggggagccataggag

SEQ ID NO: 640289 - DNA, 182 bp, Homo sapiens
tctacccaatcctcaacagtgattcagtgtcactgttactgtgttcttttcatcagggcagtaaaaagggcattgctaggttcaagggcagaggggagatatctcttggtgggaggaaggttgaagaatttctgggcatgttctaaacccactgtaggtattgaggtgggtaatggggacat

SEQ ID NO: 640290 - DNA, 725 bp, Homo sapiens
  misc_feature (654)..(654): n is a, c, g, or t
ctcaccactcctattcaacatgttagtggaatcaggcaatcaggcaggagaaagaaataaagggtattcacttaggaaaagagtaagtcaaattgtctgtttgcagatgacatgattgtatatttagaaaaccccatcgtctcagcccaaaatctccttaagctgataagcaacttcagcaaagtctcaggatacaaaatcaatgtgcagaaatcacaagcattcctatacaccaataacgacaaacagagcaccaaatgagtgaactcccattcacaattgctacaaagagaataaaatacctaggaatacaacttacaagccattaaagactgctttaaagagactacactactgaggccaggtacggtggctcacgcctgtaatcccagcactttgggaggctgaggcgggcggatcacgaggtcaggagattgagaccatcctggctaacatggtgaaaccccggctctactaaaaattccaaaaaaaaaaaaaaaattagccaggcatggtggcgggtgccctatagcccaacttctaaggaggctgaggcaggagcattggttggacccaggaaggagagcttggagtgcccttagacttgaccactggacaccaacctgggcaacaaagggagattccgtcttaagnatgacaaggttttccttcggcccaattgggcttaccttgcaattaccctatagaggccgttccaatcccca

SEQ ID NO: 640291 - DNA, 935 bp, Homo sapiens
  misc_feature (7)..(7): n is a, c, g, or t
  misc_feature (223)..(224): n is a, c, g, or t
  misc_feature (282)..(282): n is a, c, g, or t
  misc_feature (304)..(304): n is a, c, g, or t
  misc_feature (357)..(358): n is a, c, g, or t
  misc_feature (362)..(362): n is a, c, g, or t
  misc_feature (370)..(370): n is a, c, g, or t
  misc_feature (374)..(374): n is a, c, g, or t
  misc_feature (424)..(424): n is a, c, g, or t
  misc_feature (434)..(434): n is a, c, g, or t
  misc_feature (448)..(448): n is a, c, g, or t
  misc_feature (450)..(450): n is a, c, g, or t
  misc_feature (452)..(452): n is a, c, g, or t
  misc_feature (455)..(455): n is a, c, g, or t
  misc_feature (463)..(464): n is a, c, g, or t
  misc_feature (468)..(469): n is a, c, g, or t
  misc_feature (471)..(471): n is a, c, g, or t
  misc_feature (474)..(474): n is a, c, g, or t
  misc_feature (481)..(481): n is a, c, g, or t
  misc_feature (493)..(496): n is a, c, g, or t
  misc_feature (498)..(498): n is a, c, g, or t
  misc_feature (507)..(507): n is a, c, g, or t
  misc_feature (510)..(510): n is a, c, g, or t
  misc_feature (513)..(515): n is a, c, g, or t
  misc_feature (526)..(528): n is a, c, g, or t
  misc_feature (536)..(537): n is a, c, g, or t
  misc_feature (544)..(544): n is a, c, g, or t
  misc_feature (546)..(546): n is a, c, g, or t
  misc_feature (553)..(553): n is a, c, g, or t
  misc_feature (555)..(555): n is a, c, g, or t
  misc_feature (558)..(559): n is a, c, g, or t
  misc_feature (563)..(563): n is a, c, g, or t
  misc_feature (565)..(565): n is a, c, g, or t
  misc_feature (579)..(579): n is a, c, g, or t
  misc_feature (586)..(586): n is a, c, g, or t
  misc_feature (588)..(588): n is a, c, g, or t
  misc_feature (590)..(590): n is a, c, g, or t
  misc_feature (595)..(596): n is a, c, g, or t
  misc_feature (600)..(601): n is a, c, g, or t
  misc_feature (607)..(607): n is a, c, g, or t
  misc_feature (619)..(620): n is a, c, g, or t
  misc_feature (631)..(631): n is a, c, g, or t
  misc_feature (926)..(926): n is a, c, g, or t
accatgnttggccaggctggtctcgaactccttacctcaagtgatctgcccgcctcagtctcccaaagtactgggattacaagtgtgagccactgcacccagccagataattgcacttcccgaattaattatgagattactaactgttcgcctcaaaacagaaaaaaaaggaagtagccaaaatatgcaacagtatagaattagtttagatcattatggttcnnccattaaatggaaaattacacaacggaactttccataaatgggaaataataataaatnaattattttaaataccccaganatatctttacaggcatagtagggaagggaagaatatacagttaaatgcaaagnncaangatatgtncctntcccccctttttgtaaaaagttcacatttgtagaaataagtgtataagtnattttatgcncagaaaaatatccngngnggnatacgccnngtgnnanccngtccccntgacccgagccnnnntnggccgactnccnttnnncctttgcctannngtcttttnnttttccncnataaacntnccnngaangnctgtcaaacctccntatatgncncncaacnntttnnaccacngtctatgcaacnnctccacccccnccccagataaatagtaaaaaaggaaactatgtttgctataaatatggcaaacagtaataaattttgtatgtaaaaagactgtttatcaaaaagtaacaaaaccttatatattaaaataaaaagaatgccaccgccaaaaaaatttcaaaggacatataaatacttaataaatcaacaggaaaataatgtaatcccatgtcatcaaagtgatatcccttttaacttagcaaattcaaacattttcaattatattaggtatttcaaacattactagtaagaataccaagtggaaaanattctctta

SEQ ID NO: 640292 - DNA, 193 bp, Homo sapiens
ggaaggtggcgcctcgggcgggggccggtccctgcaccaggtgacctgttccggcccggatccgggcggcctcgccatgcagcggcgcggcgcggggctcgggtggccgcggcagcagcagcagcaacccccgccgctcgcggtcggcccccgggccgcagccatggtgccgagtggcggcgtcccccagggc

SEQ ID NO: 640293 - DNA, 655 bp, Homo sapiens
ggcggagcggagctggcggcgggcgcagcgtagcggtggtcgtgccgcgtgagcggaggtgcagctcggcttcccccggcacccctccacctcacagagccaaaaaatacgaaaacaaaaaaaagaagagaaaaagaaaagagacaaaacactacatacaacacgaagcagagagcagcacaaagatatacgcaaagataaagaacacaaaaacatctaaaagaccacaacagtaaaagcaatcatcaaccacaaacaaaaaagacaaagatagcagaaagcaaaacagaacaaacacaaaaaagaacagaacataaacgaacataaataaaatataagaggacagatcaaacaaaccaaataaaaaaacgaacaaacacgcaacaatataaacaatacacacaaaatacagacacaagacaaccaaccacaaaaacaaaaaacccaacaacgacccacaaaacgacacgctacaagcccttcacaaccacacacacaaaaatcacaacacacacgacacatacttactaaaacatcactagcagcacaaactgcacaccacagatagtaacacacaaacacgcacataaacaagcctcccaatacgcaggcacacatacacaagccacactccaccaaaacctaccaaccccac

SEQ ID NO: 640294 - DNA, 418 bp, Homo sapiens
tatgttcctgtcgcccctcttctctccttccctgctgtcacggaactgctatgctcatctgcctgcagcgataatacgctgctagggttcatttcctaagagagagacttctagtgccccgtgtagcaggcactgtcctctgccgtttagaactgactctctcctgttttctctctaggctgcgcccccccaccttccccaactaccctttcccaggttcgatccattagcaccaacgtccggagaaacctggcctttccacacactcagccaagaagtcctgctcaaggagttctccactatctcctgaggccacgcctacctgagcagactctagatgcccttacccatgaggatcatgggctggagggggagcgaggggagagggggctgcccccgaggttggagagaaaaacag

SEQ ID NO: 640295 - DNA, 658 bp, Homo sapiens
  misc_feature (577)..(577): n is a, c, g, or t
gggattctgccacattcgcccaggctggtttgaactcctgatctcaggtaatctgcctggcccagccatcccaacatgctaggattacaagtgtgagccgttgttcccagtctcttctgtctcctaagagttaagaggacgtgctggattctaattcttcattcgttcttctgtattgttcttttatcctgaaatcgtgatctctcagccacgtgctaacccgaggcctcggaatgatccagatgacgtcgactcgttggggctcactgcaaccttccacccccgtgggttcaagcaattctcctgcctcagcctcccaagataacttggggactcacagggttgcaaagcttgcccgctgcctgtgggctaatttttttattaattttggggatttatttaagttgagagagcaacggggggttttcaacccaattggttttgccgcagaggcgtgtggtcttggcaaatactctcctgtgaagcccttcagaggggcaaaattttggcccccgctctttcgggccctctccccaaaagagtatgctgtggggatatcccacggagggctgtttgnacgcccaacccaaacgccccaagcccttaatataaattcccttaaaataatactttgagttaaaaattccactcgagaaag

SEQ ID NO: 640296 - DNA, 280 bp, Homo sapiens
ccccgactagcatatcaggacagtgagataggtagaattgcttcagaccgtgaggcgtaggttgcagtgagctgtgatcacgccactgcactctagcctgggtgacagagtgacgactccatctcaaaaaaaaacgaaggaatcgttttctgtaccaaatttattttgtttttttataaaagacagggtctgattctgtggcccaggctgaagtgcccgggtgggatcatagctcactgcagcctcaatttcctggcctcaagcgatcctcctgcctcac

SEQ ID NO: 640297 - DNA, 582 bp, Homo sapiens
  misc_feature (5)..(5): n is a, c, g, or t
caggntctacccctcaaaatgacaaaattatggagatggagaagagattactcactgccaagggttagggacagtccgggtagggggagggcagtgtgactatacagggtagcatgaggaaaagtgataaaacagttttgtgtctttttgttttgttttttttttttttggaaagggattttggctctggtggctcaggcaggagtgcaagggcgtgatctcggctcactgcaacctccgcctccggggttcaagcgattctccgtgcctcagcctcccgagttagctgggattacggggtgcccgccaccattccgggctaattttggtattttaagtagagacggggttttcgccatgtgggccaggcgggtctcaaattcccaacctcagggtgatccatccgcctaagcctcccaaagtgcggggatttcttaatacacgtctctttccccgatttggtttctgcccttctaaatgcctgcatgagggagctaatgggatatctggtggctactctaatctcagcatattttagatttagtctgtcacctcccttttttgacctcccattcttgtttt

SEQ ID NO: 640298 - DNA, 176 bp, Homo sapiens
  misc_feature (133)..(133): n is a, c, g, or t
ctaaggatccggctgagcagctggaggcatactcatcttttcagtgggggtgaatcagtgtagtacaagagatagaaagacagtccttgctgaaagacaagtctgaatgctccactttttcatattctctctnccattcttcagtcaagtcaccttcacatgtcggagtggatgaa

SEQ ID NO: 640299 - DNA, 478 bp, Homo sapiens
ttatgccctagctcgcatgttacatcaaatcaatccagtcagaacaaattactgctgtagcatggaccaacttgggagtgttatacctcacaaatgaaaacatagagcaagctcatgaggcttacaaaatggctcaatcccttgatccatcttatataatgtgctggataggacaagctcttatggctgaggcagtatggaagttatgacaccatggatctcttcaggcacactacaaaactcaatatgcatccggaaggagcattaggttatgcgtatggggtctgcacaacatggcaagatcaaaagcaacagagaaacagagctgtacgtgtacaacatcctccagatgaatgctataccagcagcacaagtaatattgactacatctgtagaacgaattcagaattatgccccagactaaacaaggtggggttacttacacgcacatctacaactgaaaccggacgcagcaaat

SEQ ID NO: 640300 - DNA, 316 bp, Homo sapiens
  misc_feature (52)..(52): n is a, c, g, or t
  misc_feature (99)..(99): n is a, c, g, or t
cccatagccagccaaaaaaactttaaggctaaaaacaaagcaaaacccgttncccctaatcttaagaagatacccctttatgaatgaggaaaaagttcncagagtaaataaagcttttgtaaatggacaaaaggaacttgcccctttcgcaaaaagcatttcccttgaacctctgcaaaaaaaactgattcctcagcagggtcatgaaagcaaaccagttaatgttgatgaagctccaaaattaatggctctgttgtaaaaaactggtgatgcatttaattttccccaaagaccaataaattgaatgttttatcca

SEQ ID NO: 640301 - DNA, 392 bp, Homo sapiens
taggactcacaacaatgggtacacattgctacataaagatgcaacgatagacactattggagctactacatggagagggacgaaggagatcataatggttgaacaattattgggttaccaatgttcactatctgggtcatggtgtcaattgtatcccaaaactcagcatcacgcaatatacccatgtaagctcttctcttgtaaaactaggatttccaataagcaactttctcaatattctttattttgaaacctatttcaatttattttgaagtctattttaaccctgggaataagtattatgtagtcctgaactgtactgttcaatatggcagccactattcacaggtggctgttatagtttacatttaaattaattaaaatgaaacata

SEQ ID NO: 640302 - DNA, 167 bp, Homo sapiens
cgcctctcacaggcatcccctgggctggggcaagcagggggcttacaaagggctcaatgcaatcattcaagcatgcagcaaacaggcgcaatggcatcacgcaagcctgtcccatccagcctgtctttcccttctttcccccagcccagggtgtcactgcatgctcg

SEQ ID NO: 640303 - DNA, 299 bp, Homo sapiens
tggcctataggtgtcgtgaaagttacagtgggtcactaactgttatcttaaaacttacaagtgtttgtctcattgtagaataagctgatactaaaatcatatgatggtctcatctgtatagtacatgattctagggtaatgtatattcttctaggctcatcagagaagtcactactcaagacagtctggtggcaatcctttcagggtacaagagtggtagcatacttttattaaagtacaaaggaaagtgtaacttagatcaatttagctctatacttttcaacagccataatacaagt

SEQ ID NO: 640304 - DNA, 1083 bp, Homo sapiens
ccatgtttggcaatgacatctccccgtgagatatggcggagaaggtgcggactcttgttcttgcactggtgaactcaaccagtgacagattgacggaagttccacatgtaaggctccaatgaagccacaaacgtttccccttcgaccttttgtgattccatttctcaaggccaaactgcccctgctgcagcgggaactgctgcactagcgctacgggctggcacaagcagaccccatcccagatacctggctcagacacgaacaccttctgctcaacagcaagcattgcatcgcctgctgacatcgtacagagctcgctccatggcaggtgcccacggcaacctggcgcacagcaggcccaaggtcccagcagcaggcacgcagcacgcagcaatcagtctccgcatcagcagcaccacacaattgcctccctgcaggccatccatgccacaatgagaagctcatgtaccaatcacgccctgcctccctccagtggcaccacgtccatgcctcttcaaccctgatgccccatcactgatatccacagaggggccaacattccactccctaaccccttccaacctctttacagccactctacaccccttaccacccgactactctgccaccctctcttccaccctgttattccgcgcaaccccaaccaacgactgcctacgcaagcacttcgcaccacagtcccgctcgctacacacatccatccacccctttggcatcctcacattgcactgcgctacgtcccagcactgcaggcacgcctcacatccacccctcctgcacccaccacagggcaacgccgcgccgcaccgccactcgccacaccccaacctccacacccaatgacgccgtgcaaatcgcacaatcccacctgcccacccctgcgccaggaaggcaaacacacccacagagcagccccccgaacaggggcacggatcccacggcggccacacccataccccacaccacaaactccggaacccagcagcgacgccacccctcaccagtctacacaggaaaacgacaagcatgcggaccacaacagtgacacacacacccaccacg

SEQ ID NO: 640305 - DNA, 128 bp, Homo sapiens
  misc_feature (95)..(95): n is a, c, g, or t
aaaaatttttttgggttgggtttgggggggcaaaaatttaaaacccccccaaattttgtaatttttgggccgggaaaaaaaaccctttttttttncggggcccttaaaaaatctttcccttttactta

SEQ ID NO: 640306 - DNA, 862 bp, Homo sapiens
ccgccggcggggttggagctatagaggctttattcgcgcggtgtggccttccgcccccggtgaatgttagggaatgacgaccctttttgcgtacacaacggatggggggtcttcgaggccgatagaaagcgccgctctatgtgttctctcgcacaagggtgagatacccacacgctcactctgtgagatggctcctttcgccctcttcgtagatacaatagggcgtcctgagggaaaacacacttccatgtgcagagaatgataacctttgctaaaatcactcgcctcccgtaggacataacaagacgtgttttagttgcgccgctcatctgtagggctctcccgccgccacacatggttttttctcttgcgctctcggttgaacagccgtcccccccgccctagtgtttataaatgtgtggaaagtacatcaaataatgtcgcactcgttaacagtcgtcgtgagcgtgggagagggccccaccacttaatttctttgtactatccgaggagaaccctggaggggcaagcacaggtatctcctgggcaacagaggggcaccctctaatatatatatatttctcatcgcgcaaccagcacataggtggctatttataaagcttccccgactgtgtgaggatgagtgtggtggtgataccctcatgcaagtcagtatggttaatcatgagtctcataaagcagcgggccgccgcatgaagaggtgtccgctcgtgcacacacagagcgggctccctctgtctggcggggcatatcttacacggggcgacccatgttctctgtaagcaaccttaaagtgttctttgaagatgacggacccctcgccccacaaatgtcagagcag

SEQ ID NO: 640307 - DNA, 430 bp, Homo sapiens
  misc_feature (97)..(97): n is a, c, g, or t
actagaggatcctgggatggggtctgtagtcagaaaaatctgggagttcagctgggcatgtctccgaagctctgaacagcccctggtctcagactgnagaagtggtgctggctccaatcctcactcttcccaaatctgtcttgagctccccaggcctgtgtctcacccatcttggtgttctcaggacctggaatgtggaaattttcaccaaacaggtgtctactgacttacttctgcttgtgctacccttggcacaagtttcctcccttctcaaactgtcaaactgctgcctgtggtttgaggaccagatcatgtggtcaaaagtccacatgagctgggattcaaccacaggcacctctctagcccagtctgaattaatccttatcactctcaagttccccatggctcttttgacttactgaagaatggg

SEQ ID NO: 640308 - DNA, 1768 bp, Homo sapiens
  misc_feature (1049)..(1049): n is a, c, g, or t
  misc_feature (1067)..(1067): n is a, c, g, or t
  misc_feature (1113)..(1113): n is a, c, g, or t
  misc_feature (1115)..(1115): n is a, c, g, or t
aattagtgtttgttccctatataacttttaactttataggtaaatatttgtttctttcagctccagttttatgtgaaatagagttttcagatttatgtagcatggaaagttttaatacgtcagagttactgatttttgccaatcattttctcaattatttcttttttatctttagttgatttttttgtagtgacacattttgtttctagtctcatttccttttgtttatattctatgtatatttcatttttggttactatgagaattacatataacatcctagagttataacattttaatttgaatttatttcaacttaagttcaatcacataccaaaattctactgctatatatatagctctactctttttatgttattgatgtgacaaattatatctttattcattgtataccagctaacagatttacaattacattttatgcatttgccttttaaattatgtagaaaataaaaagcagagttacaaaccaaaattacaataggactgtttttatgtttgtttatgtatttacctttaccagagagctttgtatattcatacagcttgcttatttacttatatagttattgcctagagttcatttatttcaacctgaaggacttaacacttcctgaatgtcaaattcagggataaatggatttttttcagttttaaaaaaaaatccggaaatgtcttaatttctccttcatttttgaaggataagttttccagctatatatttctcaattgacaggtttcttcattattttaaatatataatccactgcctactggccttcaaggtttctgccgagaaatcagctgctaatgttatctggatccctatctgtgagagttgctcttctctctgagttttcaacattctcccattatcttttgtttgtttttgagacaaataattgtacatattcatgggatacagagtgatattttgatacatgtatacaatgtccaatgatcaaataaggataattagcatatccatcacctcaaatatttgtcatttattgtatgtgaacagtcancattctttcttctagttntttaaatttataaacatttaaattttattacagaaatttaaatttntngattctgaaaaagtcatatatgtatgcaacatttttatcatttatttatatatttatgcatctttccttttagttttgacagagattttctattttatcattatttcaaaagaactcttacctgtatttatttatcaagtatatttcccttgttttttcctagtatattaatttatttacttatcttctaaaaatcctccatataatctgtttattttgtttcctttctataatttcttcaataattagttctgttctattttccattaaaatatttaaatcttgtatgaatttttgtcagattagaaatttagggcgtttcttaatttctctatactctagcttttgactttttttttctgacctaagaggtatttagagcacattttagattttttattttgactaatcatttaaaatgtatactaatcttcaatttaaataaaaaactggtctatagtgacaaaaattacaaatgagcctaactaataaattatcagctgtatttatatgtataagcctgcacagattttggtaaatatgtacatagtatattggtgagcttatttttatcattcttaactcattgtgtagtctaaacgttggggaaaaaataaaatacaataatcagatggtgtgaataagaaaaaaaa

SEQ ID NO: 640309 - DNA, 179 bp, Homo sapiens
ccgagagcccttaaccctgcgagagcccttaaccctgcggaagcccttaaccctccgggagcccttaaccctacgggagcccttaacccttctccactgaccgactttccatccatgcacacaacttcagtaggtcgatggcttgtactgtgccagggttaagggctacccgcggtacc

SEQ ID NO: 640310 - DNA, 1006 bp, Homo sapiens
  misc_feature (151)..(152): n is a, c, g, or t
  misc_feature (830)..(830): n is a, c, g, or t
gagagagaaagtggagggtgcaggagaaggaggggctgcccaccctcgtcaggaaaattactgggagccacgaagcatagagtccctgatgaacttctgtgctcatcagagagcatgctgagccatcttcctacccgaatctcaagcatcnncaagttcagttcaagttccatccatgagacatgtgtgagaacctgtgccggtgctgggctgacagagtaagtaagaaatcatccttgctgtcccaaacagcaaaggttgctggggcccacatagctggactccagtgatatcagtaagcaccaagaggaagggctgcccaggagaggtcaaggagtctgaaggaagtgaccactgaactgagcctgccaggccaaggacaggcagtggggtgctccaggtaagagaacagcgtgtcccaggacacgagggtgtgagaaatccgtgccttctgggcatggcccattacagaaaccagagtgtggggctagagaggccaggtggctgggtctgtcgtgccagaatggagggctggcctgctgtgctgacaagctgggccctgtcctgagggtgtcaggaggggtgtgacagcacccaaggccagtaaacagcttggaagtggttcaggtgaaagctgatgaggcctgagctaggcgggtgcagtggggatgagggaaggataggctggggatctcctgagtggactcaacaggacttgtttctggggtgttgaaaatgttctagaatgaatcccagcacttcgggaggccaagacaggtggatcacttaaggtcaggagtttgagaatagcctggccaacatggcaaaancttgtctctactaaaaatacaaaaattagccgggcatggtggttcgtgcctgtaattgcagctactcaggagggtgaggcaggagaattgcttgaatctgggaggtgaaggttgcagtgagctgagatccaaccactgcactccagcctgggcaacaagagtgagactctgtgaga

SEQ ID NO: 640311 - DNA, 315 bp, Homo sapiens
caaaaaggtttttttttggggggggggtttttttccccccccgggccgggttgggggaaaacccccccccccccccaagggggtttggggggggttcccccttcacccggggaaaaaaaaggttttttcaaaaaaccccccttttttttacccggggaaaatttttttttgggcctggttaaaaaaaaataaaaaaggggaatccggggcccccccccccaagggggggtttttcccccccccctttttttgggaaaaacccaattttcccgttttgggattggcccccaaaaaaaaaaaattttccccccccca

SEQ ID NO: 640312 - DNA, 383 bp, Homo sapiens
ctcacacttctttttcctaaacaggacggaggtgacattgtagctcttgtcttctaccagctcaaagatagtggcatacatctttagcgggtctttgtcttctctgagaatagcattccctgccagcaccaccaatacaagggagtgctcaaggtcggagcctccgttgtgactacaacctgctctcgaccccctctcttggggtttaaggagttgtctcccgcatattgtattcacaacggacgctccgaccttaagcggctccccacagccagcaccaccaatacaataggtggtgctggctgagtactattaggcttctttgaagtcagccatgatcaaaggctgtcgagaacctccctaccccagcatcctgacagatg

SEQ ID NO: 640313 - DNA, 719 bp, Homo sapiens
  misc_feature (151)..(152): n is a, c, g, or t
gagagagaaagtggagggtgcaggagaaggaggggctgcccaccctcgtcaggaaaattactgggagccacgaagcatagagtccctgatgaacttctgtgctcatcagagagcatgctgagccatcttcctacccgaatctcaagcatcnncaagttcagttcaagttccatccatgagacatgtgtgagaacctgtgccggtgctgggctgacagagtaagtaagaaatcatccttgctgtcccaaacagcaaaggttgctggggcccacatagctggactccagtgatatcagtaagcaccaagaggaagggctgcccaggagaggtcaaggagtctgaaggaagtgaccactgaactgagcctgccaggccaaggacaggcagtggggtgctccaggtaagagaacagcgtgtcccaggacacgagggtgtgagaaatccgtgccttctgggcatggcccattacagaaaccagagtgtggggctagagaggccatcttcctacccgaatctcaagcatctccaagttcagttcagagttcccatccatgagacatgtgtcgagaacctgtgccaggtgcttgggctgacagagtaagtaagaaatcatccttgctgtcccaaacagcaaaggttgcgggggcccacatagctggactccagtgatatcagtaagcacaagaggaagggtgcccaggacaggtcaggcgtctgaa

SEQ ID NO: 640314 - DNA, 550 bp, Homo sapiens
tagcagagtagtgttccgtggtgtatttatggcactttttctttatccagtcctctgttgggggacgtttaggttgattccacgtgtttgctgttgtggatagcgctgtgataaacacacgagggcagggattgtttgatatgattccttttcctttgggtagaggcccagtagtgggattgctggatcgaatggtggttctattttcaggtctttgagaaatttccatactgttttccagaagggctgtactaatttgcattcccaccagcagtgtgtaagtgttcacttttctccacattcttgccagcatctattgttttttgaccttttttttttttttttttgaggcagagtttcactgtgtcagccaggctggagtgcagtggcacgatctcggctcaccgcaacctccgcctcaaaaaaaaaaaaaaatagcaactctactaagaaaataaaatcaaagataccaatgctgaaataacacagactttgaaattatctgataaaacttttaaagcagctatttaagggcttcagcaaacaatcg

SEQ ID NO: 640315 - DNA, 385 bp, Homo sapiens
ggcaaatccttaagttaaagttactgtcaggccataatgggcaatggtacgtgatttacacatgcggttgtttattctaccaatagcttatataatggtcttaatcgcatcccaatgacattgcaatgtatatgtttagataaattaaagtaaaggttccatgctctatatctccaaggcttcaccaatgttcctctcagatgtggcacaatatagcagcagatacctgcaaagtcctgttaatgtcatgttgtaagtcatgcgtttgtagcataagatcgctgtacatacatgtgcatagcactcgtaggatatatagtcctattagacatagcgtacagtggcatgcacctgtgaatcctgcacatattaagattgagatgag

SEQ ID NO: 640316 - DNA, 288 bp, Homo sapiens
gcacgagaatcacattttgtatggagttaaataaagtacagtgcttttgtatataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccctggggggggggccgggccccaatttccccttatagggagtggaataaaaattaaggggccgggttttaaaaacgtgggaacggaaaaaaccttggggtaaccaaattaaatcgcttggaaaaaaatccccttttcc

SEQ ID NO: 640317 - DNA, 149 bp, Homo sapiens
  misc_feature (80)..(80): n is a, c, g, or t
  misc_feature (109)..(109): n is a, c, g, or t
  misc_feature (119)..(119): n is a, c, g, or t
tttgtgggtcatctgtccccaactactgttggggaacagaccccctgtcttatgtgggcacgttaccaaagtttaaatgncatttttttgactcttggtccaaaatttnaggaagatgnctgtgcaatattcattttggaacttgtgtc

SEQ ID NO: 640318 - DNA, 517 bp, Homo sapiens
acgacccacggccacaaaccccaaaagcgtgtgacagtcagctaaccttatgatgctataactacgattcgggaagaagtgatgtactttaaagagagattctacatgcgcacaaatcccttctacccggaagttgagctcaattacatttctgttttctggccacaactgccaaatgggcttgaagctgcttacgaatttgccgacagagatgaagtccggtttttcaaagggaataagtactgggctgtacagggacagaatgtgctacacggataccccaaggacatctacagctcctttggcttccctagaactgtgaagcatatcgatgctgctctttctgaggaaaacactggaaaaacctacttctttgttgctaacaaatactggaggtatgatgaatataaacgatctatggatccaggttatcccaaaatgatagcacatgactttcctggaattggccacaaagttgatgcagttttcatgaacgatggatttttctatttcttta

SEQ ID NO: 640319 - DNA, 144 bp, Homo sapiens
ggagtgttgtgtccccccctatggaagcttgacaaggaatttttttgcagagcccccaaagggagtatggtcctgatgacatttgggttttgggtttctggcctcaaaaactatgagaataaatgtctgttgttttaagctcca

SEQ ID NO: 640320 - DNA, 346 bp, Homo sapiens
gagatggagtcttgctctgtcacctaggctggagtgcagtggcacgatctcggctcactgcaacctccgcctcccagatgcaagcaaattttctgccctcagcctcctgagtagctgggattaaaggcacgcaccaccacgcctggctaatttttttgtatttttagtagagacaggatttcaccatgttggtcaggctgatctcaaactcctgacctcatgatccacctgccttggccttccaaagtactgggattacaggcgtgagccactgcacccagccttctagtttcgtattttttttattcaagtaacaaggaaaaaataaataactccaccaagagga

SEQ ID NO: 640321 - DNA, 364 bp, Homo sapiens
ggtcgtagcggcggcggcgatatccatctttcccatccctcctcctacgtcgatcgtcgtacgcgacgttgtacgttcggaccggtacggcccgaagcatggccggcgatagcttagacggccaccgactggagctgctggcggcttacgaggaggtgatccgagaggagagcgcggccgactgggctctgtacacatatgaagatgtactccgatgtcctctagctggcagctatcaggagaagggggcttgcaggggctttcgggacactttgagaaccagaaggtgatgtacggcttctgcagtgtcaaggtctccctagctgctctgccaaaatacgtgctcatcaactgggtgggcgaa

SEQ ID NO: 640322 - DNA, 333 bp, Homo sapiens
  misc_feature (96)..(96): n is a, c, g, or t
  misc_feature (291)..(291): n is a, c, g, or t
  misc_feature (313)..(313): n is a, c, g, or t
attcccgtgggacgtgcctcggcagcgggagctcatatggctggacatgtacagtatctggtatatgtggctgacacggcgactccagaaggtgangctgctctgccggaaggggatcccctcctctctcagagacagagtctgagagcacctgtctaatagcaaggatcttctggagcagaccccaggaaagtgtgatgagctggaacggtctcctggagaccccatgttggtgtatgtgattgagaaggactacaccacagctccctcacaggatatgtgtgttctcgngggggcatgaaaacagcactgnactattctgaggctacaaca

SEQ ID NO: 640323 - DNA, 262 bp, Homo sapiens
tcgatctagacggatccccccaattcgcggggaggctgggagaaccggtaaacgtgggggccagttgacaacagaaacagaagtccatatgcttcaggaggggatagctcggcggggggggtgaggggggccattggtttctctattacacaggggaaaactcccgtgtgtatcatcgggaagaacccaagtgctgggaaatatacccccagcaagcggatgccagggaacggtggctgggttcttatccagagttggtgag

SEQ ID NO: 640324 - DNA, 415 bp, Homo sapiens
ggggggcccatctctataaaaaatacaaaaattagccaggcgtgggtcacagctacttgggaggctaaggtgggaggatcgattgagtccaggagtatgaggctgcagtgagctgtgattgcaccactgcactccagtctcggcgacagagcgagaccctgcctctgataaataaataaaggagaggacagcaagagtagatgctgagcaggcaaagaccaaatgctcttagggaagaaaaaggaggtagcaatttaatcagcttcctttctgtcaaaaggctaagccctaagtagtttgaatcctaataaaatattgcttttgttgttgtttgtattagagacagggtgttgagcaccaccatccatgcccagctaattttcgtattttttgtagcaagagtctgccaaaaaaa

SEQ ID NO: 640325 - DNA, 892 bp, Homo sapiens
  misc_feature (418)..(418): n is a, c, g, or t
  misc_feature (420)..(420): n is a, c, g, or t
  misc_feature (423)..(423): n is a, c, g, or t
  misc_feature (446)..(446): n is a, c, g, or t
  misc_feature (451)..(451): n is a, c, g, or t
  misc_feature (470)..(470): n is a, c, g, or t
  misc_feature (633)..(633): n is a, c, g, or t
  misc_feature (670)..(670): n is a, c, g, or t
tttcctattttatttagcaggcattttctttactgaggtttatattgtctgccaaaactaggaggaaaagaaaatattaacaaccctgaaagctctttcattctgaattattccttaatgtttttaatgatttattataaccacacaaatgtgatcttggggccatttggaagttattgagtttccttggagatgggacttggcattttccaaaccagagtttgcttttgtggcctggaagttgcaaggcatatatatttggaagactaaagattattccccaccaagaagttttgtcaacctgaccttctctactcttatgacgctgcacacacagcagtaatctctgcagaggagagcaaataaagtgaagaaatatagcggtacgtgttatttttacatcctaaagtaaattctncngcnttaaggctgactgggaatttccntctcngagttctcatgaatgctgntccactttggtgttgtctcttgaatgctttttattataggtctttgaaggaggtatttcttggtatttattcagccagagagagtagttgatgtggaatttgggaacacaggggtgtgggagcgctctctgggtgacctgtctctccgttgaccttcaggttntttatgtgcctcaccagtcaggtgaggctagtcaccnattagaacaatgtactagtctggtatgatctttgccagtctaatacttggaatggctcttaacctatgtccgggcaagatggggccccccttgaagccttaacctcggtaaagagagtttctctccgtggttgaggttcccaacgcttcaacccgcctcgcagttctgggtttgggttccccccccaaaaaaaaccgttggggcgtcttccaaaccttgtct

SEQ ID NO: 640326 - DNA, 343 bp, Homo sapiens
tccattgggggctgagaccaccccttgctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtct

SEQ ID NO: 640327 - DNA, 487 bp, Homo sapiens
ttttttttttcgcattttggaatatctgcatatacataatgagctatctttgggatgggacccaagtctaaacatgaaatacatttatgtttcatatataccttatccacatagcctgaaggtaactgtatatgatacttttgataatctggtgtctgaaacaaagtcttgactgcattttgactgtgacccatcccatgaagtcaggtgtggaattttccacttgtggcgtcatgcaagtgctcaaaaagtttcggatttggcagcattttggatttcaagttagggatgcccgatctgcacaactgttcattccagcataccacagggccacaagagaggcacggcaatggctcagcaactagatttgggcaatgagaggggagaatgggagggaaggagagaaaggcagaaagggcaagggggcagggcgctacagatgcagagcaggccaccaggatacccagagcagcggcatggtgcagag

SEQ ID NO: 640328 - DNA, 1138 bp, Homo sapiens
agcggctgtttactgcgaactgggttttgccagccatcaacacacgagtgtctgtgaaatactacccctaatagagccaacaatgggcaataggaacatcatcgtcgatatcaacatctgtcgtcgattgtgcacaccgctagcattcgggggcaacacgtccaccactacctgggccactctgactctcataaatgcagcgatgtgcactctggcacaaaaagcaacctagttgaggacaagatgttcgagcaagggagtgcgtgactgagcatcgggaagaggggctcctatcaggctatggcctgagctctctgggaatcaaacctgacatagcatgcagcgtgaacgatgagtactcggccacttgaatagtctcacttgtgtgaaattggagaccgagccagtaacgtaatgtgacttatcgattaagatgttcccagggacgacagtaggacttcatcaaagaacttgattgaccgggacatctcacggctgacatgtgcctagtcctcgacttagtgggctgctgggtgatcgggtcgacattttagaacgtcgtaggtaatcgtccaatgaattgggcacgagcccgaggaagcatagcccttctaggccttacatcatgtgcggctgtgaagacaaactaagtctagtcgcgctgtgtgacacaatggcactgggatatcgcgacatggaagtcccaactcactaacaagcacgaggttggaagcaatagtgccacgggatggattttgccttaacgggaaggtgcaacgaacctttacccactttaaggcaaacgggttagggaactacagaaacccgggggaccataaggaagccattttggtgccaagtaatcttgggtagggaacatggggttcgagcgagcgctagcttggagaaggcccaaaagttggctaaacccaaatggccgcttgggtttgtccaccgtgtggaatgagtgaaaggaacaccccccggacacgggagttcgggcaaattagcgaggttggaaagccaaaaggcatgggttggagaggctctctggacactagagtaccaaaaccccagcccaaaagtgtaggtcccaaggttggaccaatgccctttggagcgcgtggcggtctccaag

SEQ ID NO: 640329 - DNA, 97 bp, Homo sapiens
agaagatggtgagtgcagcattgatgaagaagtacatccatgtggccaaaatcataaagcctgtcctgacacaggagtcgccacctacattccagag

SEQ ID NO: 640330 - DNA, 426 bp, Homo sapiens
gacgagcttatgggatcttttctaaccggggtacatcacgaggcccgcgacacccccgatttacagaagtcgactgagccattgaagcaaatttagagacacgaaatatgatgagatgggtagctgtaccagtcaagcaaaggcctttacagcgatatgcccggtgaaggcgtacgactcaatagaccgctcaacacagtttcctcggatactatattatatgcgctggaaatgcataagagctatatcctactaatagacacgtctctcggtcagctattgatcaaccgtaactcgccgaactaatgcaagttagaccacgagattacggacgctaaagattactggcctgaccgcttcagcaggcctcatgccctaggacgtcacataatatgagcctcgggctagataactagagcttcggcc

SEQ ID NO: 640331 - DNA, 810 bp, Homo sapiens
ggattctgggttgcaggtaggcacggactaggttcatctgtctctgtgtgagcattccagacgctcccagggcctggcggggccagcttaccctcatagggcttggttctcacagtgcccagtcgacaataaaccatgctgccggcacttagtaacagagctcaggccgcgtatagccagccgtcgcgtccctcatcagtggggtgcccgtcatgccgtggggggttcgctgccagaccgtcaggtccagggtgttcatgcagagcaaggtctcatgtcataggttgctataggccgcctaggggacacctagggcagaggcaccaaggtcacgaccgtccgcagagcttgccagcgaagtttctagctttaacttattactggagagcgactttctggtttccgtctcttacacgtagacaagcagctcaatcgcgcgtcttgccaatgtcccccttgttggtggctcattgcgtggcaccaacgggttccctcgcgtgtgccccctttgtcacttcgtgtgcatcactggctatccacgcgataaggtggggagatcagctcaaagactagaaagtactgtggcaagcgcgtcggaaatgtgacagagacgtgtggccccagaacatacttccaatcgccagccaatctccccgtggggtgttggaagggcctgggcccaattgttccctggagctgaaaagcagtgccgaccaggttcaccccaaccttgctggtgtgcgcgccagggggttgtgccccgtctcccctgtggggcgtggcaagcctttggggggagaagcctcccca

SEQ ID NO: 640332 - DNA, 225 bp, Homo sapiens
ctcggtaccctgccagtagtctacaattcattgcattttcgttctgcacaagctgcatacatttgagatactcttgcatgtacttggtgcattcgccgtcgtggtctagcgggaacgaacctctctcgggtggagtaggtctcaatgcgctcagcgagcttcctgggttccctgacattggattcttgtgttatgtttcgtaaaagatactttgtgtgtagtggg

SEQ ID NO: 640333 - DNA, 370 bp, Homo sapiens
  misc_feature (178)..(178): n is a, c, g, or t
ctcagtgcgcttcgttgtcttctaagctgtagtctagtccgactccctatcatacaatctataagacacgcaggactttcccggtccccagtatacataattgaagaaaaatgatggaagagagtgcgatagagacaataacacctggtactcctccaccaaatcctgcagggctggntgctactgcgatgtcttctacccctgttccattagcggtaagcaggtctttttcttcttccaattgaatcgtccacggagtgcgttcccatcactcgaatagtatactccatcagtcgacccttccttctgtgtgggcgtgcctcaccataactatctgtggctcctcctgcagtcccttctgtcgtcttct

SEQ ID NO: 640334 - DNA, 150 bp, Homo sapiens
aatcgagctcggtaccgtcctcatctgcctcccatacctacgcatctttacataacagacgaggtcaactgatccctccctttaccatcaaatcaattggcaccaatggtactgaacctacgaagtacacctgaacttccgtgcgagtac

SEQ ID NO: 640335 - DNA, 180 bp, Homo sapiens
cccccaaaaaatttttttttaaagggggggggggggggggggggggggccccccccccggggggcgcccccccccttttttcccccttttttttttttccccttttcccccccggggttaagggggggccccttttggggcccttggcccctttttttaccccgggggggggggggggga

SEQ ID NO: 640336 - DNA, 399 bp, Homo sapiens
acacctagcgtcgggatggtccgggcagtccaaccatcccagggaattcctttaataccctaaaaattacaatgaattataattgggtctattcttattatttaacatactgaatcccatctccttcagaaatcatctcttttaacaatctgtttcacctttaaaaaaaaaatctcttaggagattattcttcaccttggtctatttagccacacttataacccagatactatttgagccagttctctatgtagagaggtatatgggataccacaggtggcccacgggacccagggcagcagattacaattggggatttgcagcctattggaaaaatgtggcgcttattttggagcaaaggtaaagaatttttaccccagcattgggaacacgcaacaa

SEQ ID NO: 640337 - DNA, 291 bp, Homo sapiens
  misc_feature (112)..(112): n is a, c, g, or t
  misc_feature (166)..(166): n is a, c, g, or t
  misc_feature (223)..(223): n is a, c, g, or t
cttgctggaaaccaggcgggaagggtgagtctcacgaggagaaatcgtgtagagctgaacttgacgcctcagtgatatggcagcccacacgagcagtctggattatgtcatntgtggttttaatttttgattatgcaagtaacaacatggatagattccccttgtngaaggcttgactttatggctgtggccagtccccttagaccctcatcatcactggtgntccctctccagcctgaagctgctcgtcacgacagttggcgatgcatttgtcgatgtgcgtggacaggt

SEQ ID NO: 640338 - DNA, 409 bp, Homo sapiens
  misc_feature (392)..(392): n is a, c, g, or t
gttttttaagcctgtcggaaaagcacagtatttgggtgggagtgacccgattttccaggtgacccgtttctttgactaggaaagggaactccctgaccccttgtgcttcccgagtgaggcaatgctcgccctgcttcggctcgcgcatggtgcgagcacccactgacctgcgcccactgtctggcactccctagtgagatgaacctggtacctcagatggaaatgcagaaatcacccgtcttctgtgtcgctcaggctgggagctgtagaccagagctgttcgtatttggccatcttggctcctcccccttctcttttgttatggagtgggtcagggatgtcctctccggggtggtggtattttgagcagacatatgggataaagtatgggnagtgacacacaaatttt

SEQ ID NO: 640339 - DNA, 400 bp, Homo sapiens
caggatgactgatccgcttaagggaactgaaggcgtatgtgattgggacaaaaaccaaatgataatggattttataggccttgttgtaggtattctctagatggaagcatgtgtactatagccataacatattcatgtttcatttcacgctatcactttgactgcactttggaaagtggtttggccttatacgtctggaagcaagaacaatcacttaagaaaagctgttgcagtaaatctaaataggatgactatagctagaaccaaggaatgggcacaggtagtggaaagaccagattaattatatcataaggatgtagacttgttagaccttgatggttgaatgtgttgtgagatacatccctggctccaccccctactgtaaggtttctgcttaagc

SEQ ID NO: 640340 - DNA, 339 bp, Homo sapiens
  misc_feature (23)..(23): n is a, c, g, or t
  misc_feature (43)..(43): n is a, c, g, or t
  misc_feature (49)..(49): n is a, c, g, or t
  misc_feature (123)..(123): n is a, c, g, or t
  misc_feature (129)..(129): n is a, c, g, or t
  misc_feature (170)..(170): n is a, c, g, or t
ccccaagtttagtgccaaaatantgatgaggttttactgcccngtgatnaattatatatacatgctgtgcatggtggctcatgcctgtaatcccatcactttgggagcccgaggcgggtgaancacttnaggtcgggggtttgagactagcctggctaacatggtgaaancctgtctctattaaaaatacaaaaattagctgggcttggtggcgcaggctgcggtcctagctactctggaggctgaggcggaagaatctcatgaacctgggaggcagaggttgcagtgagctgagattgtgccactgcactccagcctgggtgacagtgagattgtctc

SEQ ID NO: 640341 - DNA, 139 bp, Homo sapiens
aagaggaacagagcttgtgccaactgtcaaacttgaaaattgtggacttgttcagtgaacagacacgggtgaatgctgctaaaaacaagactggggtatagcggtggtatagatgtggtataggggtggtatgagtggt

SEQ ID NO: 640342 - DNA, 745 bp, Homo sapiens
  misc_feature (10)..(10): n is a, c, g, or t
  misc_feature (31)..(31): n is a, c, g, or t
ctggcgcgcntacggcgtccaaatcttaganggctggaccttgataatcatataaatcgtcatgcattatataatttatgagctactgtactttcacattaattaaaaatattaggagactctaatttaaccacttctgaagaaatgaatggctgatcagaaaatgtcaaattactatcataagcccaagattttatcataatcatgaatagcatttaatcatgaatattattttttaacttttaaaaccatacttacagttttagattaaaatcccatattgagtcaacaagactttactccaaattatagccacatatggaagaaaggttttaattcaatattttattatagtccacgcctcactgatccttcttatgacggccacctgatggatacctaccctaagaaatatgctgtctcagggtggcgcctgctcactaaacctgcactgcacctcgcgactatctttaccccgcacctgtctttctgccaccttttcctctttgctctagcttctctcggcccctgagtctcattacttatcccatcccatttctcctcccgcaactcgataatcccttcaaccccgccggcagtcatcccctccccacataccctaacctccctgctgtcgcccgccgaaccccgatcccctcccgtccttgaaactgttgtttgcatcaatgactgtattaattaattgttcctagttgtatagtccccgagagataagatgacatag

SEQ ID NO: 640343 - DNA, 204 bp, Homo sapiens
  misc_feature (53)..(53): n is a, c, g, or t
ggggggtggcgatggttccgagggaggggagggagggagatttagcggcacgnctctcttatctaccaccggtacaccaacaagatactcaaagcttactttgtagtctcttcaacatacttgagggggtggccacgtgaagaatgccgtgacagatttcagagccacgcccttgccattctgctgtgcagggtccttgctgct

SEQ ID NO: 640344 - DNA, 289 bp, Homo sapiens
cggtacccgtcagacgctgaactatgtgaatattaagctaagtggaagaaaccagtcacaaaaggtcacatattataagatttcatttatatgaaatgtccagaacacgcaaagctatgaagacagaaaccctgtctctactaaaaatacaaaattagatgggcatggtggcatatccctgtaatcccagctactcgggaggctgaggctggaggatcgcttgagtccaggagttctgggctgtagtgcgctatgccgatcgggtgtccgcacatagttcagcgtctga

SEQ ID NO: 640345 - DNA, 388 bp, Homo sapiens
  misc_feature (3)..(3): n is a, c, g, or t
  misc_feature (13)..(13): n is a, c, g, or t
  misc_feature (29)..(29): n is a, c, g, or t
  misc_feature (58)..(58): n is a, c, g, or t
  misc_feature (64)..(64): n is a, c, g, or t
  misc_feature (69)..(69): n is a, c, g, or t
  misc_feature (74)..(75): n is a, c, g, or t
  misc_feature (86)..(86): n is a, c, g, or t
  misc_feature (92)..(92): n is a, c, g, or t
  misc_feature (117)..(117): n is a, c, g, or t
  misc_feature (119)..(119): n is a, c, g, or t
  misc_feature (125)..(125): n is a, c, g, or t
  misc_feature (138)..(138): n is a, c, g, or t
  misc_feature (143)..(143): n is a, c, g, or t
  misc_feature (163)..(163): n is a, c, g, or t
  misc_feature (171)..(171): n is a, c, g, or t
  misc_feature (177)..(177): n is a, c, g, or t
  misc_feature (180)..(180): n is a, c, g, or t
  misc_feature (188)..(188): n is a, c, g, or t
  misc_feature (240)..(240): n is a, c, g, or t
  misc_feature (242)..(242): n is a, c, g, or t
  misc_feature (252)..(252): n is a, c, g, or t
  misc_feature (256)..(256): n is a, c, g, or t
  misc_feature (321)..(321): n is a, c, g, or t
ccnccaaaaaacntgggaaacacactgtngcgcaaaccactaagtgtttctaatcaanatgtgntggantcccnntttttggtaanacatgnaacattgaaactgttcccctgaatntnaacctnatagattaaaaanctaanccatgtggcaatgaccccanttatttgncgaaancgnaggagttnaaaaattgttgaacagctgtacccttagacctcggaaagtaaacatttcacnanctgatatcanggtnactgacaacctgagtgcaggtggactggagatgttggctgagattttgtggatgccaaccctggntcgtgtgtagacagggaaaacatgctcccaggctatgtcctgaagcttcacatgtgcccatttcatt

SEQ ID NO: 640346 - DNA, 856 bp, Homo sapiens
gacggagtcccgctctgtcacgcaggctgcaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagttgcaggaatttagccaattcagaggtcttgttctccataatttggaattttccttcggatttgatccagttggatagagttggtcaaacccaatgggaaaaagatgaaaacaacaagaaacagaaacaaacagcaacaacaacaacaacaaaaacagttaagtgaaacaaacaaacaatcacacaatttatgtggtcactgagtgctctaatagtaaggagaaattaagaccagctggctgttagtcttaactctagcccagacctccaattcagctacttacctagtaatgagtctcaggctgaagtctgctctctcacatcctagaagcaggaaacaactgaaactcatcttcccggagggaacgagctcaactcccgaacggagtacaggcttcatcatcaggcggcggacattggcctcctggtggcagaagtacctccacaagagtgccggcataactgatccacattgggacagccccgggacggtgcccgccccaaggtaagggcccaaaccagcgccccgataagtaccgacctcaactgcacgtccaactgcgccatgaggccccccaggagagatttaataggatttacgcccctcc

SEQ ID NO: 640347 - DNA, 554 bp, Homo sapiens
ggaaattcccgtatcatagctaatagcctcgaagggctctcggtgacgaggtattcaagacgggggctgagaaatttattcttgaggcagtgcgtgctgacactctcaagctgtgatgttgcctcttatttcactgagtaatgggaagcaaacaggacctccacctgctcccagaaccacaactttgctccctgcgaccttcctgtgctcctaacctaagtccaatccctctcctctgggtgggacatgtatcgaagaacgccctctggcagttgtgcgcattctctgctccccactaatatttccttcttgactgggttatttccagaagcgtgcaaacatcctctaccatctcccagtgctaggtgggactcttgaactcactttccactccagctgccaccccatttctctttatctcttcatagcaaaactccttgaaaggatagtctatacttgctgcatccattcctcctagtctctgttgaactctgtccactggagcttccctcctgaaacatgctcccaccccaggaacagttcctatcaaggtc

SEQ ID NO: 640348 - DNA, 378 bp, Homo sapiens
aagaggtaagacatctgcgtaggcaccatagggatatagtaggcgaacaggcggcatccagacagtacctcggcaactagtaggaggaaggcagggtagaagcaggtcagcgctataggcccagtggctgagtcgcccaggcctttcgtggagccccgcttgggtcctgactctgaagctagggagctcatacatcaaaacagcttcaacgaaagctagactgtggcagacagaaggacctccagctagtacctagctaccaagcaaagccatgtactcagagtgcccaggagcaccccacctacatcctccagaaccaagctcagggcagctctccctcagccctccccagactggctccagacccgtgccctccat

SEQ ID NO: 640349 - DNA, 481 bp, Homo sapiens
gccggaaatgccggggtcgactaccactatacattttcggccgtgtcgtttgaaagtgctgtcagtaacccagcctaaacccccaaacagcaagcaatgcaggtgtagaagcacggtggctaggaaaaactccctagaaaggccaaaacctaggaagaaacctagagaggaaccaggctatgtggggtggccagtcctcttctggctgtgccgggtggagattataacagaacatggccaagatgttaaaatgttcataaattaccagcatggtcgaataataataaggcagaacagttgaaattggagcagcagcacagtcaggtggactggggacagcaaggagtcatcatgtcaggtagtcctggggcatggtcctagggctcaggtcctcagaaagagagaattagagagagcatatgtggggtggccagttatcttctggctgtgccgggtggagattataacagaacgtcgacgc

SEQ ID NO: 640350 - DNA, 430 bp, Homo sapiens
ctaacggcaagccacaagtggtgcgcagaaattgtcatccgccaagaccatcatcagatgcaggttattagcctaccgcagtgcatatgccatagcgattgccaatctcggctttcttcagagcatgaccatctttcatgccttcgcctgtcctagctttttcctggtcttaagactgaagaaattctacatttagacttgtgtgacggttccctcgagctaaaacagcgggcgttcaggcaggcgtctcgctaggcggaggggtccgagttcatcaaactcccggcctgtgaaagcttttgacgtcacgtcctcatcctgcccgaagatgccgatgcggcgacagatggccacagcagtgcccttgttgtccccagtggtcatgatgacccggatgcctgcttgccggcacagcttcacggaggaagcc

SEQ ID NO: 640351 - DNA, 137 bp, Homo sapiens
actagaggatcctatccccggatctgggtacagcagcaagcgttgatctcaggcacttccaggctgtcctgtatggaggctgacgacgtcacagctccttacagccttcttgagcatctccgcccaaagccaggcct

SEQ ID NO: 640352 - DNA, 304 bp, Homo sapiens
ttcccacttggtaaacataccagtgtccagttgtacataagtgacttttactgtatgcattcaaggtaacaggtcgggctgggtgtgatggctcatgcctggtaaatcccagcacatttgggaggctgaggcggtgcagaccacttgaggctagcgagttcacgaccagtctggccaactatggtgcatagctccgtctctgttaaaaatacaaaaattggccgggggtggtgacacatgcctgtagtcccacctacttgggaggctgaggcacaagaattgcttaaatctggggattggaggc

SEQ ID NO: 640353 - DNA, 208 bp, Homo sapiens
aggtgatcttctgctgtgtagaaccatcaccctactcctacattttacttgtagtgtggcatgagcggtggtcaggaccacacgtcctgtctcgtaatattgtgaacttcgtttccgccttgcatcgcagacctcctacgcctcgtcgtttcattgcttccacaacccattgtgggcacgaaggacctcgcgctactgctacgtgtaa

SEQ ID NO: 640354 - DNA, 271 bp, Homo sapiens
tcccgggccaggtaaaatttaaacatttttttaaaaagttaaaattccccaaccccaggggagaaagggttttagccattgaaggacgggttgaacccaggtccttttggaacttaaaaaacttttaaacccctggccccctatagggaggcgtattaccccacccatggttttgtttgcccccgggaccccatgcataaactgttaacaataaaaatgggttcgaaaaaggggggaaaatcaatagttgccactaaaaaagttttggagg

SEQ ID NO: 640355 - DNA, 591 bp, Homo sapiens
agagatcctccagatctgggccccagtcttcccattttacagtgggtgctttgcccagcatgacggaggccctccctggacgtaatcctcaatgttctcactaccccacacacttgcacagaatggatgatttatttcataggttacattataacctcaaactctgcctaggcaggaaaagcaaagaggtatggcagtctgctctcctcgggtgacttctgagcttaagaccaccatactctgcatatcttgaatttttgacttttatgtccaagccctaagatgttcccatatgctgggcgtggtgcgtgcgcctttaatcccagcacttgggaggcagatttctgagttcgaggccagcctggtctacagagtgagttccaggacagccagggctacacagagaaaccctgtctcgaaaaaccaaaaaaaaacaaacaaaacaaaagaataaatatttaaaacgtagtagttaggatttatgtggggttaataaagtagttaggatttatgtgggatgtaggtttttcaagattcatgacttcccttaccctgggagtcgacgcggccgcgaatatcgtagtagtagta

SEQ ID NO: 640356 - DNA, 621 bp, Homo sapiens
  misc_feature (351)..(351): n is a, c, g, or t
  misc_feature (368)..(369): n is a, c, g, or t
cccaattatatggccagttttagagaagattctgtgaggtactgagaagaaggtatattcttttgtttgggggtgaaaggttctgtagatatttgttaagtccatttggttcaaaaacatgttattctcattgtttctctgtttagtttctgtttcgatgacctgtccactggtgggagtggggagttgaagtcccccactcttattgtgtggggttcaatgtgtgatttgagctttagtacattttcttttatgaatgtgggtgcccttgcatttggggcattgatgttcagaattaagacatcatcttgaaactgggcgtggtggcgcacacctttaatcccagcactngggaggcagaggcaggnngatttctgagttcgaggccagcctggtctacagagtgagttccaggacagccagggctacacagagaaaccctgtctcgaaaaaccaaaaaaaaacaaacaaaacaaaagaataaatatttaaaacgtagtagttaggatttatgtggggttaataaagtagttaggatttatgtgggatgtaggtttttcaagattcatgacttcccttaccctgggagtcgacgcggccgcgaatatcgtagtagtagta

SEQ ID NO: 640357 - DNA, 411 bp, Homo sapiens
tgcattttgactggttgtgcttttgagtactggtcttctcttgcaaagaaacatttccttaagggtgaggagtatactatctgtgcatataagaataaatacttagcggggcggtgctggcccatgtctttaatcccagcactttagaggcagaggcaggatttctgagttcgaggccagcctggtctacagagtgagttccaggacagccagggctacacagagaaaccctgtctcgaaaaaccaaaaaaaaacaaacaaaacaaaagaataaatatttaaaacgtagtagttaggatttatgtggggttaataaagtagttaggatttatgtgggatgtaggtttttcaagattcatgacttcccttaccctgggagtcgacgcggccgcgaatatcgtagtagtagta

SEQ ID NO: 640358 - DNA, 571 bp, Homo sapiens
  misc_feature (301)..(301): n is a, c, g, or t
  misc_feature (318)..(319): n is a, c, g, or t
gccatgctgttgttgctggatcccaaaggccagggccactcagagacagccagttctgaggattccctctggagtgtgttttcacaccaatagaaagaggctctcttttctcttggtgacttttccaagccatttagccatgagctgtaccatggtgtgctcttcatgaacaccaaatcattttcaggctggtactgatatgtgccttccttacgtatcttgtccacacatttgctggctaacccagaagtcttagcagatgtgaagtgtccaggttaagaagtcactgctcccagcactngggaggcagaggcaggnngatttctgagttcgaggccagcctggtctacagagtgagttccaggacagccagggctacacagagaaaccctgtctcgaaaaaccaaaaaaaaacaaacaaaacaaaagaataaatatttaaaacgtagtagttaggatttatgtggggttaataaagtagttaggatttatgtgggatgtaggtttttcaagattcatgacttcccttaccctgggagtcgacgcggccgcgaatatcgtagtagtagta

SEQ ID NO: 640359 - DNA, 564 bp, Homo sapiens
  misc_feature (121)..(121): n is a, c, g, or t
tttcaggaagaattgtaggctatctaaaaagacttgacagttcagcaatacagaggcttgcaaaacgttgggagccacctgtaaaaggtacaagataaggagggaattaagggctgagttnattggagttaaaacagaaacccgaatttttagaggaagaagagaaaggaggaacactgttgatttgatactgtgactggtccttggagagttagattaagtagcactgatttttgcctcaggtggtggcacacacctttaatcccagtactcgagaggcagaggcgagaggcagagaggcagaggcaggtggatttctgagttcgaggccagcctggtctacagagtgagttccaggacagccagggctacacagagaaaccctgtctcgaaaaaccaaaaaaaaacaaacaaaacaaaagaataaatatttaaaacgtagtagttaggatttatgtggggttaataaagtagttaggatttatgtgggatgtaggtttttcaagattcatgacttcccttaccctgggagtcgacgcggccgcgaatatcgtagtagtagta

SEQ ID NO: 640360 - DNA, 525 bp, Homo sapiens
tgctgtctagaggaccccgttatccgtacagtggtacatggcacatagtgcaaattctataaacatttgtagaatctatgtccatagaagctgcaacatggaaaacgagctttcaaattaaagcaagacagacaccagtaagacacaaaaggaattacttgatagtcaaagtaaaatctatacattgctgagtgctgtgggtctttaagaagagagtcactcatctgtcttaggggttttacaaattcactagcctaagtaatttatagtggttattcccaacaccatgatttaatacttcacagcatagaaatgaagtctggctagttataaataaatgatcactgagctattatgtgccgatcaatattctaatgctttccatgtatcagattatttaatcttcactattctatgagtactattctttttttttatctataaaatggtactctttagtcccaaaaggttaaataattggcccaaagttgaccagatcatagctggtggatctgggacttaaat

SEQ ID NO: 640361 - DNA, 497 bp, Homo sapiens
gcgtcgacgtcttagtcagtgttctattgctgtgaagagacaccttgaccatagcaactcttataaaggaaagcatttcattggggctggcttaccgtttctgaggttcggcagagagaatgacaacatgcaggtaaacatggtgctggaagaagtagctaagagttctacatcagaatacacaggcaagccgggagtggtggcgcacgcctttaatcccagcattctggaggcagaggtaggcagatttctgagttcgaggccagcctggtctacagagtgagttccaggacagccagggctacacagagaaaccctgtctcgaaaaaccaaaaaaaaacaaacaaaacaaaagaataaatatttaaaacgtagtagttaggatttatgtggggttaataaagtagttaggatttatgtgggatgtaggtttttcaagattcatgacttcccttaccctgggagtcgacgcggccgcgaatatcgtagtagtagta

SEQ ID NO: 640362 - DNA, 1575 bp, Homo sapiens
  misc_feature (1)..(1): n is a, c, g, or t
nttcgcgttttggttgcggagtaagtgggtcgttgttactaggtatcgactaatgtttcaatacacgagctttgtgggggatattctagcttgtgtgatgtgatctattctattagacacttcggtgtgcggataggtgtcgagtcccctgttgagtgagagattccataaatgtgttgttttggtatgcgagagattgcgcccaaagtcatgacgctcgtttcttaggtgatgtctctctgctatctcgattggtccttgctccatattgttcgttctgttcgatgccgccctgatgctggaacggcttaaaatattgggccggggtatcgatacgcataagttggttccgccctacaggacatcggtgatccttatgcttttaagggcgatgctggtcctcatatgaatagggcgaaactattatcgcaagtgatagggccttccctctctatggagggtccctgccacgtgtttgctgctccctgggcgctctttgccttctcgaagccttcaagattacttccgcgttcacatcgaggcggcggtgatagtgctttttgccttaaatactacggtcggttagtaataattagtcaagtgccaccgtgttggtgagttgcctctttccaactcggattgttgccgtcctgggactgctgttgttccagaggtgaaacccaaatattttccttggtaaacatcataggttgatagaaatcgcatgtgcgaaaactatatggtctatatttcggcgaaggcgtttctaacgtccagaatcgctctctgggcatatgtatccattcgaatcgttttgtaaaccaatggacctcgatctttgtatacttacctccctacgtttgcgtggtcggaaacctgacagtcagcgcttcagtcgaggctcagcccttgacaaggaggcggtcacactcctcgctcagtgattgacaggatcagggagatcatgcatcagaggctctctctcggaattattctgtctttcatgtggttcaagagtatctgtgttggccattgaatgtctttcaacgcagactgagatattctggtgcgcgtattacgttgttccctcttgtcttgtattgaattcgttagtgcttaaagcttgcttggacctggtccatgtggttttaagcaatagctcaggtgacgttgaccggcacctgtgtaccaagattctttaggaacccctttgttaacgcgcaggagccgagggtgtcgcatgggtcacctgtgttcagcgcactcagtggcttatcgactgttcacccgtgtcttgtcgcctcgtatctggcgtctccaagtagcagaagggcttaattataaggacagagaggatgaacgtcacctgtaaacctaatctgtgcattgtttttaccgtgccttttctgtgttcacgtgcagaaattaaaagtaagtataaagcaccgtgattgggagtgtttttgcgtgtgtcgggaatcactggtaaatgttggctgagacaatccctccacattgcatgttgtgaaaacacttgagcgcttaataacgcctagcctgagaagtatattcttc

SEQ ID NO: 640363 - DNA, 132 bp, Homo sapiens
agagtatgctctggattacagtgctgaggccgtaggtctaagaccaaggaagcacgccagcgcgtgaagagcgtctccaggcgaagaaggaggagatcatcaagactttataccaaggggatccatctagag

SEQ ID NO: 640364 - DNA, 200 bp, Homo sapiens
ccatgagaagagacgagatgtacaagagaagagaggatggagtttgatttatccctcctcccccaacacctaggatctgaatctttttctttttatcttttgagatggagtctcgctctgtcgcccagccggagtgcagtggtgtgatctcagcccactgcaacctctgtctcccgggctcaagcaattctcccatctcg

SEQ ID NO: 640365 - DNA, 262 bp, Homo sapiens
acagggtaattgcccccccctcccaggaaaattgaaatagctacatgcccataatgtgtttaaaatgggggatgctcttgaaaaatttaaagttttggcagtaaaaaactctgtttttaaggatgaatggatttcattcatatttcctctcccaaaggaaaatgacttcaggatagatttgtttttattaaaaagccttttttatttttaaggggtaggaagcaacatccaaaaatgcttaataaaatgcttttaagctgca

SEQ ID NO: 640366 - DNA, 254 bp, Homo sapiens
  misc_feature (116)..(116): n is a, c, g, or t
  misc_feature (142)..(142): n is a, c, g, or t
  misc_feature (200)..(200): n is a, c, g, or t
  misc_feature (211)..(211): n is a, c, g, or t
  misc_feature (214)..(214): n is a, c, g, or t
  misc_feature (232)..(232): n is a, c, g, or t
  misc_feature (249)..(249): n is a, c, g, or t
gaaccaggattgaacttttcagcctctatggtaaaatttcctgctctgtcggtgcgcaaagcttttttcagtttcctaaactcccatattcaagaagatagctattttctcttctntctcatccttccttgacaagcaagcntattttcattgtctactctgtgtcatccatgctggttcctgtcctcaaagagcttatngttcaaataanggngagggagcattttacaanggtattaaaggtaaaanattct

SEQ ID NO: 640367 - DNA, 340 bp, Homo sapiens
  misc_feature (13)..(13): n is a, c, g, or t
  misc_feature (243)..(243): n is a, c, g, or t
tctagaggatccnctattacttactcgataccgtatacttattaatattaagctagataataattattattattaatattattcttcttcttagaatgattattcaataataattattatctagcttaatattaataagtatacggtatcgagtaagtaataaattacttaagtaatttattacttacttactacttatgtaataaattattatttgttatattatataattttatttctttntatacttaataatttattatctattcttattcttattcttcttcttattcttattactattattactattcttcttattagaattattctggctgac

SEQ ID NO: 640368 - DNA, 429 bp, Homo sapiens
cctattatggactgaattgtgttcctcaaattcatatgttgaagtgctaaccccaagtaccaaatgtgactgtatttggggatagggtccctgaagaagtcactcagctggaaggagtcatattggattaggtgttgggaattggctggccaagggagaaatcaaggctggaaaccaagtgctgaactctcacatcaggtcctttgctcctgttccctggaccctaatccaatatgactggcatctttatatgaagaggaagaggcaccagagggtacacacgcagagaaaaggccatgtgtggacacagtaagatgacggacatctgtaagccaaggagggaaacctcagaagaaaccagccttgcctgcaccttgatcttggaggtccagtctccagaactgtgaaaaaaatgaactggtgttgttt

SEQ ID NO: 640369 - DNA, 228 bp, Homo sapiens
ccatggtgtcagactgcaaagtggttgtggttatgtcaaactggttttggttctgatggttaggaagaaacaggtcgagcctctcagtatcacctggcccggggacagtgtgaccccctagaagcctggctctgccattagctaggacctaagactctgtccacgattttggtctgttctctcccaatacacataggtttgtctcagcatgcaatgagtttttccttt

SEQ ID NO: 640370 - DNA, 281 bp, Homo sapiens
  misc_feature (259)..(259): n is a, c, g, or t
ctgaggtgggaggatcgcttgagcctaggaggtcaaggctgcagtgagtcaagatcatgccagcgcactccagcttgagtgacagagcgagaccctgtctcaataaaaaagaaaacctccatgatatatgacataaacattattttaaggaaaaccattttaaatattgtttttaacttttatatgtcctcaaatgtgaaaaactttaaagagatgtaaaaggcagatggccttttgatggagattccaggtgaatgantgagcatttcaggcagctgcgt

SEQ ID NO: 640371 - DNA, 487 bp, Homo sapiens
agaataggtgcggggagggcccagacattgaagctcctgcgccgcgggtgcgtgagggccccccgagagcactgcccccctcgaggtctagtcgagcagggatggctcggctgagcggataagtggtgggccggctgtgcgcagcagggggtcttctgctgggcactcctggcggaatccctggtggagatcggactggccgagatgggatctgaggcgtggctgtgaagaggtcactgttggcatgcacgctcttgtggtccaggccgggatgggattgggggcgccgagaaggaggctgctgcccccacgggaacaggaatcagggggggccctggagtggggcccctcactgctgggggccggccaggggggtgtatgctggacaccggtcggcgctgtggagtggggctgtggctgctggcgctctggagccaggtgtcatcgacaggcgggggtacaggcgtggacacagtgctggtgctga

SEQ ID NO: 640372 - DNA, 827 bp, Homo sapiens
gcgcagtcctccgaccctactgctcggcggttgtgccgcgccccatccgcagctcctcgcccggatgcctctccccggggactatggtggcttctctgctgccgtcagaggcttcaatcttctgcaccgggactacggggacgggagcttagcggggacggggacgaggacgatgacgaggaaactttgagctgcggaccccgagtccagcgggcggcgggaggggtcccctggaagtgacgctgactcagcccagtgaggagcgggcctgtctccaacaggctgcagagctgggaggagacattggagcctcatcccggagaaagggctgccggaggacgaccggacatcgttgtgaaacggttggctgtaccgggagccccgcggaggagggggcgcggcctggctgcccccggccggagcctggtttgtgctcaacgcgggactcccctggctcagttcagcagcagcgggacaaggggcgcggcgtctcgtagaggcctcgtggatacaccagcccttgtgctcggtgacccggcccagagacgcacggcgtacggacgacctggtctgtggtcagtgacgtgctgtcatgggtcggaaacaaccagtgatcgctcttgtcccaacgaccaggcagaaggcttgcagcagatgcgggggtggcattgcggggaacagtggatcggccgtaccacggggaccactggggacacccaacccagtaatgttcagggactacagcaacgttgggggcacccaagaggccggtgcctcaattcacctcaaggacccgagtcctgagacacaccatggagcttgtatgc

SEQ ID NO: 640373 - DNA, 994 bp, Homo sapiens
ccaggacctctggggacaccagaatccacaaatgctgaagtcccttatataaaatggcatagtatttgcatataactgatgtaatcttcccatatatcttaaatcatctctagattacttacaatcacattcagtcacaatgtcaacatgctcaactaaatcagtagcattataatgtctcagggcacatcaataacccagaaaaaaaagtctgtcatatgttccagtacagatgcagctttgattacctgaatatttcacaggtacaaggtatggttgaatccatggatgcagaacccacagatccagagggctagactgtcgttcgtatacaggtgttatatcaggagaggcaacattggctcttccaccttgtactcttccctcctagcagagcttgtaatccagaccacttctttccagatgattaggggtgaggggctgagctgctggatatctgatatctgggcagtggccactggtcaccggtcacattgcctgactcagcagggacacagtgtcacgaactatcatccttcatctagccaactgcatgcagtacctaacatcgtatcacctcacgcgcaatatccatatccagccgaacctccacccagaccctgaccaccacggcagccacccctcccggacccgcagcggcagcgcgcccccacgcccacaaccacccacacacgcccacgaactagaaagccaacccccacccgcacagaagaataagaatagaacatggaagaagcgactatacaaccccgagcaacaacagatccatgccacaggggctctggcaccacaggcccccatcacaccggtgaataccgacctcccgcccagaccaacacataagtgtgcccacgacacaaccattgacagccaacctgaatcaagcacaagggaccaacagacaccggagccccacactacatcggtcccccccacccccgtacacctcctaacacacacacagtcacaaacc

SEQ ID NO: 640374 - DNA, 1160 bp, Homo sapiens
  misc_feature (588)..(588): n is a, c, g, or t
  misc_feature (1016)..(1016): n is a, c, g, or t
agcggactgcatggctgcacaggagacgaagctcatgaatgtgacgggggtgtctgtacccgacggtgaccgtattcatcagcagctccctcaggtgctttccgtttctaaaactcgatctatcagaccgcagaccatcatccagttcgtctgaagttccagatgtaccacactgtggaccagtgtgttggtgagtaccatgtcctggcatttcgtgtgtggatacctggacgacatgtatggagattgagagaaataggcttgctatatgccaatgcatggagtcattgacggatgcgcctcactggtggtccttctcattactcgcttgttatttatggatcgagctgacgcgggatccaacagtcatttgaaccacaaaatagggcgcctcggccgttgtggttgacgttagttacggacagtagtaccccgcgtgtggtagtagaagtaaactgcgacatcattcacattgcaaagcgccaaccggataccactacgcgtcgaatgactatcgtgttcacgttattctctttccgtggaggcgtcctggcttatgtcttcgtgcccgggtcttcacaccgaagngggagggtatgtcggggactttcagcgccgcgaattgggccctgagggcctgtctccggtttagtcccctggttcggagagcatgccctgtgcgccctggtgccctgccgtccgattgcctcgctttttgactgggccgcctgttgcaggattgctgggacggtgctgggaatcctcaattcacccattcgcccacgggatgcattcagagcattagttttgctaaagggatccttaaccctgaacttctgtcggggacctatgagaggttacatggagaattcgagtgttgcacggctatttgcattgagccacccctgtgtgcacaaacattgatttggcaaaagtggtataatttggggaaaaacgggatttaggtaactgcaatttgaccaagaggctagatgtgatgatgaacaggttgttanatcaaaaagtcaaaacaagtgtagaagatcgagaagggggggaaatttggcgctagggatgggaaaggagagtaaaggggtttggaaccaaatagtatttggagtgcgtaaagagaatttttaccctgtggataagggctccct

SEQ ID NO: 640375 - DNA, 1074 bp, Homo sapiens
taaaagagattttgtgagagagggggggggggggggggggggggggggggggggggggggggggggggggggggggggggggggggggggggggggggggggggtgttttttgggggggggccccgggggggagaaacagcacgggttggtgtgtggtgtgtgtgtctctctctctcttagagagagagagagagagtgtggtgtgtgtgtgatgatgatgatagagagaggtgtgtgtgttgtatctatctgatgatgattaaggggagaggaggaggggagagagagagagagaaagagagagggtgggcgtggtgtgtggtggtgttttaagagagagagagagagagagagagagagagagaggggtggggaggagagggggagagagatatatatatatatatagagagatataataagagagagagagagagaggttgtgaggtggggggtggggaaggagagagagagagagagagtttatatagatatctcctcagcgcagagagggggggagagagagaggaggagagagagatagtattgatagatgatgagagagagaggggggaggcgagcgtgtgtgtgggtgtggtgtgtgttaataagaagagcagacagagagagggggggggagagagagggagagtgagagagagagagagagagagagagacagagagagagaggagagagagagtgctgttatctgggaggagagggagagagagagaggagagatagtctttctgtgatatagagagagagagagagagagagtgttgcggctgtataataaatgatgtggggatgatgagagaaaaagaagaagcagatggtctttgtaggtagtaacgaagagagagaagggagtgagtttgtattgctgattctatttagtattgatctcgtgtcttggtggaggagaccgccagaagacagagtagaagacgaggggggggggggtgagtaaacacctagtaaatgtgtttgttgagtatgaagaagactaggaggattattggaatattaaaacaaacaaaggggtagatggtattgaatgagtgtga

SEQ ID NO: 640376 - DNA, 936 bp, Homo sapiens
ggtcaccgccatgacgcgccggtggttcccgtctgggcgagtccagctgcagggtgccccaggtcgcttcatcagcacagtaggcagcatggcatggcagtgagcgtgtaggcagcgggagggtgtcgatccaggtgacagggcacaggtcctccttgctgtccgaggaggccctgcccggcaagtggggtcacagctcgcattctctgtatggatgctgcatggtattcgcttatctcttccgagtaccctggcaggagtactgggcttacagttgcatcgggcatgtccccaaggacttgtattaccggggttgttgtgtccaatgtgagctgtactttgggtcttgggtgggcacttccctattgcattggcggggctgccccccttgtctcgcttgatttggcgtagaagcatagggcccgctgtgggtaagcatttcccgtcgggcaggcctggtcggtggtcttcgccttttgggtggcttggtggtcgccaccctgggttctggtacaattccatcgattcgcagtgcattttggacagttgcgcaatggtaccttctctcgtgtcgctttttcctctacgggcaccctatgggctacacccgaaggggtcccgggggccttgtggtggaccacgggtggtgcaccttcatttggttgtcagactgttcaaactaattccgccagtggctttggccacagtgattgtccagggtgtggagtgacttcgcaaaggctgctcgagtgtggtattgacttggaacgacccgaggtgtaccccagtggggttcgagacccaggttgtgtggatgcattcccttgcaagcaggttgcggccaaacgaatccggggtggcttgtcccattgaaggggggggggggcaccctctggttacggggaacgggtccaaagggagtggcataacaggttg

SEQ ID NO: 640377 - DNA, 357 bp, Homo sapiens
acgcgcaccgtgtcaaatgattctcctgcatcaccctcccgagtaactgggattacagtgcatgcatcaccacgcccagataaattttttggtattttatagtagagacaggatttcaccatgttggccaggctggtctcgaactcctgacctcaggtgatgcatccgccttgcctttccaaagtgctgggattacgggcatgagccaccacgcctgacctaaaatcatgtatactttgccaggtatttgttacagtatcgtggtttaaagtcttggataacaggtcatgtaggacagtgattcctaaccagaagcatatacaatgtagttgcggggtgggaggggcagatgttttc

SEQ ID NO: 640378 - DNA, 145 bp, Homo sapiens
tggtacccagactctctctgatgtgaaatgggcagtttgggacccagttgagtttagccattgtagaagatactttcgtgactaatgtccagtggatcatatgagatggccccgaaataaaccgttcttccgcaccagtatatgt

SEQ ID NO: 640379 - DNA, 237 bp, Homo sapiens
  misc_feature (213)..(213): n is a, c, g, or t
gaggctgacctagaggacccggctatacattatcgtcaaggacctgtaggaagcctaaagtctgtggcagctattctagaagaagcactgagacactcacaagcttgtcactgcagcacagcgggatgggagatactgggacagcagcaccagtactgagacacgtgactttgtaaacatcgaatcacctctcactgagaggggactcttcancatcagtggatagtgtgataagcg

SEQ ID NO: 640380 - DNA, 385 bp, Homo sapiens
ttacatagatattcagttacatagagactaaacttctatctcttctaaatctgctgatgtatacaacacttgtttcctcaaataaagcactacctattgttgcttcaccattacctagaaagtactagtgtactctgcttaactgaccataacagagggaacctcacattcaaatgaacacaaaatgaaacagactctacagctgaaatcaattcagttggccacctgagaagtatactgggatccgtgcacgttaacgattactaggactatgcagaaaccagagagtttaagaataccgcatgggaatccttgtctttcttcaaactatacataccgacaccctagtacttcccttctctcttcttatcttttcttaattaat

SEQ ID NO: 640381 - DNA, 151 bp, Homo sapiens
  misc_feature (145)..(145): n is a, c, g, or t
ttcacgagtacagtcaggagaggctcgaggatagctatgcaatacccagaagacaccgcatatgcaccactagatagagactaagatagggcatggtctctcgtgtagattgtaacccatatttgcatatagcagagatacatanactgta

SEQ ID NO: 640382 - DNA, 706 bp, Homo sapiens
  misc_feature (277)..(277): n is a, c, g, or t
atttgggccagcttaatcatttattgttggttttccatgactgtctgcaaccggaaagggcatcctgttcaagcctgtttccccacctaacattgtcaccttatgccacagcataccttgaccctgaagatcctgggaagaaaagctgggaggaaaagacacccagcattgcattaccatcgtggaataatctatcgcaaacctaggaaagctgaagccacaaagtccgaaccacctttgtactcacctgcaggagctgccatgaagcatcctctgnatgaggcaagccctagcgctcattgctgctgggtgttgctatattcaatctttacggcttcctgacttctgtgacaggaagccaagtgcaaatacacttgatgagaatttcctcttttaataatgttatttgaacaccacatatctttaaatttattttatttgaaagtattaggtccattgagcctggaaaaccacactcctttagattgggggccgagaggcgacaacccaacattgagcgagagttattattaaacatggctagttggcactatgtacgtgagctaggttttttatgtagtcgagttttttaaacgcacattctggaaactgcttcatctatgcctctttataccatgtaattataaaacactagaattacttttaccttaaaagaggtttaactttgtgagaaactgagtgtgcc

SEQ ID NO: 640383 - DNA, 197 bp, Homo sapiens
gcgcgagcggacgcggcagcgcctcgtctcgctttttcttatttttcccccctttccccttcgtttttcctttccttttctcccctcccccccttacacatcccctcggaggcgcttcccgggagggcgaacggtacacagcaaaaaaggaaagcagaagaagaacagtaaaacagcaaacaaaaaaaaagagaaaa

SEQ ID NO: 640384 - DNA, 161 bp, Homo sapiens
cattacgtttgttcatcacgtcatcatattccagcaggcgcttacggataccaaatgttgttctcttccacttagcgttgtgcacgctcaatacttttgtgtaaccatgctgtgctggatcacctcaccttctttgtgaccaaaacggtccatgatagaag

SEQ ID NO: 640385 - DNA, 211 bp, Homo sapiens
agtgcattcgactcgggtctggaggatctctagagtctgaccaggctccagtgttaacgagtattttggaggtccgtactggctgctcacgtgtcggcgggaacttgtacagggaggcatgcaccgcagtggtgaatacacgtcgaccaggctgcatgtatgcgttcttgggacgtgatcatggttctcctatattgaaggagctgtgtat

SEQ ID NO: 640386 - DNA, 284 bp, Homo sapiens
tgtgatgatccagacgagacagagatgcgaaccaccaaaaacgcacacctgccctatagccctgagacagacacacagcctcacgccccctggaatgcaagttgtttcctggtgcttcccacggaggagttttgtcagccagacttctggaggaattggttgtatagaagatcctagtgaccaaattcagcctactgcctcggatctctccagccgaagtctgtggactgcaagtctttgtgatgcttctggctcccatcccgttgattgggttgacgtcagga

SEQ ID NO: 640387 - DNA, 261 bp, Homo sapiens
gcaatggagtgtgggtccaccttagcctctgacttcctaatgtaggaggtggtcagcaggcaatctcctgggccttaaaggatgcggacttaatcctaagccagcgcccatgttgtgtatccaaggggttttgttggatgggttaaaataactggaaactcagggcccatccatttcctcagatctcctgaaaatgaggcctttcgatagttcggggcagtaaaatgcctcctgcggtagttttcaaggttttggggcttt

SEQ ID NO: 640388 - DNA, 328 bp, Homo sapiens
atgatgatgggtattaagtactcttggcggtagcgccctcttatggtcatgagctaaagggccattgctcctggtctgaaaacatgcctgtcctccagcagcagctcctccagcggcggatccattacttatgtgactgggcacctggacagaaagacagacccagagccatcagcacttacagtaccttggggtgaattagaataagggggctttcccccttatggtatggcaaacggtcctaatatactatttttaacagaacacgggccggtataacaccagcatgtattattatataaatccctatgtggtcctcaaggtgcca

SEQ ID NO: 640389 - DNA, 652 bp, Homo sapiens
  misc_feature (578)..(578): n is a, c, g, or t
tcgctcttctactatgaaccgcacgctcgctgatagctgagaaggtggccctccgtcgatgcagacagcgctgcgctgaattatgatgcctaggctggccttcatatgcctactagtgcctgttcgttgcacatctgtgtctggtgtaccccttcccctgctgatcttggcatggatatgacgaataagatcacatgaacagcatgaaatctcatatgaagtcaccctagaccagtgcgagtgctactatcaagattactaataggtggctcctttaacctctccacccttatctagcaacacaaggaggcacctctgattacgtcctgccatcatgacccgtgggcactagatatgatatatctccagcaactaggcagaagaccgaaaccgaatgcgcccattcgaggcgtgcgcgaacggtggagttccggaggcgtaggtctcatggcttttgcaacatcgaactacgccgacatgttcccgttcgcccgtagttcttcatagccgaatacaggcggacacttggttgataactaaagcacccttcatcactagcaagtcttccttagtgaacngaacatagtgacggccagctcttccccctgaacctcttacctccaacgcagtagttagtgttgaaaaaaccagg

SEQ ID NO: 640390 - DNA, 941 bp, Homo sapiens
  misc_feature (941)..(941): n is a, c, g, or t
gacctcgaacgaaagtctgaccgaactccgggatctacgtcccgaccccaggacgacactccagtgagtctaaatggtggtcgcacactgtgtctccctcctctagcgcccatcgtggtgaattatgaaggagattagtacgagcatccttttcagatgctggagtgggaaagatcgtgagatctttgacgtacagaattgtttgctcgaaaagaatgatgtgacatatcttagtcatttaggatgatttaaggatatagtattcctggtcatttaagaatgtcatgctattggacgccgggagctgtctctgccgacacgtcatgagctcaacatggtcggtatgtaactcacgggccttcgtccaagcgccagcgtgtgagtcacttgtcctagttgcagtccctgtgcttccgttctaacggtgctgcgagcaaagacgagggtgacttgaggcaaatcccgcaagtcctgcttctgacagccaatcgtgggggcccgtacgtccagtgtctagaaacctggcttgaaagtgagatgcgaaggagacgcgtgtgatatcctcagatttgagcagcccgtccgatggaagtccgggaggggggtctctgacggagggacttacgtttcatcggggtgatagggagcagaacgcaggcgcgtggtaaggtttagctggtcagattccgccattgttctgtatgcccttgtgtcgcccagccaggacctgcctttgcccgagacacttccgagctttttgaacgtctttccctgcggtagcggccctggcattgggactgcagcactcattgggggtgggatactaccgcggtgttaaggctcccaaggaggcagcggggcgcgacctttgcccccacctcggtggttgtgccccaaggttcaacttggcgccaagggcgagagccccccgcggaacgacn

SEQ ID NO: 640391 - DNA, 156 bp, Homo sapiens
ggcacacgcctgttaataccagctactcaggtggctgaggcataagaattgcttgagcgtgggaggcagagattgcactgagccgagatcgcgccactatactccagcctgggcaacagacatcctgtctcaaataaattacattaaatgtttaag

SEQ ID NO: 640392 - DNA, 248 bp, Homo sapiens
gagacggagtctcactccagcctggctgacggagcgagtctgtctcaaacgtctcaaaaacaaacaaacaaacaaaaaacctctttgaaggggattaagtggatttgtcccaattaactagcaaacacctgtgaatgccagctttgtgtcaaggggagagtgatttgtatagctaaaagatatttattgcttaggaaaaacatgactgaataaatgcatcctcattaaataaaaaatgctccaaaaaa

SEQ ID NO: 640393 - DNA, 120 bp, Homo sapiens
gcatagcagagtaggtgatgcgttctgaggattcaacaccagtgcctgacggtgtattcacagtctgatgggcactttaaatctgtgactacttcacacagccttgtcttagcgagatat

SEQ ID NO: 640394 - DNA, 368 bp, Homo sapiens
tacggttcgcagtccccaagcttcatgacagctggtgtaaagaagctggcacctttcgcctctctcttgctcccctctccccatgtgatctctgcacacacaagctccccttcaccttccgacttgagtgggagcagcctgaggctttcaccagatgcagatgcaggcaccatgcttcttgcacaactgctgaatcatgcaccaaataaacctctttcctttataaattacctagtcttgggtatttctttatagcagtgtgaaaacggactaatacaccccatacgtttgatatgagcttaatatccagaatatataaggaactcaaactactaaagagcaagaaaataaccaggttaaaaaacagg

SEQ ID NO: 640395 - DNA, 672 bp, Homo sapiens
  misc_feature (135)..(135): n is a, c, g, or t
gggttgaatttggcttacagagttccgtctcaccatcctgggcttccaagtggagactgcggtatccgcggttggagacccagcgggagtagcctttgtgctcccggacggacttgaggtgtggagtctgtgtgntggggaccctgccttgtgaagcgcccgagaggcttaaaggatggcctcgtcagatctgaacaattatgctctcatgtaatgacaacgatgggcaatattaagaaaacccttatcattaagaaactgtggccaggaacctaacctgtgaaaagtgtattacataacaataggagatgagatcatgtgtaataaattgaacttctaaaatacatggaattgtgcaaattcagtatcaagaacaaaccaacaattcactcaaggaaactctgtggaatctctgtgaagaaagattaccaaggacttagaacatcttaacagaaacattcctttcccattgtgcctcaatgtaacagttaccccagaagctgtgtaaagggatcagactctgtgattcctgaagaaccaatcacagttgaagaacctgaaacccgtaaagaagctcccaaagagccaaagaagtattagggacattgccatttataactttgtgactgagtccacgggggtccttcgtacatggaatcccgttaacctata

SEQ ID NO: 640396 - DNA, 162 bp, Homo sapiens
ctgcatgtatctatactgtagtccgcctttcccattcaccatgcctaattgtatctgttcttttttggtttcacacacactgattcatactcataaatattttcatgttttacacacacaaaaaaacaacaccacaaaacaacacaaaccccacacaaaaca

SEQ ID NO: 640397 - DNA, 109 bp, Homo sapiens
gctgttaccgaaggcgacgctggtgtctgcatcctgttgctggcgtcaaactccacacccaccgtgcagcgtggtcacgggcttgtggtagtatgtgcgtgcatgcccg

SEQ ID NO: 640398 - DNA, 179 bp, Homo sapiens
ccctgagacggacttctgctttgttgcccaggagtttgagaccagcctggcaacacagcaagaccttgcctctgcttcaacataaaataaaataaaaaaataaagctgggcacggtggctcactcttgtaatcccagcactttgaggccaaggcaggcggatcacttgaggtcaggagt

SEQ ID NO: 640399 - DNA, 370 bp, Homo sapiens
atctttttataaagtggaaataggacgggcatggtggctaacgcctgcaatcccagcactttgggaggccgaggcagccagatcacctgaggtcaggagttcaagaccagcctgacccatatggcaaaaccccctctctactaaaaatacaaaaattagccaggtgtggtggcaggtgcctgaaatcccagctactcaggaagctgaggcaggagaatcacttgaacccggggggcggaggttgcagtgggccaagattacaccactgcactccagcctgggcgacaaagtgactctgtctcagaaaaatacaaaataaaaaaataaagtggaaataacttcctctgcttctagctatgcagtttgcttg

SEQ ID NO: 640400 - DNA, 381 bp, Homo sapiens
  misc_feature (116)..(116): n is a, c, g, or t
ttcccttgggggttgccggccagaattttttcccctgggggtcccacctttgccttaccccagccttaaaaatagcccctggccaaaggccttgttgggtggagcctttgtgtgantccatactcctccccccacaacatttatttgtcaaacaccaagcactttcagcctccccgccttcagctgtcagctttttggggctaacttttttgcctttgtggttggaggcctgaggccttttggaacttttgctaacctgttcaaaagccaggaaggaagactgcccatgttttgaaagcacagccccgtcaggtccggcttgtgggtttccctttttgcacgcctgtgtaaagctattataattaaaatggttttccggga

SEQ ID NO: 640401 - DNA, 612 bp, Homo sapiens
ctggggtgggccctgtgtgggcccatggtggccctgggatggtggaacctgcgtgtggcttccgcgtgagtgtttctgtgcatgtgtgcatcctggtggccggtgtgtctgctgtgcctgtcggactgtgtggcctggtggcctgaggccgcaggaagctctgcaggagtgcaatggccgaggataagtgagtgtgatgccctgtcaccaaggttggcgcctgcatttggtcacaggaccattgaaagcattcaaaggtcgacctgtgaatgtgaaagcagtcagtaagtcgttctattatcgtcgcacatgacccgcaagttaaagggaattcaagaagaatcactctgacgtttgcgttttaccccatgtagatgcaaggatgagtatggcacacagatatcctagtttccagtttccgacaaagagctggtgggcacgttgtagacaacccggcgggagctttacatcagactgcgtacgtgaacgaacgaggcggaacgatgtcttcacagtttagcgcgccacccgaagatgagtgtctcggccccgaatgggcaaaagcacaactgggaccaagacgagaggaaaaagcggaccacaccaagtagt

SEQ ID NO: 640402 - DNA, 210 bp, Homo sapiens
  misc_feature (140)..(140): n is a, c, g, or t
gagatgggagtctcactctgttgcccaggctggagtgcagtggcgcgatctcggctcactgcaacctctgcctcctgggttcaagcgattcttctgcctcagcctcccgagtagctgggactcccaaagtgttgggattntaggtgtgagccactgcgcccagtcagtatgcttttccctccctctctccttcccttctgtcgtcttctc

SEQ ID NO: 640403 - DNA, 891 bp, Homo sapiens
  misc_feature (877)..(877): n is a, c, g, or t
ggagttcctccttgctctcgcccctactctttctggtgttagatcgagcaaccctctaaaagcagtttagagtggtaaaaaaaaaaaaaaacacaccaaaggctcgggccacaaaggggatgaaatttcttctgggacatcctcctcgttctcccggttaactggatcggtctggtccctagagtccttcgtgaagctttttattcctaagaggagaaaatcagtcacgcggcgaaattggtgctgatacaggagctgggcatggaatgtgggagactgactggcctatgaattggtaaattaaaagcaagcgggttctctgggatataaataagcatggatgaggaaacagctgccaaatgcagggactgggtgccaaggttcataccttgtgggggtagaagtgcagcaaaccgagaagatatttacacgtctgcaaaggaaggtgaggcagaaatggggatgtagtatttagtaaataatgctggggtagtctatacatcagatgtgttgtggtacacaagatctcagatggaaaagacttttgagtaatgtattggccatttctggactacaagggatttcttcttgcatgcgaggaataaccatggctttgtcaggggttcgggaagtggacattttgggccccttttatggttacgtcaacagttggtggtggttctaaacttggcagtgacatggtgttacaataatcggtcaacaccttgtggtccatccgactgcgtctcaaccggtcagttggcgctggcggaggaagggggggtagagagaggatacctcagtaaagggacgcggggaacacgttttctttctctctcttctcccttcatctctcttctccttatatctataaacngaagaaaaaaagag

SEQ ID NO: 640404 - DNA, 414 bp, Homo sapiens
tgcagggtcatgtataaatggggccatatagtacatacatatcatactcttagggctggcacacatttgaggtgcatccatattttatattcactcatcaggagctgtaaacacattcttaaaggagcattttcagatatgaataagcagggatgaaataaggattaggctaagggaaatggctgaggctttcctaagtgaagcggaacaaccacagccttgtttttaaagggatggccaatatgcatttatctgttcaagcattttaagatctccacgaagatggcctgaggaatcaagagtcctcattgagggggcggatatcccaaagggagaatgatctgaaaagaccatgtgctttttggaaatataaggaaaattgtgaaaaaaaagaccccccccccccccttcttt

SEQ ID NO: 640405 - DNA, 221 bp, Homo sapiens
cccgatagcccgacagtggaggtgtctgaatgaggactcacggaacaattgtgaatctgggagagcatgttcgataaatctacgaacggtgtgcttgtccgtatttcgctgggggcttcaaccctgaatgttctatgacatatctgacaaggttttgttgagcaagctgaggctctggaatccataggattccaagtggtattctgtctaactactcggtc

SEQ ID NO: 640406 - DNA, 222 bp, Homo sapiens
gtcgggcgcggcctccgaacgtccgcttcggcgggcgcacatcgaccccgatgccgtgctgactccatcgtcgcaagctgccgtcctggcgtcttgccgcgccgctgcatggtgtctttcgctgcctgcaacgtggaatccaatactgcactcgcccctttctacaacggggccgaacacatggtgcgcgagcccgtcgcgcgtgacgcggccgacctgatc

SEQ ID NO: 640407 - DNA, 338 bp, Homo sapiens
  misc_feature (29)..(29): n is a, c, g, or t
  misc_feature (102)..(102): n is a, c, g, or t
  misc_feature (298)..(298): n is a, c, g, or t
  misc_feature (324)..(324): n is a, c, g, or t
ctttttttttttgagagggagtctcactnttttgcccaggctggagtgcagtggtgcaatctcggctcactgaaacctccatctcccgggttcaagcaattnttttgcctcagcctcctgggtagctgggattacaggcgcctaccaccatgcccggttaatttttcttctttgtatttttagtagagacggggtttcaccatcttggccaggctggtgttgaactcctgacttcatgatccacctgcctcggcctcccaaagtgctgggattacaggcataaaccaccacggccggncttaatatcaagtttttatgtgaatnagtttgaggtgaat

SEQ ID NO: 640408 - DNA, 162 bp, Homo sapiens
caggtcccgtgcggggggctagtcctggcatccggtatgatcaggtcgcaggcctgtatctccagcagctccaaaatcttcttgaggcgctactcgctggcggcgggaacttagctaccggcttccagtaagtacacgcattcgctctcctcacccataatg

SEQ ID NO: 640409 - DNA, 279 bp, Homo sapiens
aaaaaatttaaaaatcccaaaaaaagtgaaaagggccggttccccccttaacgggggccattcccttgtgaaattccttttctggggtcaaaagctcccccgttgggccccttttgacccccggccctgccccccaaaaaacaaccccctttggggggaattggcccccccccccccaaatcctataaaacagccccccccctgtttcccttcaatgactccttttttagggccagccggccggcccccaggggaaaaaaacacccttgtggctcccca

SEQ ID NO: 640410 - DNA, 414 bp, Homo sapiens
  misc_feature (32)..(32): n is a, c, g, or t
  misc_feature (37)..(37): n is a, c, g, or t
  misc_feature (49)..(49): n is a, c, g, or t
  misc_feature (97)..(97): n is a, c, g, or t
  misc_feature (119)..(119): n is a, c, g, or t
  misc_feature (283)..(283): n is a, c, g, or t
taatatcctactgccaatgtgagggctaaaantttgntcttgcaatttntttagtctaactctcttccagagtttcttaacaccttcactactgaancttttggacaagaaaattgttntgagaggttgtcctctaaactggaagatgtttaatagcatgccaatagcaccttcccagttgtgacccatgagaatgtttccagacactgtcaaatgtcccctaaagggcaaaatcacaactctacccctacgccaactgagagccatacaccataaaaatctnggagttgtgagtgcagggaaatggaaggattaggtggaagagtagctaaggagaacagggtgggttttttgtttttgtttttttgagacagagtctcgctctgtcacccagtgtgagagagtccgctatct

SEQ ID NO: 640411 - DNA, 409 bp, Homo sapiens
  misc_feature (409)..(409): n is a, c, g, or t
cagttggttgagaaatagccaccctccaacctgtctgccggagacactgggcttcccttgtctagaagggagcattgctctccttcccttggttgactgctaggttcaaggatactcatgaccttgcaagtcccccaccccccgtgtccctgggctggggctcccttgcccaccccttacttccagagcttctctctgcccttgtatctcaggtgtcccttggctgctcatatgtttggggccttgaggtgcccacctgtattggggtgctcctcttggcctgagcagtgtgtttaccagcaggccagggtgttgctgtcccttcaaaaccaaattgactgtcaactggacagtgggtaccatcttcttgggatgactgcttgcctgctcaggtcttggtaacttgctn

SEQ ID NO: 640412 - DNA, 338 bp, Homo sapiens
agcagagcagttcagagcgctgggctgttgtccacacatctgtgtctgattctgtggcaagggtagaggaagagaggtcactgatggatgtttctggagaaagttgtgcatcgttttccttcttagctaggagggaatagggggtgtgtcgggagggtgaatgggagaagtgagggcagatgagtggatatgtgagtcgtgttagcaagccagattaaacgaactgcttttggtttaatctgatgctcaaataacacactttgcctttttttctaggtatggaagaagagaaagaaaagcctaaattggcatgagatccaagtctaaacgcctctaca

SEQ ID NO: 640413 - DNA, 189 bp, Homo sapiens
tgacagtgccaagcctgtagtcccagctgctcgggaggctgaggcgggagaatcacccggactcaggagttcaaggctgcagtgagcttcttggcacttcactccagcctgggtgattttttttaagagatgggggtttcactattgttggccaggcttgaccttgtaacttcttgacctcagtgcaat

SEQ ID NO: 640414 - DNA, 602 bp, Homo sapiens
ataagcttgattcgtattctactccaccttccggaagtcagtgggtgggtgtggtctgagcacctggtaggacctgccacctggaaggaaagctggccgtgaagcgcaggaggtcaagggtaaacgataatccatgaggtcaaactgcaactcatctatgacttcctccagactcagtgacacaagtgacccgcacaagatgcggatgcccttggctctggagttgtacaaaacaccgaagcgggagagcctgcagcaagcagctgggggacctgagcccatggctgccccacaccagcagggtgcacaacatgccacagcttctgcagggcctggcgccctgtgctggcctcggagatgggcctgctgtttccttctctccttccaggttcctcagtttctcctgtagccagaccatgcagagcaatggaagtggcgttccagttagctacggtgacatagcataaactcactacaacgctcgttggctgttttggtttcagacacagatttcagttttattttcagctttctaatttctctgttttgccctcttccctctccctcctccagggggattggttgaaatggcatttctgatg

SEQ ID NO: 640415 - DNA, 714 bp, Homo sapiens
aaacacaaaaatcagccggacatggtgggcgggtgcctgtagtcttagctactttggaggctgaggcaggagaatcgtttcaaccctggaggcggaggttgcagtgagccaagattgtattactgtactccagcctgggtgacagagcaagactgtctcaaaattgaaatgaaaatgaaaataagaataaagttttaccgtatgaggataatttgggaaagtacttgtacaaaaaaacattagagaaacagaaaaaaatttctgatatccaaagacaaccccttctttaaggggtgggcaatttttccttcttctttttttttgaaagggatttatttttcgggaaatggggtctcgaaaaccttactggtattgtcgcaggtaagtgtactctggcctatctggcggtataacctttcccagtatatacatttccgggggttaccacctggcatttaaacgctggtattccttctcaattcggtcacccagtgtcacgtgtcaccgggcagtctccaagggttgtgttgggccccggggatccggatcatttatcacgtgaggggccttattaaaattttcaggggagcctccaagtggcgctctgccttttcccaccattggcctcagggtgttcagccattaacccgtagggtatctttacaaaggtctacagggtacgtgacacttaccacgtggggagacgaagaggcc

SEQ ID NO: 640416 - DNA, 472 bp, Homo sapiens
  misc_feature (409)..(409): n is a, c, g, or t
ctaaaggagtggctcttaacatggttagaccagccatctcttttaaaaaatattttacatggctattttttttttcctgagatggagtctcactctggcacccagggtggaagggcaagggcgcgatctcggctcactgcaaggccaagcctcaggttccagccattctccttcctcagcctccctagtagctgggattacaggcatctgccaccacacctggctaattttggtatttttagtggacactgggtttcaccatgtgggccggctggtcttgaactcctgacctcagttgatccacccacctcggccttccaaagttctgggattacaggcgtgagccactgcacccggccttagtgtatgtaagtgtagtgtaagtgttaaggtaagtgtaggtaaggtnagtgtagtgtatgtaaggtaagtgtatgttatcttttggagacagcatatcagggtaccgagc

SEQ ID NO: 640417 - DNA, 811 bp, Homo sapiens
gttcttttcttcgggttcaacttgactttccttttgtgactggccaattgttggtaattttttttccaccgtaaccccgtgtggccgggacccttttgaaggcacgagcttttgtacggccattgtgccttccttgcagaagccccctcgacctggttagcagactattatccatgggacccaccttattgaaggcctttggaccgtctgctcacccacaggggcaccccaccaccatctgtccagccggtaggcaccactggcccaattgtgaaagtcacttcagcccagttttcatttgggagctacccacagggcacccctgagctcctatccagaagtgatcgcacgtgaccccctttcaccagattgaaaggggtgaatcaccactgctgcattggataactgggtactttgatcttagaatgtgatcttggaaatcactttgggactgggatcccttcgctgatgaccaacagactttctgggaccctgatggagtggggaacaacgcagatagagtgggactgggggagaccccaggcccccgggctgagcactgtgaggcctggatgtgaagactcagcccacgcgaagctcattcccttacccccggcccactgctgctgcttcagtggaagagatgaacccaaggcccggatggaaatccctaccttcagagactttagcccagccccacaccattttttcctgacctctcagccttttccctccccagggccccctgttgaaatctgggcactttaagtaaatttttaggcgtgaaccgtggaacaaaaagaaaaaaaaa

SEQ ID NO: 640418 - DNA, 329 bp, Homo sapiens
agcctctaacacctgcttagtctttagtcattcttagtaacgctgctctgtccttagtcatccttagacaccgtgctctgtaactgtctttcccgctgaaactactcaccctgccactccagctcatacccctgccctctttgaaatagccaatctgaattggcttagagtgtgcagtccaaccctatccaatagggaaaagacacaacagtagggactagctgcattagaaataagaacactttcccctcccttgtccggtgtgatcttgcctttgctccatctgcaagaccactcttccatagaagtaaatttgccttgctgtaaaa

SEQ ID NO: 640419 - DNA, 790 bp, Homo sapiens
ggaagccgtggggacgcgcccagggagctaatcagattacctggctggtgtgcttgtctggagtgatcttctgactgaaaagaactatgtcatgatcaaggaaggagagctgtctatttgggagcggttctgtgccaccatcataaaggcaggccaatgccgaaacacattgcattcataatgggacgggaaccgtcgctatgccaagaagttggcaggtgacgcggcaggaaggccactcacagggctttcaacaagcatagctgagaactctgcgggtggtgttgacaccctggggccatcctagaggtgacagtctacgcattcaagcattggaggacttcaaaggctcccaagagtgagggtagacgggcttaatggggttctgggcccggcagaaagttccagccgcttggatggacgacacgggaggacagtggcagaagccatgggggtgtggactccggggccctggggcggtctgcacttgttggccttggatctccaggaggctgatttgcacaaagttgtacagggccatgaggaactaccaacatgatttctctggagtctctgctggaaagtgcctttatacaaaggtctcctcatctgaattttgatacggactctgagaaggcggtgagtgactcttgtaagaagccttactctgctgtgccaccgtttgtgcaagtatcatttgacctttgggcatctgattccgagacatggtgccaaaggtcgcttgtgcggggtgagggattgcacacccccggtaggtcgcacccgggtc

SEQ ID NO: 640420 - DNA, 144 bp, Homo sapiens
ttactgtgcgttaatgttcacagcaactttattcattatagccagaaaccgtcaacagtaaagcttgctgccaacaaaagaatggagaaacaaactgtggagtaatcatactacagtgttatggttaattttgttttttttcaa

SEQ ID NO: 640421 - DNA, 691 bp, Homo sapiens
cttccacaggggacattggcaatgtctgaatgcattttgtgtggtcatgactggtcagaaggatgttatcagcatctagtgggtgtcagccagggaatgctgctaagcatttgataatgcataggtcaagcgccttcatcaaagtaattatctaccctcacagtcaatagtgctgaagttgagaaatcatggtttacggagtcttgattaaacattttcatctggggtaccctgagatggtgatatatactagtatgctatgcttcacagtgtcagctttctcagcatctgcagcaggtgagttataatcttcacagaaccatgctcctggggaaagactgatcatacacgatattctcattaactttgactaaatctttcaccatgcccattagcatatatcgacgttctaatgtctcagcagcagcgagtctctgtatttgaatatatgtttggttatatctcatggcttgtttccacgtatggaaaacagagtcgtaaatggcaacagttatagtttagtgctgcctttacatagtgcctgatcctcttatagcacaggcacagttaagtaccttgagctccaagccatcacaccacatgctcacattctagcatgtaatggtctcagcattgcgtaggttgatgtaccactgcagcacagttccacttagtgaacatacaattgtcc

SEQ ID NO: 640422 - DNA, 718 bp, Homo sapiens
gctttgttaaacagatgcttgaaggcagcatgctcgttgagagtcatcaccactccccaatctcaagtacccagggacacaaacactctgcctaggaaaaccagagacctttgttcacttgtttgtctgctgaccttccctccgctgttgtcctatgaccctgccaaatccccctctgcgagaaacacccaagaatgatcaataaaaaataaataaataaaaaaaaaaaaaaacgaaaaaaaaaaaaaaaaaaaaaaaaaaaaaaaaactaaaggaaaaacccaaaaacaaaaaaaaacctataaagaatcaaattacaattcaattggccgaagattaacaacgacaaaaaataaaaaccccggggggggccccgaaccaaattgcccctaataggaggccctttaaaaaaaatggggccgtctttaaaaggtccgaaccggaaaaaccttggaatatccccacttaatgccctggagaaagaaccccctttgccggaattcgtaaaataaaaatggggccaaccctttggccctttacaaacattctgtacgcctaagggcaaactggaaaatttcctcgtaaaactttggaataaaaccgcgttaaaattttgggtaaaaccacgcttttttaaaccaacgggcgctaatgcgcgaatcctctcttaattaaaggggattaccccgcaatagcgggaagggcccctcaactgaaa

SEQ ID NO: 640423 - DNA, 815 bp, Homo sapiens
  misc_feature (50)..(50): n is a, c, g, or t
  misc_feature (67)..(67): n is a, c, g, or t
  misc_feature (186)..(186): n is a, c, g, or t
  misc_feature (396)..(396): n is a, c, g, or t
  misc_feature (445)..(445): n is a, c, g, or t
  misc_feature (513)..(513): n is a, c, g, or t
  misc_feature (559)..(559): n is a, c, g, or t
  misc_feature (592)..(592): n is a, c, g, or t
  misc_feature (610)..(610): n is a, c, g, or t
  misc_feature (649)..(649): n is a, c, g, or t
  misc_feature (657)..(657): n is a, c, g, or t
  misc_feature (667)..(667): n is a, c, g, or t
  misc_feature (675)..(675): n is a, c, g, or t
  misc_feature (677)..(677): n is a, c, g, or t
  misc_feature (703)..(703): n is a, c, g, or t
  misc_feature (713)..(713): n is a, c, g, or t
  misc_feature (742)..(742): n is a, c, g, or t
  misc_feature (752)..(752): n is a, c, g, or t
  misc_feature (814)..(814): n is a, c, g, or t
ggagctgagcaggaacagggcctggctgcctcttctctgccacagctctnacctgggcaaggctggnagctggcatcgtaatggatgggggagtgggtggaggatctgagggtcccctgggtaggttccgataccttggacaggtgggcctcaccctgactaagaactcggggaggggccactctnccttcccctccttccagcagccgccccaccaccctccacctcctgtcctcgacatgtgtcccagaaaacccagccatgaggaccgccctcagaagggtctataggctttgcaagccgaaagaaaggtgggctgacctctgacctggattcagggggtgtctggggtcatccccaaagccaagtatggttggaaaggagaaggactgaganaagacgatggccctggcatcagccggtgaggcccaggatgacccatgcnagaatctgggggaggacgcgggctctgccagccagcagttggtcatctctgggggccacaaaggccangccagttagcttcgctctcgcaccgggcccggccatggaagaagtncctcaagaggttctgggcctcttctttcacgcncctcccaggagaggtctnctgagttagccagttttaaaaggggcgggcaaagctttnaacaactncttggaagcnaacttgcncnccttgtagaaaggggtgagggacttnaccacaacanttgcagcctccttcaaggagaggccaggngcggagagcnggaaggggttttgagccgtgggatttaaggggccccgttcgctggccgagacgctgcccttna

SEQ ID NO: 640424 - DNA, 316 bp, Homo sapiens
  misc_feature (16)..(17): n is a, c, g, or t
  misc_feature (202)..(202): n is a, c, g, or t
  misc_feature (212)..(212): n is a, c, g, or t
  misc_feature (214)..(214): n is a, c, g, or t
  misc_feature (254)..(255): n is a, c, g, or t
ttcaagccttcagtanngtagggatgcttttaacttttattattaattattttgagatcttaaaaaaatagaagaacaccccctccatttttgtggtcattgaaaagctcatttcacagtaccagagatttttactgggagtatatattttggaggtaggcatagagggagccctaccccttccacaaattacgttactcangagacagctncnataaaatgcattatctccccagaccagagacagtggcccnntaaaaaaatcatggggctggaaatttcccaaatcaaaccagcctcctggtgcttgaaggtt

SEQ ID NO: 640425 - DNA, 601 bp, Homo sapiens
cattcaaatactattttttatccacatttttttttgttccccaaactgtaatgtacaaggcatcatgtgtgcataatgcttgtggattttgcagtcaatatttcttttttctttccagaggaaaaaactgcttggggatatttttcagcataattttaacactataatttcaggcatacagtgattattggctcaatcttgaccccacaattttcagggtcaaaactattaatatgtcgtcaacgacaatcctgtggcacacagaagactcctgcacgcttcgcatgttggaccatacgatacaaatgtttcacagcagtatactacttttttcgggttgggacattcactatacttacaatttcagcaagcaggaaactgcgtaacaatggttacaataccttgtaccaatgcgctttaacgttacgcaattggattggtacgcatggggttccctccagaggtttcaatgcatatgggcagcagtttaacacattatatcaagattcgtttactctcgttaattcattttaccagtaaatttggaataaatcctaggggtcattatcacttaaataatactgtacctaggtctttcaaa

SEQ ID NO: 640426 - DNA, 112 bp, Homo sapiens
ggcgagctcaaggaggacagaaaccttccgtggagcagaagaaatattatactagcatttaccatctcacttctgagaatactagtatatcgctcacacctcatattctccc

SEQ ID NO: 640427 - DNA, 843 bp, Homo sapiens
tctttccgagacggtgtctgtgcttatcgcccaggctggagtgcagtggcgtgatctcggtcactgcaacctccacctcccgggttcaagcagttctcctgcctcagcctcccgagtagctgggattacaggcacacgccaccacgcccggccaatttttggtattcttagtagagatggggttcatcgtgttggccaggctggtctcaaacactcttgacttcgtgatctgcctgcctcggcctctcaaaagtgctgggattacaggcatgagccaccgcacctggcagaccattttttctttatttaaaacttaaaagagattatcaaacgaatgcctaggtctttcagaatggctcaagggccagagaagcgggtcacgggctattttcctcctagcggtcctttccctatgagaactcactaatttttgcagtcacctctgtacccgtcgtactcattgacgcattaccgcgagagagaagctgagtcatggttataagataagaccttcggggagtctagtgggccctgctttgtcgcaggatttgccatcacctttaatatgggggggacatacgtgtggatgacaccctcgtgggaacacggtgtacacctgcaaaacccgggttcccgttgccgtgacgcagggagtggagagccgctttataatgccccagagttgtcgcaaccagccttccaatagtgtatgaaactgaaattccaatcctttatgcagactgtacaacctgttgtttactaacggcgagtgtaccacaccttttagccatgaagtgagcgggagcatgaccactgattagtgcagtctgttataccctgaag

SEQ ID NO: 640428 - DNA, 664 bp, Homo sapiens
gggaggaccgtgggcagccagggtcggtgaaggatcccaagatggtgggcgaaacttgtctaaaaaccattgactgggtagctttgcagagatcataccccagaacaaaaggcattgtagttccctggaaatcctggaatgagacctcactccaggttgggtgtttacctgagaatccaccagctatcgactgggcttactacaaggcaatgtgggcaagggctggcttgggtggatgactttgagaagaagtttaattgcgctgaaggtttcccgtgcagaggataatatactggcccaggtgggatgcccgaagacaacacgaagatgtgacaatctttgtgctgagggggtggtctctctccaagggccaggatgggtagaatattgagaacaggagatgggagcaagcatgaaagaaaccttaaattccattgtgatcaagcttgacccattgggagggactttgaatgaaggctttctccccaagaaaaccacacttcagaaccacgcacaacagtatccctatggggctcaaccaaaacaaatcgagacatttcattccacttgagtccaggaaggaagctctggcccttgtattacaacattctggaccttcaaacattataatttatacccgtctaacaacaccaacaaactcaca

SEQ ID NO: 640429 - DNA, 236 bp, Homo sapiens
acttgtccagcgtagccggaagcctctaccgagactcaatggctgaacaagcccggaaacctgaactaaacctctcaccctcagaggcaatccccaaaggacaggactaaaggaactagcatgagggaagctttgaatgtcaatgccctcatgtatctagtatgggaatataataaaatcttctatttccggagttgtcaataactcattttgtaaccttgggccagacaccttat

SEQ ID NO: 640430 - DNA, 1348 bp, Homo sapiens
cgacgccaacggggtctctcgtgatcgcggcgcgaggcaggaggggcggggcaggagggcctgctggcagtgcccgggcctgccaaagttgtcagcaatggtctgatgggccggactgtggtggccccatgagctgactgctgatgtgctgtgctgggactctggatgtactgtgactggatgcccctgatgctctctatgcccgacactgcctgccctcgggccatcctcccggatgccctcggcttccgcacaccccaagttctggcttcacctgtgtccttatctggcggccaagagtttcagccctgtactcacttacatgggcctgcttggggacgtccggggcccccccgagactctggccagcctcacagtcctgtgggcacccgtctaccccgccatttccaacgcttacttgcatgccggtcgcaagtccaccaccccttttccgggacgaccgttcagcccatgctctactttctcaaggaatccagtgcccaggtgagatcctttgacatcttcgcagcggcagaatcccaaccatgctccgacaggttagactctctttcacacttcaacaacacgggtccttcgtatccaacgaaatcttcgtctcctgcccccaagagtaggactagactttcaaacctggcgtacatctcaactcgacggcccccctaagacgcttcccggggcaaccacaactgactaaactaaacatacccgcctacatcaatattagcgcgcacacacgcgcgtaagatccctccaagacaacactgcccttcgtctcgcacagacagccatattttcaccgttacacaaaccgctaatttatgccgcccccttatgccctccaactagcgctacaaagcctactcgagcacacaccccttcgactcccgcgtttcatagcaaggtataactccacacagcgacacaacagcccacattttgtgtacccacaccgtcgtgacactacgtaagatatccgagcaacaacacttgccgccgcagatgcgacggtgcaccaccggctaccgaccacagcgttcccatcgctgtcttcctcacgaccgcgcatccactatggatgcttgtgatccgcgtacaacaagccggcctacccaccctcctccccctgcgtgacgcgcgcctgctgttctctcccctctttgatggtctcgacgcggctgcttactgtgcacttccctagaacctcctgtgtgagtcgctccccgtcccttcgtcgttctatcaacacctgtgcgagtgctctcacgcccgctgctcgcttatcccccgctccatcccacctgcttcgtcgcctgcacctcctgatgcc

SEQ ID NO: 640431 - DNA, 248 bp, Homo sapiens
ggcgagcgactgagtcgtccgtgagaaaaaagaggcgaggctttttccgagatcgtctcagctatggcgcttcgctcgcagttttggggttctcgctttgcaggaccctggtcaggttcgcagccctgtcaaccagcttccaggcggcagccaaacttgagtggccctgtggaaattaagctgtgcccagattcaccaaccggacccccggacctggagcttttatctgtagccaggaaagacggctg

SEQ ID NO: 640432 - DNA, 124 bp, Homo sapiens
tcggtacgtcccatggcttagtttgggtacacgtcgtagctccaagaaatacaaagccattgtatcaaagaagcgtagagtaggtcaaataatacttgagatcagatgattaaaattctgagat

SEQ ID NO: 640433 - DNA, 1244 bp, Homo sapiens
gacagagggtgatcccgagggatctagacttcatgtgtcacgagtgtgaagactggcttcgtggtccctgatgggatacgacattgaacaggctgtgctagtgtgagagcccattgggataaccagggtctttccgacaacgctcaacagccgaccagacacagtttgatgatgattcccggatctcccagaaacgctcctggggtatgctgaagctctgagtctacatcacaagacgccaggtatagtgagccacaggaccaaaggtcttatcgcacggttgcctcggagaccaagcttcatgctgaacctactgatgtgcgaggagacggaagatgcgtgtcattgcagggcaacctcaacgatttctaggctatgctttgagaagacggtgcctgacgtcgccgcgaacatgggccctgcaacatggggcaccagggagacgcgcacggaggccaggccagtcggggcagcggatcggcaagcgcaccgggccccgttgcggctgggtagcgtcggtcatgggttggtcccttcgtattcccgacaagaggccttttctagggagtgcgtagggcagcgaagctactcgccttgctaggtcgctcgcctttgcgtacgggctacgcattcccttagggcgggcgcggacctcgggtcgagtcaccacccattcagccttcggcacctttccttgggcggttgtaccttgggtgggcccgccgttaggcacgaaatccccggtgttgcacctacggccttggaggcgacattggttatcccctgtgacttcgcgtggcacgttggacgtgccattgcgggatgatctccgggcctcgccgggggggagaccggggcacgcgggttggacacctcgctatttccaaatgcgtccagtcacatggcatgacgcccttcgacgaaagcatacggtctgaagggccatgggacttggacaccaattgcctccggagcaaagacaaacctctgtgcctagtggaaacagcatttgccggggcacaagccggcttgggtcgtggacctttcccggttgcgggggctgtgatacccgttgccccgcgtcgcacggcgggcttcccgttgtgtaccttcggaggggcatctctacctggtggcgtggggtgcgatgtgccactccgggtggtgaggccattcactgagtcggcggcctccttggcgtctgcgacggttgcaggtctgcctgcggctttgtggggacacct

SEQ ID NO: 640434 - DNA, 207 bp, Homo sapiens
  misc_feature (207)..(207): n is a, c, g, or t
tgagagtctctgtggtctctttgttacacctcgtataggaaatttgcgctttcttcttgtggagagggggcttttctatacacctgtgtatcattttgggaggtggttctaacgggggggtgaacccccttaccccgcctgttctctttattatttttatctctgagagacattattctgcggcccgtaatatatagaagtgtgggn

SEQ ID NO: 640435 - DNA, 250 bp, Homo sapiens
ctgcattcaatatgttcatcattattgcactctgtgttttatgtggtgcctgacggagagcaaggaagtttaagcatttgcgtgcttcttttgtcgacagcagcttgagcatctttgcctcacctgctttacaatatttgtcttgcatatctcttggtgttgtggggctgggaaggtttcttactttctcttctttccatcttgtgttgtgtccgttggtacggataggagctctggttcaagattgctc

SEQ ID NO: 640436 - DNA, 1326 bp, Homo sapiens
  misc_feature (1326)..(1326): n is a, c, g, or t
agaagcggggggagggggggtttggtgaaaattttggtggtatgatgtctgtgtggaaagcggctgtgcagacattcaacttgttattaaaaaaaaaaaaaaaaaaaaaaaaaaaaaaaaaaaaaaaggggcggggcgcgcggccggcagatctaaaaacggtcttatccgcgaaggcgggcgcgcgtcaaaaattctccggcgggggggggccccagtatacggcgcgttccccccgaggttttgtgtgtgtgtccccaggggggtgccccatattggggtggaggcgggtatttatataaggcctgagggccgtgggggcgcgcggcgtttttaaccacacgcgtccggggagcggggggacacaccggtggcaacgctgggggaactcctctgggggagagagggaaacctcttaaaatttgcgggggggggggggggcaccatatatgttggcgcgccccacaacttttactctaaagagagagatattttaaaaaggtccagaaggggaacacattttcaaccactttcttcgacaggggtgtaataaccgtgtgggttcaccccctgaggggcggaattatagggtggggagcgctttagaaaaaattgcggggatcaaagcggagaataataacatttttgtgggacacacttttttttataacgcgggggggttctctgttgttaataatataagggaaaagatagaagagaaagaaagaagagaaaaggacgcgtaaagaagtaaaagaatagaagaagaaggaggacgaaaaggagaacaagaggagggataagaaagaaaggaggggcggaaaaaggggggggaggaggagcgggagcggaggagagaggagggagagggagggcacgaaaacagatccacagcaaaataggaggaggcacagagcagggacaaaggggcacaaacacaagaacggacggggagggggaagcacccagcaagcaacgaaagaacaaacgagaaaccaaaagacacgcccgagtgcgagaacacaaaagagcgacggacggagaaaggaaggacacggctgagccgggacgaggagcgagagaaagaagagagaagggacgggaggacagagcatggcgcgatggggcaggaagggaggaaacggagaggaagggaggagacaaaaaacgataaaagacgaaggaaaaaagaggcaaggaggggggccagacggaggaacgccaagcgaggacggcagcaccaggacgaagggaaggagagagagagagcggcaaaccggcgcgcccagagaaacaggcggacaagagagatctgcgaaaacaggn

SEQ ID NO: 640437 - DNA, 726 bp, Homo sapiens
  misc_feature (14)..(14): n is a, c, g, or t
  misc_feature (79)..(79): n is a, c, g, or t
  misc_feature (84)..(84): n is a, c, g, or t
  misc_feature (139)..(139): n is a, c, g, or t
  misc_feature (142)..(143): n is a, c, g, or t
  misc_feature (197)..(197): n is a, c, g, or t
  misc_feature (212)..(212): n is a, c, g, or t
  misc_feature (226)..(226): n is a, c, g, or t
  misc_feature (246)..(246): n is a, c, g, or t
  misc_feature (282)..(282): n is a, c, g, or t
  misc_feature (285)..(285): n is a, c, g, or t
  misc_feature (307)..(307): n is a, c, g, or t
  misc_feature (346)..(346): n is a, c, g, or t
  misc_feature (349)..(352): n is a, c, g, or t
  misc_feature (370)..(370): n is a, c, g, or t
  misc_feature (391)..(391): n is a, c, g, or t
  misc_feature (395)..(395): n is a, c, g, or t
  misc_feature (403)..(403): n is a, c, g, or t
  misc_feature (414)..(414): n is a, c, g, or t
  misc_feature (418)..(419): n is a, c, g, or t
  misc_feature (436)..(436): n is a, c, g, or t
  misc_feature (455)..(455): n is a, c, g, or t
  misc_feature (495)..(495): n is a, c, g, or t
  misc_feature (499)..(499): n is a, c, g, or t
  misc_feature (525)..(526): n is a, c, g, or t
  misc_feature (528)..(528): n is a, c, g, or t
  misc_feature (643)..(643): n is a, c, g, or t
  misc_feature (654)..(654): n is a, c, g, or t
  misc_feature (666)..(666): n is a, c, g, or t
  misc_feature (725)..(725): n is a, c, g, or t
gtctcaaacagggncggaatgtttaacacagaaaacagggggttttagcactcactcgttctcctggctcccgaaatangagcngccctgccccagttcatccaagcccatcaatatagttgtcctcgtccttaatctncannggtgttcaatgtgagccaactgtcagatggctttcatttgctcaactgaataanccatttatgcctagngttccattactggnacgctaagcttatgggagtnatttatatcttactgctcgaggtcctcaccaagatntgnttttttcacaaaaaaatttgtnatctccagcataaatggaataatcaaagcaattgtggcngtnnnnggggggcagaactctagngtttaatcttcgcggcttgantggnttgggggngttcctgtcantgtnnaagatcttgtggggggnggtgggggggcgcgggggngggtccccgggtgtgcttcgcgggtcgtggcccggtcgtngtcncggtggagtttctgctgcaggctgtnngngccttcttgccgagggccatgttgggccttgcaatcgtgctggcggggcggctgaacgaggggacaggtttttgaagccacccataagtctgagaaatttcagtttttggtcatngttctcaaaancagcagtatccnactggccaaactgggttcccgtccacttcctggtttcagaagcttccgttttgcctgant

SEQ ID NO: 640438 - DNA, 614 bp, Homo sapiens
ataagctggtcaagaaaagaaaatgaagtcctccagtaggggactcaataacttaagcaggtggattcggttcaagacagctttggcttgtttggtcaactccaggtgacatgtccagtgtagtcatgcagcactgtggggttgaatgcatccactagcatcttgtggagtttgagctctagaaccatctcattgagcagcatgtcatgtgcatctttgttgtagcagtatacgctatgagttagttaatgcccgctgggagctgtgactgcatacattagcattggcagctggaccgcaccgggctataaagcccctgtacgcaatgtcaagtacatgcatgaccgcacccaagttctcatcataggatctgtcatagtcatacttggtcacgtccaggaaggcctccagcaggtcaacatagtcgttgttcaccagcaggccccaggggcacacactacccagtgagcactcacggactgttctgtcaagatccgcctgagtctggatcacaacccctaaccgcgcgacatacgcgtgcagagctggaccgttccgcgccctatacctgcaccggtgacacagcagcagtcggtctgcgaggaacagctcca

SEQ ID NO: 640439 - DNA, 610 bp, Homo sapiens
  misc_feature (147)..(147): n is a, c, g, or t
agcggtactgtttgatgatgatatgatcatatacctagagaaacctaaagactcctccaaaaagctcctataactgataaatgaattcagcaaagtttcaggagacaaaattaatgtacacaaatcagtagctctgttataccccangaagcgaccaagcttagaatcaaaccaagaactcaaccccttttctgatagctgcaaaactaaactaaactaaaataaaatacttgggaatagacctaaccaaggaggtgaaagatgtctacaaggaaaacaactttagtatttttaatgggttaaaatgagaggcagcaggtacagcagaagaagtcagtgcgtgggcatccgcatccaatgggtactgcacctttgatggtaaggctttggttttgacttactaaattactaggtacgattattttctagtttttgtcattaaaccttaaaactactaagtaaccccttccatttcttgttaaatattgtaaaatttcatactctcatttatgctggctgacgttagagtgtttgtttctattttgtgactaccttaaataatacctattaagagtaaactgttagtagtggtgttgctgtgattaaatgc

SEQ ID NO: 640440 - DNA, 785 bp, Homo sapiens
  misc_feature (605)..(605): n is a, c, g, or t
  misc_feature (612)..(612): n is a, c, g, or t
atcaaagtttattttaaaaaaaatgaaaagacatgcctttgaatttatgaaatataatatatacaacctttctgaagagccccatggttgattagtgtatcttaggttctgagaaacactgcagtaaaaatatctgttaagatttctttaaactagcatttcccaaaccacctgattagccatttgagtttctatcacaccactctgtctcataacatttgttagaatttctttggctctttcactgccaagttgccttattgtgaggaggcattgaaaattgggattcacccgtaactcactgccatgcccaaggaaggcattgctgctggaggcgtagtggacattaacactgctttgcaagaggagctgaagaccaccctcatccatgacggctaccatggggaatttgtaaagtagtcacagtctcagacaaaagccacgcccatctctgtgtttacattcaactgtaatgagctttgtatgtcaagttggtggaggccctttgtgctgaacagcaaatcaacctaattaagactgatgacaccaagagactaggaatcgatagtggcggaaaccccaaaaaaatggttagttgcagttgngtagtantaaggtctatggcaaagaatctccggccaaccatgtcattaaagagtgcttcaaatgccagaaatgaacaaataaaatgttggctcaaaaaatttgaaaataacatggaatattatccaatacaagcatggcaaaggcaggctatctattgaaatatttgaagaaattctgag

SEQ ID NO: 640441 - DNA, 832 bp, Homo sapiens
gaagcaagctagttcgcctgagcgttgataatagatcggccattcattggcagtatggtgagattgagttatctcaatcagtcgagcaaggcctattcggattccatactagataggtccaggagattggtgaacacatgtgctaacagccctggtagtaatgtggaactgacattaccattcgtctatctttgacagaggaaacttagtcgtgatccaatagtaatattctggaccgcaagctttccaatggagtcgggagggttcgctggcagtttgtaatacatcatttacggtaagcgcatttcccgataatcgtgccgtttatccattgtagctacagcaacttatcctaggagaactgtcatcttcgaaggggtccccatactcataggctgcgacagagaaatccgcaacgttgaaagtgtaatcggggacttgaaagagaaaatttacttcctccttgaccctacaagcacttctaagaggtaaacctacggaattacggctacctagaagaatgtccgaaatgctaaccgctaggcacaatttgccgaaataacaccccttctgccacttcccccactccgggccttccgatatggccaactagacaccacggcgctataaatacatacccaacggagagcgcgaccacaataaccgatggcgaacgcgaaaccacccaatatccaaagaatcaactagagcgtccaccaaaccaaacaacacccgcggggaccacgaccaaccacctggggcgaaaagagcccccgccaaacacataacgaggaccctcagcacacacccaggcagcccctgagcatacatg

SEQ ID NO: 640442 - DNA, 357 bp, Homo sapiens
tagaatctagaggatcccagactgtcacaggttgagtgctacccatattcactcagagagaatttaatccagtactggcagctccaaaggcatcgtgtgtgaccggctacagacccctgtcgggtctcctagacaggtacctgtggccaagcccgatggaccctatctctcctggcaggatgccaggaatcaacgcagatcgcatgacaagcacacataaaactacagcactcaggtcctgactccggcttccccatgacagagcgaacttgtgtggtgtatccccagacgtctgtgaccaccaggacacgcattgctgaggaacgtttaaggtctttggacttgttgaactgggca

SEQ ID NO: 640443 - DNA, 869 bp, Homo sapiens
  misc_feature (285)..(285): n is a, c, g, or t
agcggagggcttcgcttgagtacaggagtggttggcgttgatgttgcgttttctcaacggcggcatccgaggagttcgtcctcaccactgcgcgccgacggttcttagactctgtgagtaaagacagcttcatcttcccagttcatcatggcttcaacatccagataacaacgaacttgatgcaagtgataggtttgccaaggtcagacctctcatcatccggatgaactgcaatttccagaagcatgcacccttggaagagttctacagctttggcgagttatntatggcaccgaaagcgaaggaagctcctgctcctcctaaagccgaagccaaagcgaaggctttaaaggccaagaaggcagtgttgaaaggtgtccgcagccacacgcaaaaaagaagatccgcatgtcactcaccttcaggcggcccaagacactgcgactccggaggcagcccagatatcctcggaagagcacccccaggagaaacaagcttggccactatgctatcatcaagtttccgctgaccactgagtcggccgtgaagaagatagaagaaaacaacacgcttgtgttcactgtggatgttaaagccaacaagcaccagatcagacaggctgtgaagaagctctatgacagtgatgtggccaaggtcaccaccctgatttgtcctgataaggagaacaaggcatatgttcgacttgctcctgattatgatgctttcgatgttgtaacaaaattgggatcacctaaactgagtccagctggctaactctaaatatatgtgtatcttttcagcataaaaaaataatgtttttcataagaatgacaacttaattagaatcaaatctataagctttaaaaaaa

SEQ ID NO: 640444 - DNA, 1041 bp, Homo sapiens
gactgaggcttcagcgggtgccgcccggcctatagtggagtggagcggtgagcacgtcaggcgtggggggcgcaggtcaagctttcaccagtttttaattctttgatggggtaaatttgagcagttttctcgacttgtcgacattcgttcattaactgatgccatggaatcaggagaggatacccggtcctctccacacagcaccagcacgtggtagacaggatgacagtcaatatatgtaagatgatacgttggttccctcgggaaaggcgggacaactcgaagcagggtagggggcttccagcgtcactaggagtagcctacgattagcatttgctagtctttacgtcctgcgcgtgaggctgctacactacatgtcagaagtcatgctggtggcccggacattgaagggagagaagtggattcgggagacattgtagtgagatggcggctgtgagctaatgaagctctgtgattccttccgtaaacgtcctgaagagcaatagctggaggctcttttcaggccaaggactgcgagtgtgagtggtgtacgctaccactggcaaaaaagaagatccgcatgtcactcaccttcaggcggcccaagacactgcgactccggaggcagcccagatatcctcggaagagcacccccaggagaaacaagcttggccactatgctatcatcaagtttccgctgaccactgagtcggccgtgaagaagatagaagaaaacaacacgcttgtgttcactgtggatgttaaagccaacaagcaccagatcagacaggctgtgaagaagctctatgacagtgatgtggccaaggtcaccaccctgatttgtcctgataaggagaacaaggcatatgttcgacttgctcctgattatgatgctttcgatgttgtaacaaaattgggatcacctaaactgagtccagctggctaactctaaatatatgtgtatcttttcagcataaaaaaataatgtttttcataagaatgacaacttaattagaatcaaatctataagctttaaaaaaa

SEQ ID NO: 640445 - DNA, 279 bp, Homo sapiens
cgccacagctctcggggttgcagactttcacccacagaatatggtccaatggagccagtcgatgggctggtcccggttcgaacatgacaatgtgtatgtgtgaactgtgctgtctctgtcaatgtgtgtcactgtgtgtgactgtgtgtgaatgtgtgtgtatttgtgtgaatgtgtgtgctatgtgtgtcaggtgtgtatctgtgcaatgtgaatctgtatgtgaatgtgtatgtgtgagtctgtgtgcctatgtgtgtgtgagaggctgtgggggct

SEQ ID NO: 640446 - DNA, 175 bp, Homo sapiens
ctgtcgctgctaacattctctttacctcaaacatcctacatgtagccttgatcctattcatgctgtacactagggggagtcaatacttcctaaagcattctttagttttttttttagaatgcatttttttcttattcgtaggggaagggtccagttcggggatcctctcagaagt

SEQ ID NO: 640447 - DNA, 202 bp, Homo sapiens
  misc_feature (25)..(25): n is a, c, g, or t
  misc_feature (80)..(80): n is a, c, g, or t
  misc_feature (123)..(123): n is a, c, g, or t
  misc_feature (175)..(175): n is a, c, g, or t
  misc_feature (189)..(189): n is a, c, g, or t
cagcggcgtgccctatttctacctnagcccgctgcagctctccgtgagcaacctgcaggagaatccatatgctacactgnccatgactttggcaaaagacaaacttctgcaaagaaacatggntttgaattcaaaaaagtccctttgtgttaaaataatgctgtaaggaatgtgnacaaaggtgaatgnaacagaaattggt

SEQ ID NO: 640448 - DNA, 1777 bp, Homo sapiens
  misc_feature (40)..(40): n is a, c, g, or t
gtagttgtgtggtgttggtggttggtgggtcgagggagtnattgtgtgtgtggaggtgtggggtgatgtggattgtttttgtgttggtagatttttgattgtgtgtcgatgtgtgttcgtgttggggtgtgtggttgtgtttgctggttgatgagtgttgggtgggatttgatgtggttggtgtatgtttggtgatgattgtgtattttgagggttggtttgtggttttggtggtttggtggggttgtgggtgttgtatggttgtggttgttgtgggtgtgtgacaacagagaaagtaacagacaggacactaagtaggagccgaacgatctggtgtgattgtttggaggtatgcggcgctgttcttctttgtggtgggtgtttatagggtgtgatgatgagtcgttgtgttggttagacatcgctgacatcgagcggaccgctggggtgtgctaacgacgtgtgtgtggacgtaagacacggggagggatcgctgggttgcaacggggggtttgttgccgctgggccttgtccccgcccatgggtgtgagatgttcggtggtgtgtttgtcgagccaaccgtgtgtgggagttgtttttttgtgttagtaggtgtttctcgattgtggggggcagactgcaatgtgttgttcagcgtcggccgcgtcttgtggtgtcatgggtgggggccccgtgggggtggtgtccgtcaggcggggagagtgttgttgctattgatgtgcaccgggagaggtcactcgcttggggctgtagtgttagatgtagattgttgggggcgtggtagatgtggctcgatgatgtgattgacgcattggggggacacgcagaggaagaaaagagggggggtgtgtgtgatagatatatactgacgggggcacccctgtttctgtgggtgtgagaaatcacagatgtggtagatggaagagacgggtttttttcttgagagcgaatatcacaggtggcgcacacgtgggctcacgacttagaacttctgggagggaccgacgttgggcggaggacaccacgcggcggcgctcacagggtgattatggttgggcgagtcttttttgttgatgagagagattgtttgtgggcggagtgtggttggatgatgcataaagagttttgtggtgtggacccacgctctaatgacatgtgtggtgtgtattatgagatatatgttagagagaaactatatatgagatgtgtgtatttatgcatcacactgtgtgttgtaattaactaactgtggggagtgctctcctcctacaagaggcacgtgcgctcaccaacacgatggatttgatgtataacgagcagggagagatctgatcgaggaaagccggattgctgagggcgccccagctagcgatcagcaccagcagagaggtaggatgagggggctgcacacgatcgctcggttgtcctttcaatggagtgacgaggatggtgtgtgtcgtgtgaggagcacgtagtggatagtcatacatcgtcagaactcacgctctgctgaagtttggtatgtgcaggtctttgtgtgtggtcactgtgagcgcagagagcccattctcatatatagaggtggtgggtgatgatagatagatgacagatttgttttgttaaaaggaggagagggggtggtgcacacacacaaagcggttagaagtggccttcaagagaccgatggggtcacctgaggatgtgtgtaaagatgtttaatataatgttgcctctttctttaaaaaaaaaaaattaa

SEQ ID NO: 640449 - DNA, 261 bp, Homo sapiens
ggattgctttagactaaaatgaacaataacaaaataagaactcacttatattctttatatggtcaataaagaagtgatagtggaaaaaaacaagatcaaatgaaggtgatgatttaggaagttggaaagatagctgaaactacaaaatggtatataaccagtgaacacttagacacactgattgatgaacttcagctttagcttggtgagagcataaaatgagagcagctgaggtttgcaaatttgtaatctccttgtgga

SEQ ID NO: 640450 - DNA, 373 bp, Homo sapiens
gtgtcctgagtattgtctcgggggagtgacaacgctagccatgtacacccattgttgagtttctctctcagggctggagctcttcagtcattctctccatctgagctgtccacagatatatgcttgtgacaatacagcatggacgatgtcaccaagtcgggttcgacacaacccaccgttttcaacgtttttcctccaatatgtctttcatgattctgcagagtgttctcaaactttgtctttttctcttcctgcttctttttctcttcttcatcctcggaagtccaggccttctttggtgactgacactaaagtcttcccctcaaattccttcagctgttggacacagtactcatcaatctgtcaatcataa

SEQ ID NO: 640451 - DNA, 200 bp, Homo sapiens
gtgtattcaccactgcggtgcatgccatccctgaacaagttccgatcgacacgtgagcaccgtgctgagcttccaaatatcgttaagctggcgcctggtcgacgtgtaatcaccattgcggtgcatgcctccctgtacaagttccgtcgacacgtgagcaccgtgctgagctccaaatatcgttaagctggagcctggtc

SEQ ID NO: 640452 - DNA, 117 bp, Homo sapiens; identical to SEQ ID NO: 598175

SEQ ID NO: 640453 - DNA, 288 bp, Homo sapiens
  misc_feature (29)..(29): n is a, c, g, or t
aggcttaaaataatttttccgggcaatanagagtttctttttttggcttagaatgtcataaatacatgtgaacacgtttaatgcagggctttttattctctccaaaatgtcaacagtattttcagaataaagacttttaaatatattgctgtagtggttaattctggtcctttgtctttaatgtctttttgagtggataaattttatttacccggtttgtagtttttttatttccgtgaatttttgaccttgcaatgggttgcttttaaagagatttttttaaaaaaa

SEQ ID NO: 640454 - DNA, 1296 bp, Homo sapiens
cccgtccattaccaccatcgttccacttgcacgattggctgtgacatccgggccagaacagatggcgtcagttaacggcagcagccagaactgtgtctcgggtcaggagcgcggccggcctgggggtccatggccatgtcctgcatcaatgaactcatgtccacagaactgtgtgcctcatggcatctctgaggcagtctttactgcgtcatgttccagcagactttctcacctccatgccagacaacatcaccaaggcataacacatgcccacacagtgacagagccaggctcagcacagcagctcgcatgcagcagctcatatcgcagcaagtttcactgcacttctcttcgcgctctttggtgcagatgttccaccataagacagcaatcgcagtcttcactcccaggttcccatgctggctgcgcaggttccctgaccacatcttcagtaccaagatacacattctccatcagccatactcatgacggttcacttcatcattggatccgcactctctggcacagctcgcttcctagggacctatctgaccacagtcacaattccacaccgtccgaactctgggagaccaaggcaacgcccagccctcccaacaggtaccgacacccatgccactggctgcctcccagcactcaccagcagggcggatgcgacatcgcactccaggacccaggcatcacaacaccaaggccacccaggcatgggacgcgacagctcagggaccgcaacggaccacttcgtgggattgaacggcatccagaacgaccgcgacgtcggacacgcaggaacactaacgggccacacagcctagcgacgcgctagcggcgaccacaagcgcatggcaagcatcactgccacacacgcacagccctgtcagccccaaaacctggtacacaggcgaccagtaaagggacaccagtcaccgacacgctaacgtcaggcgaagtcacaaacgagggacacgaacagagaccaccaccacgctgcacccccggacaaaccaccgggttcgaacccactcaccgcggcgcgacgaacacgacacgacagcgcacgcagacaccggcgacccaagtacagaaacaaccgaacacaacaccccgcgccagcgacacacccgcaggtagccagccaccggcgagcaaacagacaattcacacgccgaagagagtacacaccgccgagcagacacaccacgaggcagcacagcagcacgagcgccgaaaatgcgcgagaaccacatcccagaacaagccaaccaacaaatgcggcca

SEQ ID NO: 640455 - DNA, 916 bp, Homo sapiens
cattgttggttcaatatatgaggcaccattgtagtcttttaggaaataaattagcttttatcacagatttaggaaacttgtctaaaaaaactgtgatcatcagttacagagggaaggaaacatattgaacacaaggcatcatagtagctggaggccttaaaaattatgcacgaccaaaaagaatgatttggtgagagatgtgtagctgattgacaattttagtgtgaattcatattcatttaacccagcagcaatctacataagctatgctttttcccgcctgtatttatgtttcttagcttataaagtcccaatatattatatcttttgttgctttggcagttttaatttagagctctgcgttcacagagatgccacctatagcaaaaactatctttaagaattggaaaataaaatgaatgttttagataaaatattgcaagccattatgtgtagagttaatgtatggaaatttgcatttgtttttctgaatcatggtgtacattaatcactcattgaattctatttctaagcaaataagagaatcaaacatttctaaaaggaacatatgtcttgctattaataacaaggagacaggtaaaatagtaaggtaatataagcaaaaaaaaaactgtcctgaatttagctatctaatgggattttaccgatggtgcttctagaaattgaatctttgaggattccgtggttatggtcccaggaaatgattcagggaagaactataaaagatgtggaggaacgattggcgaaatttttgaaaacgctgtgggaatgtggctttaaccaggaaaatacaaatgtgttcataccgggtaagagaagtacagtaccgagtgaaggggagtgataaggggagtgaataaaggaaaagatagagaagagaagtgataagagggct

SEQ ID NO: 640456 - DNA, 219 bp, Homo sapiens
cagctgtagcgatgagagccatctgcaggacagaagaaacaaaaaaagatgtcatacagcaggttcatggataaactgtggacaatccagaaagctttaacattcttcaaagaaatagaaaacacaatcctaaaatttatatgggaaccacaaaagacttagaatagtcagctatcctgagcaaagggaatcaaactggaggagtcatattacctgact

SEQ ID NO: 640457 - DNA, 1666 bp, Homo sapiens
tattttattatattaaggtggatatatacgtattaatataaaactccgtggaaggggttatggcagggtcttcatcagtagtcccttcaaattaaaaaaaaaatatacaaaagtctcaggtcagaacacggtcagaatcaagaagagacctacaactctatcccacgaacctccaggggccacagatcacatctcctatatgagagcacccgtgcaggacactacttacaggaggaaccccctgtggaaaagatctcaggaacactaacacgagagataaaagcggagagagacaggaacaaccgggtgaaagaaatataagcatagagacgcactacatagtcacaatcacacacactcatccgtgtgaatgagaggtataccatcctctcgacaatcttactcctccacgaagaacacccagtttaacttcatccctctccaacaagagcctctctctctcacaggaatacgcaccagcccccaaatatatatatagggggaccagtgtatcccccgcagaggaaacaccttgagaacgcccgcaactatgacaccccgagaaacgggggcatacccgccgggagaacctaactaagagaggaggaaaggagaatagagaagaacccagttgggagagacctcagagacgaagcgaaaaggggagagtgcataaccccacggagagaaaaacacagtagtaaagaaaccagaagagaaaccgagagagagaggagtcccccccggagagaacaaccccagagaggaaaaaaagaaaccccaacgcaaagaagacgaacgaacacacatgaggaagagaaaaaacaaacaggacgagtcaacagaaaacacagcaggagaatagaacaagaagcgaataccgccggaaaggaggagcaacggaccactaatgcacacgagcacaccacgaagagacaaaatgtcaacacacctaccaccaacaaccacaaatataaaacagtgcaggagaggggaagaaaaacaaccctggatggacaaccaacccacgaatggaaaaaccacaccggagagcagagaagagaacacaacacacggaacaacgccgagaaaaaaaaaaaggcgacacaaccgacacaacaaagagaggaggcaataacaacacacaacaagaagaaacaacgccgagggcgacaccccagaggagaggcgaccacaccaaaaagtagggaacccacgagaccaaaaagaagccccccatccggaacagttatgaacacatgagaacgaaccacccaagtcaacgggaggacaaccaacatgaagagaaggacaaccaaagaaatgtcacccccggtggtggggaaaacacaccaaggacctagagtcggaagatcgtattgagtgcaacaaaaccacccgacagaactaccacacctagattacaactgcaccggggaggaaaatcaagcgagaggcgaaaacaaccaggactgcgacatgctgaacaacctcccagaggtcagaaaacacaggcacaccaagagaaaaactacacgccaggcaaaactgcaagtaggcagcaccacaatcagcaagagagcagaaagggacagaagggaaccaaagcaaacacagcatcaagacagggcagcgacgagaccacgacacaccaccgacagcaggc

SEQ ID NO: 640458 - DNA, 217 bp, Homo sapiens
tttactcaatattaattacttacaaataacctcacataaacactactcagccataaaaaggaatgaattaatgacattcacagcaacctggagactattactctaaaggaagtaactgaggaatggaaaaccaaacattgtatgttctcactcataagtgggagataagctatgaggatgcaaaggcataagaaggatacaatggactttggggact

SEQ ID NO: 640459 - DNA, 232 bp, Homo sapiens
ggtggcagatgagtggtcagtgtcagcttccggccgtgcccagacctgtgcccagcagacctggctgaggccgtgtggggctgctgtttgcaggccagtgaatccggtgaaacgggcaccgttcatgtggcttgtgggaactgtgggtgtgggtgctgtctgtgttcgtgggtgtacacatgaccctgagacagtccagtgcaggtcccatggattccatgtctgttcttca

SEQ ID NO: 640460 - DNA, 819 bp, Homo sapiens
gtcctcttctccagcatggtgtgtctgaagctccctggaggctcctggtatggcagcgctgacagtgacattgacggtgctgagctcccacactggctttggatggggacacccaagcacgtttcttggagcaggctaagtgtgagtgtcatttcctcgaatgggacggagcgagtgtggaaccatgagtcagatacatctataaccaagaggagtacgcgcgctacaacagtgacctgggggagtaccaggcggttgacggagctggggcggtctgacgctgagtactggaacagccagaaggacctcctggatgcggaggcgggccgaggtggacacctactgcagatacaacttacggggttgtggagagcttcacatgttgtcatgcggcgagtccaagcctaagtgtgagctgtgtagtccttcaaatgacgcgcagcgcactctgcgatggaccacgaaccgtccatggtcgtgctctgtgaagtggttatctatcctaggcagcaattgaatgtcaggttggttccaggaactggccaggaagagaaggctggggtggtgtccacgaggcctgatccagaatggagactggactcttcgcagaccctggtgatgctggaaacagtacctcggagtggagaggtaacacctgccaagtggagcatccaagcgtgattgagccctctcacagtgcaatggagtgcacggtctgaatctgcacagagcaggatgctgagtggagtcagggggctttcgtgctgggcctgctcttacttgggaccagggctgttcatctactgtcaggaatcataa

SEQ ID NO: 640461 - DNA, 739 bp, Homo sapiens
atttcaagtgggtgaaacagcagtgtgaatttgcaaaacaagccctagaacccagtaccaaggccctaaactggacctgggcttcaaggagggccagaccatcaagctcaacatcgcaaacatgaagaagaaggaaggagcagctgggaatccccgagtccggacctgccagcacaggacgggctgagcctgcttaccacccctccccacaggggggaaaacctccacacctgatccctccccctggaggagacagttgagctgtgagagagggatccctcgataccagaacagacagttgatcccagttcaggaggtgcatcctgtaccactggaccacagaccaatcctgacactgctgacatctggggagacttataccaaactctacaggatcaaacttacagaacagaaccagcacaggacacaggctgggtccagatactgaccctgagacacggattcttaccatcactgtgacttacatgggaaaggcagcaccactcatctagagcacaaagagaagggaggacaaaaagacccatcactcagatggacaagtgatcaggcggacatgaaaatccaacatacctcatcccatccatagaacaaggacataccggaactgaacaaaaccgcgcgcaatgctacaagaagactcaaaatcagagaaaacagacgaacaaacctgtaaaccaggagaactcccaaattatacaaaacaagaccaccaggagca

SEQ ID NO: 640462 - DNA, 218 bp, Homo sapiens
atcacttgagcccaaaagtttgagaccaacatgtcaagacccagtctctacaaaaaataaagaagttagctgggcatgatggcatctacctgtggtcccagctactcgggaggctggggtgagaggatcacttgagtccaggagttcaagattgcagtgagctgtgatcataccactgcgcttcaacctgggtgacagagcaagaccttgtcttgccc

SEQ ID NO: 640463 - DNA, 1219 bp, Homo sapiens
gacccacgcgtccggaacattctcctacataaccccccatgctattattgcacttaggagaattaatgatcatgtcaagtatcagctaatgtctattccatatttaaatatactagaactttcaagtatatttgcagatctggtgtgttcacctcccttcccaacctcaaatggctctttgcctattcttgtttctttctttttttgttttttgattgaagattatactgcagttagttatgtctcttttactctaaaacagaacagaaatattatattgtttttcgtgatattgacttttgaaatccaggcgagttatttggttgaaggtcctgcattctggacttgtctgattgtttcctcattgtctgattcaattcaggataaattctggggtataggttaggagctattctatactacccattgtatctcctcaggagggatcgtgtccaggtgttggtgatgctgttgataagttggtgaagctggcatccacctgatatttccattgtaaaggctacatttcgtgttatatgagtagattatttgtgggatgatatgtccagatcacatgggatatttctccagcaaactttcactgatggtttagcttctagagaatcttggtgaaccggtattcaattgacgttaacacggggccacattctaatccataattgtcccggtttttgggcccttccctggcaacagaatcctttccttcccctattagggtaactctctataccacaaacgcgacgcacacaacgattatacaacaagtctcacagagtttatatcgggagcgccagcgctcaacttcgggataagctcgcctgcgccgtttataatattatttttgctttattattattttgttatgagctcatcaaccaacaacctacacgtacacagcccacatgccgcccagacgcagacacgatgaaacaggtcagacgtcaagcggaaacgagtgagacgacgcgacccttgcatctgactgacacacactgacagcacacagaacaggaccacaaacgccggccgaacagcgcaactcgaagaaacacacgacaagacagtcgcataaagaccgaaagcatgagcgagtgataatccagagacgacatcgaaacaacggcaccacacgaccaaaagcgcagaaaagcgcagtaaggacggaagtgcagccaaccagacaagcatgcaagcagaa

SEQ ID NO: 640464 - DNA, 481 bp, Homo sapiens
ccccgaacccaagagctactgaaacctacgtaaacagtttttataaagctgtggaaaggcgcaagttgggtcttttatcagcttcccttaacagctttccattaattgaagaaagaggtgggaggggtgaattcatttttgcatgcacaagatgtactgcttaacgaaacactatcagcttgttttaaatggatcttttaaatatcaactgtagcctggttggctaattctttctaatcttccccattactttcgcctagatttcccatagatcaacaggcatagtaaaatgcctcatcagaacacacttctccacacaattcaaaaagggagctcctgtgggctcaaagcaaccatcagtccagcaatgcccatgatttatctgaaactgcttcccaagagacaggagtgcagatctgagtagctgtgctgccaatacagataggtttagcactagatatttagtgattgtggcaaggaa

SEQ ID NO: 640465 - DNA, 227 bp, Homo sapiens
aaatcccaatttttttaactgggcttcctaatatatacttctatcaagtggaaagggaattccgggcccatggaaacttggatatgggtaatttgatgcccaataattttccctaagggtcatgtccaggtttttatacttcccagctattccctctgtggatgaaagtaacaatgttggccccgtatattttaccccccgaaataaaaaatgtgaaaaatgctcca

SEQ ID NO: 640466 - DNA, 152 bp, Homo sapiens
acacagctatcattgccagatatgaagctaagcatcaggtggcacaatacattctatgtgccgttttgttgttattcacattttattgtaacttagagaggtgaacgacctaagttacaataaaatgtgaataacaacaaaatgaaccaagt

SEQ ID NO: 640467 - DNA, 217 bp, Homo sapiens
gaaccttggaagcccagccagggacaatgcaccttcacagagattctgcactaatctgagtgaaggtctaaggtttggaatctccccctcatggagagaactttgtatggctgtctagcttgaacgtagttatccgcaacttgaccttcaggtcgggagaggtggagagccatgccttgttctccttccttgtctaggtttaagtcgacactatatt

SEQ ID NO: 640468 - DNA, 550 bp, Homo sapiens
  misc_feature (24)..(24): n is a, c, g, or t
gagctgacacatgctgcacatggnatgagccttgaaaacatggacatggccaggcgcagtggctcacgcctataatccgagcactttgagaggccgaggcattcagatcacttgaggtcaggagttcgagaccaacctggccaacatggtgaaaccctgtctctactaaaaatacaaaaattagccggatgtgcttgcttgaacctagaaggtggaggttgcagtgagccaagatcgtgccactgcacagagtgagactctgactcaaaaaaaaaagaaacatggaggccaggtggggtggctcatgcctgtaatcccagcactttgggaggctgaggcgagtggatcacaaggtcaagagatcaagaccatcctggccaacatggtgaaaccccatctctactaaaaatacaaaaaattagccgggcatggtggcgggtgcctgtagtcccagctacttgggaggctgaggcaggagaatcactcgaacctgggaggtggaggttgtcgttagccaagattgcaccactgcactccagctggcgacaga

SEQ ID NO: 640469 - DNA, 180 bp, Homo sapiens
ggtcggcctggttgtcatgagtattgattgcatgcttgcatcagtcaacatttcaggcttcgcaggctgtaaagtgctgcagctccttagctttgctgttgttatcgtgtcgctggagccatcgacagttagttagttcgttatgagtgcgcacagctgggtgccagtacaattttaatg

SEQ ID NO: 640470 - DNA, 847 bp, Homo sapiens
gcaaatggctggatgacgccgtgtgcagcgtgggtggtgccctggggtgccctgtgtggccctgggatggggaacctgctgtgtgtgcttcctgctggagtgtttcgtgcagtggcatcctggtggcctggggtctgctggccgtggactggggccggggcctgaggcctgcggagctcgctggaggcaaggccgaggataaggagtggatgcccgtcaccaagttgggccgcttggtccacggacatgaatgatcaagtccctggaggagatctatctcttctccctgcccattaacggaactcagagatcaattgatttcttccttgggtggcctctctcacggatgacggttttgaacgattatgccatgtgcagaaggcagacccgtgcctggccatgtgcaccaggttcaaggccatttgttgctatcggggactacaatggccacgtcggtctggctgttaagtgctccaaggaggtggcacctgccatcccgtggtggccatcatcctggccaatgcctctccattcgtacccctgtgtcgcatgaaggctacttggggtgtgaacaacgactcggccaatgccccacactgtacctttggcactcggtgacagtgccgctgcgggcttcttgttgcttggtaccgcctcatcccttgaacccacggtgccacttggccactcgtctccgtcaccttgctgccccttaagcaaccttgcctcactgactgggctggctactcgattgaactgccaccacgcttcgagtcctgggtgtctgccactgccgaccctgggccaacttccgccaatggcccaccgttggatgccccatttcaag

SEQ ID NO: 640471 - DNA, 127 bp, Homo sapiens
  misc_feature (2)..(2): n is a, c, g, or t
cntcaattctagattaatcgaaatcttcctgtagagtaggttatgcaggtaaaactacaccaccggctgtggatatataaaaaaaaacaaaccactcgagatagtcacagccttccatatctcgcct

SEQ ID NO: 640472 - DNA, 169 bp, Homo sapiens
ctaggacatatggggcgaagtatgtaggagctttaagattagtccgccgtagtctcgtgctactcgctgcgcttcagtaccattggtggccaattgatttgatggtaagggagggatcgttgacctcctctgttatgttcaggatgcgtagggatgggagggcgatgag

SEQ ID NO: 640473 - DNA, 130 bp, Homo sapiens
ctccttgcgtggctcttcgtgaggctcatcgggtggcccgaagagcggctctttgtgcggctctttgtgcggctcatagggtggctcgtggggaggtggagcacgagcgcacgtgttaggacccaaagcg

SEQ ID NO: 640474 - DNA, 528 bp, Homo sapiens
agacgctcgcacaagcaagagagtcatcgcgtcgacaaggtcgacgatgcagaggatgagaaatactgtgctagacaggggcacacgcctccgagggtgagcataggagatctctacagagcgatgccgaggaggaggtgcccctatataacctgacaacttgtaagacatcttgagactctaaggtctgtatcttaagatctctagttctggaggaggtggaaagaaatactcaaatacactgctggtagaggtggtgggtggtaaagtagcctatattttctttctgtttaaatatattttttgggagatggagtctggctcggtcacccaggcgggagtgcagtggcgcactctcagctcactataacctcgcgcctcctgggtccaagcgtttctcctgcctcagcgtcccgagtacctggcataacagggtgcatatcaccacacctggctaatttgggattctaagtaaagatggggtaacgccattgtgggcagtcgggtcttgcactcctgacctcaagt

SEQ ID NO: 640475 - DNA, 1177 bp, Homo sapiens
acaagatatgctgcttgccgagtagattctacctcgaatacctcctagcctggcgctggagacaccgtgggcggggtgtcctgccgcaagtacctcccttcctcctctccgctagcccggagcatcatccaggccgtgtccccggcccagccctcgatggggtcgggtgtctggcatccgcggttagcgcgctagtggtcgcgatgtcgtgaggggcgggcactcggctcgtggtatccggcggtgcgtgccgggcgtccgtgtgcggcgtgcggtgcgccggtgggacctcttgcgtgcgtgccccgcgacggcgtcgcctttgtggcctagccgcttggttgctgtggccgtctcgccgtggcactgttgcttttcgcgtgcgcgcgagcgtgcctcgtttctcccgcctgccgagcggccgtggtagctggggagcgtgtgggccttcgtctctctgtgctgtcgcagcccataccggtccgttggcgccgaggttactgggccgtaggttgcatcagacgccgtgcggcacgcgctggggtcagcgcgcgccgtttgaccgagacccgtcggcggcgcgggatctccatgctgcgcgaagcgcggccaatgcatccgtgccgtcgcccgcacgccggggagacagggcagctggctccggccgacgcctcaaccagcctgagatcggtccggtgccgtatcccgtgcccgtgctcaaccacgggtggtggaggcgtgctcccgagtcgcgtatgggagcgttagctcagctagcgcggctcccgttcgcgggccgcgggcgcaggtggacgcttccgccgcccggcccgccatccgctgcggccgacccacccttggctaacgaaagcgcgacgcaatctgcgcccggtcggcttgcccgggcggtctgcgtgctcccgcgcgaccccgcgcgcgcttcgcccgccgcctgccgtcgtgccccgtgcttctcctcctccctcggtcctgctgcccgcatgtgcggcccatcccttggctcggccgtcctgggcccgcgagcttcggcggggtctggcgtgggtcgccggggcgggtctcgtgcgctgcgttgctgcgcgtgctgttctctcggctggtcgcggcgggcgccctcgccgttgtggcgcgcgtggccgtcgcgccagccgtgcgg

SEQ ID NO: 640476 - DNA, 341 bp, Homo sapiens
  misc_feature (24)..(24): n is a, c, g, or t
  misc_feature (27)..(27): n is a, c, g, or t
  misc_feature (36)..(36): n is a, c, g, or t
  misc_feature (44)..(45): n is a, c, g, or t
  misc_feature (58)..(58): n is a, c, g, or t
  misc_feature (62)..(62): n is a, c, g, or t
  misc_feature (87)..(87): n is a, c, g, or t
  misc_feature (123)..(123): n is a, c, g, or t
  misc_feature (133)..(133): n is a, c, g, or t
  misc_feature (144)..(144): n is a, c, g, or t
  misc_feature (162)..(163): n is a, c, g, or t
  misc_feature (213)..(213): n is a, c, g, or t
  misc_feature (243)..(243): n is a, c, g, or t
  misc_feature (276)..(276): n is a, c, g, or t
  misc_feature (313)..(313): n is a, c, g, or t
  misc_feature (326)..(326): n is a, c, g, or t
  misc_feature (329)..(329): n is a, c, g, or t
acgaattcggcacgcgggaaatgntancgatggcgnctgtgccnngtgggtgtctgtngccnccgtttgtgctaccgttgttgttgncgactgtgctctaagcggtgtctgcttttggggcanagttttcatnggaggcatgcngagaggtaggcttttctnncaacttgctttgcagctcttgtgatcttttggacaggtcaacctggttanctggatcccgattgcagaggatgctgtcangaggaagcacaatttggaaccagctgtatgcangagctattcttgaaggttgtggatgtgcttttggacnacaatgggaacantgntggagaactggc

SEQ ID NO: 640477 - DNA, 171 bp, Homo sapiens
cctcctccaagtcccatgccagggagaatcgctgctgctcctgctgggagcagaacccagcatttagagggaacgggtactttcactacaaaagctggttgtggcccctttggggatcggctgggccccagccaaaatgtccgcctgcagtgtggtgagaatgcccctgca

SEQ ID NO: 640478 - DNA, 371 bp, Homo sapiens
gtaggagacgggtcgttgccacgtagtcccaggctaggttctcgaactcccaggctcaagcaatcttcctgacctccgcctcccataatgctgggatgacaggtgggattacagagcaccatggcactctgccagactcaaggactcaggtcggaccatgtcaacagcatccttgaggcgtggaccggccctctccgcgaaccaggggaactgcactctccattagaagtcctacgttggatgctcacgagctgcatgtctgtcatgtgacttggaccttcgggaagaaaaacaaccatttaatccgtgttccctggagaatccagcacttgagttggatctgttacgggtcatgttcaccctcttgaggt

SEQ ID NO: 640479 - DNA, 540 bp, Homo sapiens
ctagaaaaaattgcactcttctcaagcttgtaatcttctttaccacaagacagaatctgtgtctcctgtcctggtgacatcaggcagatcagtatgaacgacggtattacacgtaccactgagcatggttccatatctcagtcttcagtgtcacagcccacgactgagggtgccccgccctgtggtttgaacaaagaacagtcaaatcttctgctcgacaactccttaaaggtcttcaatttcaactcgtcaagtacatcacactccagttggaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccaagcatttctttttctggaatgtcattatcagac

SEQ ID NO: 640480 - DNA, 304 bp, Homo sapiens
  misc_feature (3)..(3): n is a, c, g, or t
tgntacctactcatggctgagggaaaagcatagacgaagcggacgctgtcaggacctggctaaggagaggctgtcacaagaggcaaggcagatgagtgagacacaccaacccatccctcctcattccagcctcatcacacagcttgcagagaggaaggtgcagctggggagaaagaagcaagatctctgtccttggtgcttggtgggctctcggcatcattcactagtggagggacctcgaagcactgaactcctcactttctctgtcaacagtgtctacaccccctgagaccccgtctccaca

SEQ ID NO: 640481 - DNA, 536 bp, Homo sapiens
cattacttcatgctacgttgagatactacatacttttaccatactatagtccccacctctcccatgacatgctatttaacatcctttgcaactttcctttgccatcaacaggagtactctactaatcctaggaagacttaacaatagtgagttgtcctcatctctgatacccaggtgtgcttaagatcaaaatttaatattcccttttcaatattaatccattcattttattttagttgcaatcattcagtggttgggagtaacacttggatcacttaaagcagtaaagaaaattagattacaaaaaatgcagcagctgttcatgacaaactctgcatgaaaattgtaggtaaagaccagaatccagatatatcatgtccaccctctgccactgtccttataggagggagaaatttgcagttattccaataaaggtttcatttaccaagaagctttaaaaaaatacctaagttcccattcatactgcaaaacgttcatttaaaaccacttttagctagtcactaaatcattatatc

SEQ ID NO: 640482 - DNA, 182 bp, Homo sapiens
atcacccggttgtggctgccatggcctgttacttacctttgtgtagccgatttgctctcgggttctattccgactaccccgccgaggacgctgtgcacgctgccctagttgcgccacccccgaagcgcgtcggcgtcccccgtcctcctttacagggacaagggcgcgttcatcctacccgc

SEQ ID NO: 640483 - DNA, 101 bp, Homo sapiens
tcagcacagatcgccaccaccagcggtaatcctccccagacaactggaatctaggtgagtgcaattggagatgcaaatcccccaccactcagcaggatggc

SEQ ID NO: 640484 - DNA, 853 bp, Homo sapiens
  misc_feature (394)..(394): n is a, c, g, or t
agcggctactcagccccagcggcaggtgaaggacgtccttccccagtgagccgactggcccaatcacagcgcaggtaagatgaacggttctgtgggctgcgttgctggtcacattcctggcaggatgccaggccaaagtggagcaagcggtgcagacagacgccggagccccgagctgacgccggctatgaccgtaggctggcaggcaatgcggccagggcgctgcggaactgggcacctggagtcgccttttggcgacttacctgacggctggcgtgcgagagcagctggtctgatgtcagagtggcaggatgggagtctgctcacgggtcctcagtgttcacccaggagagctgagggtcgctgagtggacagaaaccgatcgaagggaagntctgaagagcctacaatattctcggaacatggatggaacatactgatcggccccggtggccggatgggaggacccgcagggctacgggctgatccaaagtgagttgcagggcgtgctgcaggcccgggctgggcgcggtactagtggaatggaccggttgttgtcgcgaccgctcgtggtttgcccggtacgccggcgggcagatgagttgcggggccaattgcttcgggactcgtaggcaggcaggtggcatggcttgcgggggttgccgccctccgctcttcccaccttgcagcgagccttgcgttaaggcgcgttcccttccggtgattggccagattgaacctggcacgaaaagcgcccttggacagttggttccaggggcccgggggtcccagcggaggggtctgccctgaggcgcagggccctcaaggtgcctcattcgccgctagccgggcg

SEQ ID NO: 640485 - DNA, 368 bp, Homo sapiens
tgcatgcgtatttaaacataggaactcagaaactcgtttcagggtatgctgaagttaaaaattaaaaaaagaactcagccgggcgcggtggctcatgcctgtaatcccagcactttggtaggccgaggcgggcggatcacctgaggtcaggagttcaagaccagcctggccaacatggtgaaaccctgtctgtactaaaaatacaaaaaatttggctgggtgtggtggtgggcgcctgtggtcccagctactcgggaggctgaagcacaagaatcgcttgagcctgagaggcggaggttgcagtgagccgaaatcgcgccattgcactccagcctggccgacagagcgagactccgtctcaaaaaaaa

SEQ ID NO: 640486 - DNA, 359 bp, Homo sapiens
  misc_feature (71)..(71): n is a, c, g, or t
  misc_feature (75)..(75): n is a, c, g, or t
  misc_feature (80)..(80): n is a, c, g, or t
  misc_feature (239)..(239): n is a, c, g, or t
ggcacgaggactgcatagggctgcgtggaattgttcaccactttgctctggagcaaagtgtacaatttccncgcngttcnaggaatgtcgtgtttgatgttcagatccccaaaggagcattcatttccaactgctccatgaccgtggacggcaagacatttaggagctctattaaggagaaaactgtgggccgagctctttatgcacaggccagagcaaaaggcaagacggctggcttngtgaggagcagcgtctttgatatggaaaacttcagaacggaagtaaatgtcctcccaggggcaaaggtgcagttcgaacttcactaccagggaggtgaagttggaggaagcttgggctcc

SEQ ID NO: 640487 - DNA, 150 bp, Homo sapiens
accctatgaatcagaagacagaaagatccaaggataaataaccatgatttcttaaaatttcaagtgaaacttgaaggcaagaaggaacctgactatgaaagccattgatacttactattacgcaacttcagatagacgcagctcagaacc

SEQ ID NO: 640488 - DNA, 534 bp, Homo sapiens
cccatcgctcacatttcgtgcgtagctcctcctcctgtcataccagcagtggcattagattctcataggagcgtgaatcctattgtgaactgtgcatgcaagggatctaggttgcacactccttatgagaatataatgcctgatgatctgtcagtgtcttccataacccccatatgggactgtctagttgcaggaaaacaagctcagggctcctactgattctaccttatggtgagttgtataattatttcatcatgtattacgatgtaataataatagaaatacagtgcacagtaaatgtaattcacttcagtcatcccgaaactatccccctatccccaccccggatctgtggaaaaattatcttccatgaaaccagtccctggtgccaaaaaggttggggactgctgctctaaggaagactttttcgtgccttggggactgctgctctgaagaagactctttcatgcttcctccttagcttctgatggctcctggcagtccttggcttgtggctgcatcacttcagtttct

SEQ ID NO: 640489 - DNA, 119 bp, Homo sapiens
  misc_feature (31)..(31): n is a, c, g, or t
  misc_feature (89)..(89): n is a, c, g, or t
  misc_feature (115)..(115): n is a, c, g, or t
ccaccttcttacggtgtcctcacatgctggnagggcctcttttataagggcactaatcccatccattagggccccatcctcatgactgnctaataaccctcaaggcccccccccnaaaa

SEQ ID NO: 640490 - DNA, 1704 bp, Homo sapiens
  misc_feature (438)..(438): n is a, c, g, or t
cgtgtggggtttgtgtgtgtggctgacggtagcgtgcgcgtgtgtctgtttgtgtgctttctttgctcgagtatctctcactcggttgtgggggtgagtgtgtgtgctgtttttgtgttgcaccactgcgcacctagttcttgatgtggtacctctctgttctgttgggggtgagggtactctcttagattgattgttgttgtgttgttgtctctccgctgttctctcgcctctctcattgtgtgtcatccatcttccccggtgtgcgctgccatcgtttggtgactcgcggtaggtgggtctatctcgttgagtgctactcgctcttggtcttcgtgtgtcctctactatgattattgcttcgtcgtttgtgtgttggtgctcagcagagtgttgccgcgcccctgccacagtgggtgttgtcgtcccagctagcgnagttgtgtgtgcatccgctctggtttttatattgaaagagctggtgtgtgttgtttgagccgctccgttgtggtggttctccctctggcgggcatccccaccatagttgttttgtagagcgggtgttctgtgtcgctttcttgttggcgctctgtttctactactcctttgcgtccccgccgggggaatggtgtgtcttctcctcgttagagggggttgtgttctgtattaggtgtcctgcgtagtgggcgacctcctactaatagtgattgtgtttttgatattagtgtttggcgcctgcatgtgtgggtgcgacaccccccactctgcggtgggggtgggttgtgtggttgtgcctccttctcgttcgtcgtcgggctgtggtttgtttgtttgtctgttataatatgtcgtgtccgcagcaccgtcgtgttgattttgttggagcagcatgtagtgaaggagtgtggtcttagtcttcttgtgggtcgttccccgccggtgatgagcgcctccacgtagattgtgtttggcgccaccccggctgctgcagcgagggccagcaggttgtctgttgtcgtttggtcgtttttcgtcacaacacgcgccgcgcatgtacgcattcctcccgctggttgtgcgtcgcccgcgctatgtgttgtcacgcactgcatttagtcactcacggtcttcgccacgccttcgtcttctttggggcctcttctgttctacccctttttgggtgtgagaggcgccacacacctgggttaggatatgtggtctcccctgtggtaatttttgtgtgtgtgggggtcgacacaccagtagggatattgttgtgtatatatacactggtgttaataattatatagacgactttgtgttggctctcctcagatacgattctctctcttctgtctcgctgtgtgagataagagggttgtgtagttctctcacaagagatgatctctaaaacaacctctcccaccactatagccaccccctgtgggagatatttctctcctctgtctgtctgtatttgatacactgtttaacatgtagaggggtatcccccgagttgtgcggagtattggggcacacacaccttgtggcccacacacagtattcatgtggttgcatttccaagaggtacacctatatcgcccctgctccctctcctcctggtaatacaacagaggttcatgcgcatatgtgtatttaagtagttgtcccagagcaattatagaattatgtgtgccccaaata

SEQ ID NO: 640491 - DNA, 307 bp, Homo sapiens
agttcacggagactctcagaaaatcaccccccgtccgggaaggatcaccattttatcttattttattttatttatttttgagatggagtctgctccatagcacaggctagagtgtggtggcgcaatcttggctcactgcaacctctgcctcctgggttcaagcaattctcctgcttcagcctcccaagtagctgggattacaagcagcaccaccacacctagctaatttttgtatttttagtagagatgggtttttgccatgtgggccaggctggtttcaaactcctcacctcacgtagtccacctg

SEQ ID NO: 640492 - DNA, 938 bp, Homo sapiens
  misc_feature (33)..(33): n is a, c, g, or t
  misc_feature (101)..(101): n is a, c, g, or t
  misc_feature (106)..(106): n is a, c, g, or t
  misc_feature (124)..(124): n is a, c, g, or t
  misc_feature (133)..(133): n is a, c, g, or t
  misc_feature (135)..(135): n is a, c, g, or t
  misc_feature (137)..(140): n is a, c, g, or t
  misc_feature (155)..(155): n is a, c, g, or t
  misc_feature (165)..(165): n is a, c, g, or t
  misc_feature (170)..(170): n is a, c, g, or t
  misc_feature (180)..(180): n is a, c, g, or t
  misc_feature (193)..(196): n is a, c, g, or t
  misc_feature (199)..(199): n is a, c, g, or t
  misc_feature (202)..(204): n is a, c, g, or t
  misc_feature (224)..(224): n is a, c, g, or t
  misc_feature (234)..(235): n is a, c, g, or t
  misc_feature (238)..(238): n is a, c, g, or t
  misc_feature (243)..(243): n is a, c, g, or t
  misc_feature (247)..(247): n is a, c, g, or t
  misc_feature (250)..(250): n is a, c, g, or t
  misc_feature (258)..(265): n is a, c, g, or t
  misc_feature (269)..(269): n is a, c, g, or t
  misc_feature (283)..(283): n is a, c, g, or t
  misc_feature (292)..(292): n is a, c, g, or t
  misc_feature (295)..(295): n is a, c, g, or t
  misc_feature (298)..(298): n is a, c, g, or t
  misc_feature (302)..(302): n is a, c, g, or t
  misc_feature (309)..(309): n is a, c, g, or t
  misc_feature (340)..(340): n is a, c, g, or t
  misc_feature (346)..(346): n is a, c, g, or t
  misc_feature (355)..(355): n is a, c, g, or t
  misc_feature (371)..(371): n is a, c, g, or t
  misc_feature (594)..(594): n is a, c, g, or t
  misc_feature (730)..(730): n is a, c, g, or t
  misc_feature (813)..(813): n is a, c, g, or t
  misc_feature (855)..(855): n is a, c, g, or t
  misc_feature (920)..(920): n is a, c, g, or t
catcaattttattaacaatttacggcaataganatttacagaacaaatataagacagttccaagacaaaggagtgtaaaagtacagcacacaggttaatantcttnaccctcatcctctccgtnagcactaanangnnnngcctcctcataatcnttctaaaggngagcnatgtactcangggcatctggcannnngcnttnnnccatcccctcacccaggtancagtgaacgnnggnacgcntggngtncgtcgggnnnnnnnntttnttctttttttttcnggtttcggnaanttntgtngttttgntcagcttgctcacagctctctgtaccttggncaggtntccgccagnttccatttttggaggntggtaatttatgccaaccttgaagccagttgggcaccaatccacaaactggatggtacgcttggttttgatggtggcaatggcagcattgacatctttgggaaccacgtcaccacggtataacaggcagcaagccatgtatttaccatggcgagggtcacatttcaccatctggttggctggctcaaagcaagctttggtgatctctgctacagtaagctgtncatggtaggctttctcagcagagatgacaggggcatatgtggccagagggaagtggatgcgggggtagggcacaggttggtctggaattctgtcaggtcaacattcagggctccatcaaatctcagggaagcagtnatggaggacacaatctggctaataaggcggttaaggttagtgtaggttgggcgctcgatatcgaggtttctacgacagatgtnatagatggcctcattgtctaccatgaaggcacaatcagagtnctccagggtggtgtgggtggtgaggatggagttgtagggctcactacagctgtggaaactggggngcgggttaatggagactc

SEQ ID NO: 640493 - DNA, 1219 bp, Homo sapiens
  misc_feature (685)..(685): n is a, c, g, or t
  misc_feature (728)..(728): n is a, c, g, or t
gtcctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgtttttttttttttttcccggggggggagtcttcccccgtgttggcccagggctgggatgtgcgcagtggggatgagatctgggctcactggcgaatcttctggccaccgtggggtccaaggggattctcggtggcctcaacctcctggatgtacgctggggactggcaggcaccgcggccacctggtgattctcgggtaatttataaggtaagaagacggggggtgttcgcgccatgtgttggcccaagatgtggtgtctctgagaactcctcgggggccatacaggcgtagattctggcgccactctttggggccctcccaaaaatgtggctgggggatataacaggggtgtgtggacgccacccgggcactctgggcgcaagaaccggtgtcacacctgggtaacaacagaacttttagcgggctaatataacagaaaggcgtgggtacgttctccgcgagagaaaatcgcgacacactttttaaactctttaagaggctctttttgcacctagggtanaaatagcgtccaccatttcccacaattttgctactcccccttngggtgacaacagggggggggtaaaccatacgggtggagccaataaccgtcaattatatttcctaagtggaagaaacatgaatttttgtggaacgcttggttttaccacacaatcacaatggaaaggtggcacatatggttacttcaccgcttgttggaatcaggcaattttttgtaataacgtttttgattattaaaacaaggggttaaaaggtgggtcaaattaaacggataaactcttcgggcgtgtggttgaagaagcacatctccggaggttatttcaaaagggttctttctcttaaaaatgatttggccattaaggaaattttcttccacatatgttttttcaaaacaaggggggaagagttatggggtgaggccccccttttataagatagtgtagctttacaagaagggggctcctttttgtatttattaaaaacagtgtgggggcatgtgagaaaaatattggggggggaaatatgaatttga

SEQ ID NO: 640494 - DNA, 370 bp, Homo sapiens
ggacacgctcgccctagaagaggagaaccagatggaatgcttctgtgtggacgacgatgaaaatcacattaaaaaggagaatcatcctctcctcgtcggacacactgcctatgatggtggccacgcagcaggagtccaacattgaatgtgctgcttataaccctgaaccttacctaaataatgaaagccagccagattcattttccacggcacatgctttcctgtgggtaagatgtgtttatttggttttggtacaaagtttcacagagaatcaacgttcattgtcggtgtgatgagagactgagatgtgacttgctcagtagagagtcggcggtggcgtatcccagagtgtacttcgaaacatgaaaac

SEQ ID NO: 640495 - DNA, 876 bp, Homo sapiens
ctgagactgggtggagggagaggcgcggagaacactggtggctctgacgagctggctgaggccctctcagtatggtgggtcacgcctcctggaactcatgggaccccaagtttctgtgcattcaggtgcgggtgctggccccaatgccctgtgcataggtgtgccatggctgcatcccagtcgatcagaccagaggcagcagcagtggactcatcaattgtgtgaggaagccctgggtgaccctggggaccttgccagactctattcccagaccagctcctaggacaagcctcagagccaacacccgactcgaaccatctcacacggaacccatccccttcataagtctattagcagatgatcagccgggtgtcgatccttattcccatcacagtacagggaccaggcagtggacgccgacccggaacgactgagacatcgaggggcaacaggtgaaagcactggaacaggggtctggcatgggttcatgggcgctcggagagaccaagaatggaagggtggctggactagtgcggcccagtgtggaagcccaggcagaccaaaagataggcacggttggaacacccacacgaacgaacgatcggccagcacatacgtaaaccagtggaggacgccagggaggacagacaaaccaccgccaaaacgtggcgtagagcgccaagtgggaagggagttaggcacagtaaaacaccgagagcaaaagagaggaaacgtattacacagagagtagggaaaaaggacaggccacgttgcggcagggccacgagcagtagacaaccacagagaacacggacccaggagggagatactacaaatgaggcgatcacccaattgacgtggggaaagaaaacaagg

SEQ ID NO: 640496 - DNA, 1901 bp, Homo sapiens
  misc_feature (370)..(370): n is a, c, g, or t
  misc_feature (543)..(543): n is a, c, g, or t
ctggattgccgctacgattatgttacgacgcggagaaacttgccctctagttctggaagtccctatgcagttgtcctgctactagttgaacgagacgtgtagcgtactgtcactttccagtgtctcttgactggccagggatgcctcacattgaagatgtggcaacgccctgtctgtgcatgttgcgcagaactgcgttgagatccgagccagcattctcattagaaggaacaaaggtgattggagcattctattattataaaattctcaagcacggtatcctggtgactagagtcgttactagactgggacaaggcttacgttagtcaaactttgatttgtcgcaactatagtagagacaacacactgnacatagaaatagatacaaagatagatattcatattcccatacaccacgggaaatactcggcgcgagtagtggtcttgttgccttgcatatgttgtgctcgccttgtttcaaatttgtgaatgtcccgagctaactcatattattgggtaaggtctcgagattatactaactancctagaggataatcactactacatctccatatccacacgcattgcgcatgtgtgcatggccctattccccagagtgtcacgccccatctggggactatacttataagttaggattaaactaagtatgcgcaccctatgtgggaccttagaatcgctatctccaaggctctttcgtgcactctgtgcatgtggcgagttccttttcaagtagatttaaaataacccattaaccccttttagcgccactttgggctgtgctagagtgggttacaatcaaaccaaaggaagttttcctttcccttacaatgactggtcatactggtttggggagcgaacttatgtccgcgatccgcaccatttgaccaagaaacaacattctataagggaggaacggccctatctatacgtacgaatggtggcgaagatctcttaccagtgggatagggcgatagaggcacattagcattggcggtcgttcacagggacgaacaaaggcatcttccttttggccggtacaatttgtccgggttgggacaaaccccgacgtatatacgcaccagattggataaccacgccccccaatgaggagtcaaaggattcggagtttgcgcctctagaaattgggtggtcaccatatccggttaccgagaggaacagcacattctccttggaacacgcaccgcactttgggacaccgacatcacttgacagcgaaaagaccacacgggctttggagaaatggcactttggaaggcaaaaacgaggcacattgtttgtaagccgcacccgggacgatgagaacttttatacagggggccagcaccactgtagaccttgggaggccccccgcgctcacatctagaagaacttacaccaaggactaaactgcacaaagcccttcgacgagctgtgtacgacaaccccacggcgtcgctagaataagcgaggcatccacagcgtcgcccccccagtgcagcgccaatatgagcggagcaaacaacccccataattgtgacaacatgagagagacaggcacacacatagccgacagcaaacaacatagattattgcacaccaccacaccacatatacaataaccacacaatggaagagacttatcacccaacattatatatactaaacaacaaatatcacatagaaattaacagaaacccacccaacaagcactatcatacaaaacaaatactgataaaaatagatcaaacacataaacaacaacaaacaaaccaaaacataccacacatacaatcaaaaacattattatgcaaccaacccttaacacaccaataaaacacaccaaaaataacaacagaacaataattcaatcatacacaaca

SEQ ID NO: 640497 - DNA, 191 bp, Homo sapiens
aaatcccgccacaccacggaaattctgggatactcaccagaggtcccatcctggccacgctacctccccccattcacctgctccccgaaaccctcccatgatctaccactcccccaaaactccatccctcatgtgaccgatacaccctctagtctatactctgcacgcgaataccacctcgatgaaactcc

SEQ ID NO: 640498 - DNA, 290 bp, Homo sapiens
aagaaaggggtatcagttgatttgaaggttgaaattaaattgaaattgaagtgagaaggaaaagttttagaggaaaaaaggataacaagaaacgaataaagcctccaagaaatatgggactatgagagaagaccaaatctacgtctgattggtgtacctgaaagtgatgggcagaatggaaccgagctggaaaacactctgcaggatattatccaggagaacttccccaatctagcaaggcaggacaacattcagattcaggaaatacagagaatgccacaaagatcacc

SEQ ID NO: 640499 - DNA, 404 bp, Homo sapiens
accagagccttctgcagatgctactgatatctgctgtcagtggacctgcatggacatcagctcagcatcaagacatagatagaagatgtagacaagaagacgtacccttggaaatatcagatggaggagactctgagcagatacatagatagaggagcgtcagggaccaccatttggagaggacagcaatcatcaaacctcatgctggtgatgggaaccagaatgatggccctcagcagggaccaccccaacaaggaggacagcagcaaacaaggaggcttgattacatcactcccatcatcccctcaatgatccacgtgcctgacagacacagggacataatcccacctcctgaaagacacaaaacacacacagggattagtgaactctatgaggggtttccc

SEQ ID NO: 640500 - DNA, 913 bp, Homo sapiens
tgtacagatggggtcgacccatgtggctcaggctggtctcgaattgccgggctcaagtgatccgcccggctcggctcccaaaaggtgtgagcaattgcgcctgacctacgatttcttgctttatatatcagtctgaaacgcaatggcggtggctgtcggattctgtgagtcataatcgtgatattggtttccacgcgttttggccgatggaggagctcctggagatcgtcgtccttgtgccccgtatccattattttccctgcacctttgtttgacgtgggggatgtcgtcagttggcctttgttcccagctctgcaaccctgagctgcttctccagggagcccctccctcatctcggaggaactggtgattggagcaacccagaggactctgggtagtgggtgtgcttgctgagcttcggggcccctcgctgtgcccacgagctggggagggtggatgctatgacgcgtgcttgggtgcacttgagccgccctggttggtactgtagctgtctagtcccttgcggtcctgtctcacctgccccttttccttagtgtgtagttcttcctgtgacaggggagagactgcttctcagagtggactggtacatcctgtttaggcatgtcagtgctgtagtggaactgtcaacctgtgcgcaaggggggcggcgtcacgtatggaggcacgttattcctaacggtgaggaggtcggtttgaccgtaagactagctagcgtccaaggcgcaaagaagtgttgctactcactcgtgaatgtgttggtactgccccctgtgtcaggaatgatccctgggccccatacgggctattttgaagcctttgcaaacgactataattgcatacataaaacaggcgcgtggagcaaaaattgaggactcttgtgcgcggtggacaa

SEQ ID NO: 640501 - DNA, 113 bp, Homo sapiens
gatctagaaggatcaccttgcgtgtatcatagatatggatggtgaccgtggagacgtggcaggagggctcactcaaagcctcctgcctatacggtgcagactccccagtgttc

SEQ ID NO: 640502 - DNA, 379 bp, Homo sapiens
actggtcccggtgcatagagctgggattcaggcatgagccatcgtgctggccatttttttgttctgtgttatcagtgacaggtatcttgctctgttccccaggctggtgtgcagtggtgtagtcatagctcactgctggctccaacccctgggctgaagcgatccttctgcctcagcctcctgagtagctgggattacagacacatgccaccatgccagggaagttttttattttttgtagagacagggtctcactatgttgcccaggctggtcttgaactcccaggctcaagccgtcttcatgccttggcctcccaaagtgctgggattccagtcatgagctcttattgcccaggctggagtagctcttattgcccag

SEQ ID NO: 640503 - DNA, 931 bp, Homo sapiens
  misc_feature (63)..(63): n is a, c, g, or t
  misc_feature (81)..(81): n is a, c, g, or t
  misc_feature (117)..(117): n is a, c, g, or t
  misc_feature (137)..(137): n is a, c, g, or t
  misc_feature (153)..(153): n is a, c, g, or t
  misc_feature (189)..(189): n is a, c, g, or t
  misc_feature (215)..(215): n is a, c, g, or t
  misc_feature (291)..(291): n is a, c, g, or t
  misc_feature (304)..(304): n is a, c, g, or t
  misc_feature (315)..(315): n is a, c, g, or t
  misc_feature (317)..(317): n is a, c, g, or t
  misc_feature (354)..(354): n is a, c, g, or t
  misc_feature (425)..(425): n is a, c, g, or t
  misc_feature (673)..(673): n is a, c, g, or t
  misc_feature (700)..(700): n is a, c, g, or t
  misc_feature (791)..(791): n is a, c, g, or t
agcgtgtcggagcgtgaagtggcctggtggcggtaataacctggaggagcctcgtggcctggncctggccacggcggagcnacttgtggggcagggagcctctgctgtgcttctggncctgcccaactcgggtgggnaggcccaagccaagangttaggaaacaatgcgttttcgccccagccgacgtnacctctcagaaggatgtgcacacagntctggctctagcaaaaggaaagtttggccgtgtggatgtagctgtcaactgtgcaggcatcgcggtggctagcaanacgtacaacttanagaagggccananccataccttggaagacttccagcgagttcttgatgtnaatctcatgggcaccttcaatgtgatccgcctggtggctggtgagatgggccagaatgaaccagaccaggnaggccaacgtggggtcatcatcaacactgccagtgtggctgccttcgagggtcaggttggacaagctgcatactctgcttccaagggcgggaatagtgggcatgacactgcccatatgctcgggatctggctcccataggtatccgggtgatgaccattgccccaggtctgtttggcaccccactgctgaccagcctcccagagaaagtgtgcaacttcttggccagccaagtgcccttccctagccnactgggtgaccctgctgagtatgctcncctcgtacaggccatcatcgagaacccattcctcaatggagaggtcatccggctggatggggccattcgtatgcagccttgaagggagaangcagagaaaaaacacgctcctctgcccttcctttccctggggtactactctccagcttgggaggaagcccagtagccattttgtaactgcctaccagtcgccctctgtgcctaataaagtctcttttttctccacagaaa

SEQ ID NO: 640504 - DNA, 892 bp, Homo sapiens
  misc_feature (433)..(433): n is a, c, g, or t
ggtaatcttatcaaccatcttcagccgcgaacgatcataaggcgcacgcgatgcatgcgccacatgattatatgatacgcatgaagctaggtgctagaagagtacaaacactgcgttctatcggagtctcacaggctatctaacctgacatgactgattgagagctccgctcggtatcaacatcatgagatactagacgccaatccgaatgttatttatcgcctcgaactggcaagaggactacactcggccaattctctaatatagttgcgcttttcatatagtaaggcatgagtgcccgtgctgtacagaacgagaatactagcctcgtcctgggcaacagagtgacaaccaatacaagcctagagtagcataccgagactacacatactctagtacagtataatacaatacatacaatgcgtgtaatagnacaagtgaaatatagcataaagcgcaaatttaggtcgcgccccgttctactagcatgtccataagcacgttgcgctcgacgcacgcgctcgatcgcgcagatcgttgcgacccacacctccctcggaacgaataaccccgaggctcttcgacgtatgcttgtggcatcctaaaccattgtactagaaagatagcttgaagttcgcacacccgatttgcctcctagaatcctaattatagtaacctctacacactttcttccctgcaccacttccatcaattagaaagccgtattagaccgcccacatgtgcctttcccttgctagcgtgccatgcgtacctagaatacgttgcaagttcgccagttttcgactcattgcccatgagccaaaatctggcattgcgctagaggaagtatgaataaaccccaaagaacatcgccactaagtgccattaaccg

SEQ ID NO: 640505 - DNA, 465 bp, Homo sapiens
ctgcataaagtatgcaactgaccaggaagagaaaaatacacagcacaaaagttggctcacaattccactcaaagagggtctacaccaaagtgaagttatgcaccaggatgaacatgagcatgagatgagaggacttgaatctgagacttcagcatgtctcagtccggtgtgcctcttcacatagtgagcattctgaatgctgtacatgattctagttgaagagaatacttagttgaggcgtataaacagtctcctaattaacaggccaactatttcatttggtatcgcaactttgtgctggacatatacaccaaaccatgtttatatactttaatgttggggtcactggagatattttgcatgcatcattttgcattatttggaatcctcactttatgtgtaaactttacaaactaaactcctgccggaagatgcagcattttactttgccgcagaggatggcgc

SEQ ID NO: 640506 - DNA, 112 bp, Homo sapiens
ctaacgttaatttccaccaactcggggagctgaaactttcacaggcttcacaatcttttgcttaggtctgcctttgtaggtccttagcagcagccattgcagtctttttaga

SEQ ID NO: 640507 - DNA, 935 bp, Homo sapiens
  misc_feature (63)..(63): n is a, c, g, or t
  misc_feature (81)..(81): n is a, c, g, or t
  misc_feature (117)..(117): n is a, c, g, or t
  misc_feature (137)..(137): n is a, c, g, or t
  misc_feature (153)..(153): n is a, c, g, or t
  misc_feature (189)..(189): n is a, c, g, or t
  misc_feature (215)..(215): n is a, c, g, or t
  misc_feature (291)..(291): n is a, c, g, or t
  misc_feature (304)..(304): n is a, c, g, or t
  misc_feature (315)..(315): n is a, c, g, or t
  misc_feature (317)..(317): n is a, c, g, or t
  misc_feature (354)..(354): n is a, c, g, or t
  misc_feature (425)..(425): n is a, c, g, or t
  misc_feature (673)..(673): n is a, c, g, or t
  misc_feature (700)..(700): n is a, c, g, or t
agcgtgtcggagcgtgaagtggcctggtggcggtaataacctggaggagcctcgtggcctggncctggccacggcggagcnacttgtggggcagggagcctctgctgtgcttctggncctgcccaactcgggtgggnaggcccaagccaagangttaggaaacaatgcgttttcgccccagccgacgtnacctctcagaaggatgtgcacacagntctggctctagcaaaaggaaagtttggccgtgtggatgtagctgtcaactgtgcaggcatcgcggtggctagcaanacgtacaacttanagaagggccananccataccttggaagacttccagcgagttcttgatgtnaatctcatgggcaccttcaatgtgatccgcctggtggctggtgagatgggccagaatgaaccagaccaggnaggccaacgtggggtcatcatcaacactgccagtgtggctgccttcgagggtcaggttggacaagctgcatactctgcttccaagggcgggaatagtgggcatgacactgcccatatgctcgggatctggctcccataggtatccgggtgatgaccattgccccaggtctgtttggcaccccactgctgaccagcctcccagagaaagtgtgcaacttcttggccagccaagtgcccttccctagccnactgggtgaccctgctgagtatgctcncctcgtacaggccatcatcgagaacccattcctcaatggagaggtcatccggctggatggggccattcgtatgcagcctctgctgtgcttctggacctgcccaactcgggtggggaggcccaagcctttccctggggtactactctccagcttgggaggaagcccagtagccattttgtaactgcctaccagtcgccctctgtgcctaataaagtctcttttttctccacagaaa

SEQ ID NO: 640508 - DNA, 477 bp, Homo sapiens
ggatagatctccatatttaacacctccggaagcaactctttataaaatcaaaagaccatttgatgaataaaaaacacaggttgccagcaataaggctaaccagagggtctacaaaagatctaaaaatcccaccaaaatcttaaaatctctcatttaaataaatggatgcatctgaaaaatgcagctggaatttctctgatgccaggagcaaagcagcacagaagtccatggagggcagggagtaaacactgaagttgctccacagcgacccacagcctctgccctcacagagtggtactgccccacagcagtaccagcagacctcagagatactgtaggttcagttccagattgcctcaataaaccaaatatcacaatacaacaagtcacaaaaaaattattttggtttcccagtccatataaaagctatgtttacactatactgtagtctcagtgtgcaatagcattatgtctaaa

SEQ ID NO: 640509 - DNA, 934 bp, Homo sapiens
agcgggtttcctggccgaggtgggtcggtagtagcgatggcgggtctgactgacttgcagcggctacaggcccgagtggaacgagctggagcgctgaggtgtacgggccgggcggggcgcgcggtctcggaaggtggctgacggcctgctcaaggtgcaggtggctttggggaacatattccagcaaaaagggagagggtgaagattctctaacaacaaagattgaagatctgatcaagatagcctggatcctgagtatcgtcgaccgacattgccatacgctgatgcctctaagctgcaatgcatcctagcagaggagcatgtttatcctttcccagtgtggcactcctggagcaggtgaatgccttggtgcccatgctgaagatatgctcacgtcaaagccgttcctgagacatgtctagcccgcctgtgaggcgctgtggcccagatccacattcagacagcagtgaccagtgtgtggaaactcactgaggaggtccaaggggctctcctggaggaatacaagcaagactacaatgcttctctccaagacaattcgtgcagagggatgagctactttgccagctagaggccgcacgcgagtgaagccatgcaaggagtgataactagtccgatcccacagtgggcttgggcagtcaggcgtccaggcctatgcaaacggccttgtgacatgcgacgaagctagtattatggctgacgccccttcgggaagcgggatcaaaatggagtcaggtacctgcggtgcactttacacccacctccccagaagtcttttcggcccatcactcgtgtaacaaatactccgcgtgcgcgaagacaatcgggggcacaaactgtccaaggatggcggagaggagtggcagttcccacatcacaacaatatgaagcggaaagaaaacacaaagcacaagaa

SEQ ID NO: 640510 - DNA, 373 bp, Homo sapiens
ctttccaattttgtacctcaaatttatttctcttgtattatttattttttcagtagctagagtacaataataattatagcgatgagagttggcagacttgtcttgtccctggctttaatgagaaatgattgtaaagtttgatcataattatgatgctaacttttggtcagggataagtataattttcattttaaggaaatatcaatggatttatatttcattaaaattttttaaataataagtagttgttgaattttgtcaaatgcctgttcaccatctgtggaagtcattatatgattcaggattatatgatttttcattgtatatgtattaatattatatgtactaataaagatctgtgaaagttgtcaga

SEQ ID NO: 640511 - DNA, 758 bp, Homo sapiens
tagcaaaacaaaagataaatatttattcagaacaaaacttttaacaatcaattttacattctaagcccacaaaggaaatagcaaaaacatatagcaaaggaaaagcaaacactaaaagaaaagcagggtacggggcttttctacgggtataacatgttagtgggcccagtgaccctctccgcatgtggcctatcttcccaagtacatttatagagttaacagctcactcataatttggggttaaaatccatctttctcctgaagaatcaggagtggcacatgagctccagctagctgcttctctagggttcgtagctatggaggctaaggtgcaatgtaaaccttgggtaggttgctttacacaggggcacccccatttctcactggtggcacatgaattggggaaggggtagggcctccaaaggaccgggcacactgtatttccagaagtggtgccccagggagcaacgaatgccccctggagtgtggtccttggtccgtgccgtatctcccaagtattcagaagcccctccttaaaaagccttctctttctgctccctcctccaggtgattctcagcatcctcgggcgatcatctggagagatcagaatttctgggcctcaaggtgtgggggaatcgtgtgacgtgtgagacgtctgttggattggccccggcttggggtcagggcctacatagggggtctggaccgaacgttgtgatttccccgcattacctttgggcggtctcccggggaaccg

SEQ ID NO: 640512 - DNA, 739 bp, Homo sapiens
tggctaggtctgatggctgggtgtttaaattcggcatcgatggcaccccatgtccctgtgtatgtcccgtggagaagcagacacttctcagcccatgtgccctggactgctgatggtgcatggtggaacccctggcgccctgccctgctgatcccctgtgctgacaccattgacatgctcagggccctccctgaccctgcccaattggtgtgtgctgccttttcagcctgtggtgtgcttgccactaggtgtgccatgtgcctgggatgtgcccttgtgaaaatggcacctgtgtacatctcagtgagatcaagaagagtgctgtgaatgaatgcttcctagtttccacacctctgtgcatgtttgtatccttgtcctgtagaatgcatgtggactgatgcttgcatgaatgtgtagatccttgattgcttgttgtgacacacctgtgacccctaactttccatgatgctgagccatgcatgtagctaatgctgcactgacccctttgccatttcgcacagcctgaccacagatatgtgtgctacctgttgggaagactcttgccacttgctagcttatgcttgacatgtggcattgagaagacccataaccatttaacattgccacgttgcgatctaacacatcgccacccctgagaacggcacaaccttgaattcgtgacgcgcactgctgcgctagacaacaaaataacatcccttagcgacggggtaaggcacac

SEQ ID NO: 640513 - DNA, 980 bp, Homo sapiens
  misc_feature (980)..(980): n is a, c, g, or t
agtcatcactgtgggcctcccctgtgggctggaacgtctgcatggatgcccctttgagaaatgctgttccacagaaccctgcctttcatggccttggagactgtgggcatgggtgatgaatgcacgcgtccctcagagccaggcctgtgcatgtggtgctagcatggggccaatggcccatgtggatgcattggtctcctgtcggagggacctgggcaagccctctccactgctgccatgcgtggtttctctagcatgggtgatggtccagcaccacacctgcttgtggaacctgtgtgtgcctaaactgcaaacaggatgccaatggcacaaatttaaccaaacaccaaggttgctgtgaggccccatttcatgagcctgggctccaaggacgtgtccttaggctggctctggaatgtgcccagctgccagcccccgtacctctgttaactgggatgccatgtcccgcggctccgcccaggcatggtagcctgatcgcgcccccagggtagtagggggcacctgaggagcagggtctgccctggcatgagcatgagcccaggatggggtcaggggtcaggccctgccagaggctgagggtgcccaaggcgaggccggtgagtgccagctctacaaattaacagtgttaatatacaggagtagtctctccagggtcccagttccctggccaccctcaacccagacccagggagacgagggcggattgcaagaggagctggccagaggctgtgcatgtcctgagttgggcacggtaggcaagagagaaggcacgagccctgggtgcccaagatcccagggtacgaggccaggcctgcctggctaatgagcgagggagcaggtctaatggcacggctggttccatgacggcgatctctgtcaataaccgtggtcccatcggataacaccgattagatgaggcctgagatcctcttcacccttttgtactccaatggtccaan

SEQ ID NO: 640514 - DNA, 500 bp, Homo sapiens
tctaagccggaccgtccttcatcatacctaccaagatcagatatgcatcctttggcgggtgcagtggctcacgccatgatatcctatgcactttgggaggcgatggtgagcggatctcttgaggtcaggagttcgagaccagcctggccactatggcaaaaacccgtctctgctaaaagtacaaaaattggccgtgtgtggtggcacatgcttgaggtcccggttacttgggaggctgcggcagggagaatcgcttgagcccaggaagcggaggtagtagtgggccaagattgtgccactgcactcaagcctgggtggcagtgtgagactctgtctcaaagaaagaaagacagagagagagagaaagagagaaagaaggaaagagagaaagaaagaaagaaagaaagacagacagagagacagagaagagagagagagagacgagaaagacagaaagaccgacacgaccagagagaccgggtagggtatgatgaaggacg

SEQ ID NO: 640515 - DNA, 949 bp, Homo sapiens
  misc_feature (59)..(59): n is a, c, g, or t
agcgaacggtgttcgccccgtaacaatagtacgccgatgatgtgtgttataagtgcgtnataaaacccgcccctttaggcccgtcttttccccgggtaattctttttagaggatcacacatatgaggaaacctcttatgtggcggcaccccctctcgagaaatgggtcctcctcattagccaaaaaggggacaaagttccctttgccgcaaaggaacacccactctggttttgaggccgccccctttcgggattataccgtgagtatacacttgatctattttgagcaccatctttaaacccgttataaggcaccctttttaaacctcaggcaaagacctttatcaataacacaggcactctgtgcgcgtctgcagacaggggtattatggacaccctggttctcaaagacatttacctccccccgggggcccattcagtcatacatagagcggtcatttcggagcgttgactttagtagaaaaaaaaaagccctctttgtagtccttgccgcgctaaaaaaggaggaatcaatacaaatttctccaggatacacggtttggcactaatgtccggttgatgagcactcctccaaacccccccgggatatagacagtacgtgcacccccctggtccgcgcccccaaaaaacggggttatacggcgacgggcgtcaatatcgccttgcatgccctgtgcaaccaccctttacaggggattgcggcacccttgcatgcaagaaaattgccttcacatccggcctgatttttctcagagatacatagcacatagtgctcccgcgctgggtgactgcagttagagttcaaccgcggtgcacgcgctcattcagcagctcagaaggtttccgcacaacacaaacaactcctttagggacgagttcagaaagctgtaaccccccaaaaaatacaggcagcttaacccccacatgac

SEQ ID NO: 640516 - DNA, 132 bp, Homo sapiens
atggcggtcgatgatccccagcggttcgcggtcctgcgccttggcccagtcgtgcttgaaatactccatgcggtctagcgtctgcgccacggcgatgctggcgccgcggatgttccacaggccccagtgtcg

SEQ ID NO: 640517 - DNA, 97 bp, Homo sapiens
gagcttcgtgactctgctgtgtatttctgtgccagcagccccccctcaggagcgggaggggagcagttcttcgggccagggacacggctcaccgtgc

SEQ ID NO: 640518 - DNA, 819 bp, Homo sapiens
agcgggtctcgtgtcttttcctcctcccagtgcccggcgtacctcccttcccccctcgccgccgaccgagttcttcctttaacagacagggtcgccttgctgtcgtcgcggatgattttcctgctactgctactgctgctgctgccaccgtcactaccactgaggctcattatgccactagatccacttcgccagcaagtcccagctctacataaggaggtccaacgatgctcagtacggacctttcgaccactgacccggcacgtcacacgcgtcgtctgctccggcacaccaatcctgaccctcgggcgactgtcttgactacttcctccggagcaacgctacaccactcgaggggcacgacctctgactcctcacgcggacactcactgcaccctgtggcacacacgccgttgggaccgcctctaccgtagcaccacgacgcctattcttggttcggctaaacacttggccacataggcatcagacagcattcttgtgtccgtgtagaagtccgtaactgcatacttcttccgtgggagactgtgtacgttgagcctgccatcgcggcccaacatcagcagggcgaagaacgtagaggcgcgaagcagcacgcgcgacgtggtcgccccgtcacaggaggaagtcccaactgagcggtccacgacagggacgcaggtagcccttgacagaacgagagaccacagctggaacactaaacgcaccttaacgcgcaacgcgaaaacacggccccagacacgagcccgaaccggtgaccccttgagcacggggttagtgacacgcaccgcttggtaccag

SEQ ID NO: 640519 - DNA, 961 bp, Homo sapiens
gccctccaagcctgggcaacagggtgagactctgtctcaaaaaaaaaaaaaaaaaaaggaaaaaaaaaaaaaccagaactttgggaatggcttgtttgtttaccctggaaggttatttgggaaaaacctattttccctctttatactcctgattttagaacctggtgttggtactttacaccctcaacgctagaactttaattatttttacggagggcgcattagcggttaattctgccttctccagaaggatatttttattctccaaattaccgtgtaactcctctggagggggttaacctcttttttggaggatagagctcttgggctcgtgactctgaaggcctggagttgcagtggccgccagcctctcgaacttcaccaaaaccctccggttgcccgggtttcagggcaattctccctggcttcaagcctccccggagtagctgggtttcacaggtggcgccctccaaccaatggccgttggctaaatggttgggttttcctaagtcacggagcacggggttcccccgtgtcgggctaggctggatcctttgactccctggacctcagtttgatcccacccaatctagggtctcccacagagttggcggggtttggcgttggttgaccccaccggtggcccaggacttaacaattcttggctaaggtccatttccttcccctttttccaatcagtttgtatggtggtgttttggtggtatgctcttgtggggggaaaacgagacacggggcctcacgtccgggtgtgccccggtggggaggggtagggttatgccacgatagcctcaacccctgggggcgggtggttaccccccgggaggcccggagatggtgggatttacatttcggcccaatttgtcttgttgtctgccacgagtctttgtcggaggggtgttctgcccccgcagtggggtgtggctccgaccccccagggtcc

SEQ ID NO: 640520 - DNA, 254 bp, Homo sapiens
gcaattgcttaatttgttcttccttcttagcattttgctgagaagccaaacgttgcgccaattcagaagattcacgccagaagtcgtagttaccaacgaatggtgtgatcttaccaaagtcaacatccaagatgttggttgacacggcgtttaggaagtgacggtcgtgggataccacaatcactaggttcgggaaatcagccaagaaatcttctaaccagttaattgtctgcacatccagaccgttggttcga

SEQ ID NO: 640521 - DNA, 100 bp, Homo sapiens
ttcaagcttctaacgatgtacggggacatgattatcctggaaaaagaagaaaagagcttcttctttgcagatgaaaataaaggtgtttttggccaaaaaa

SEQ ID NO: 640522 - DNA, 581 bp, Homo sapiens
  misc_feature (163)..(163): n is a, c, g, or t
  misc_feature (227)..(227): n is a, c, g, or t
  misc_feature (279)..(279): n is a, c, g, or t
  misc_feature (324)..(324): n is a, c, g, or t
  misc_feature (360)..(360): n is a, c, g, or t
  misc_feature (388)..(388): n is a, c, g, or t
  misc_feature (421)..(421): n is a, c, g, or t
  misc_feature (426)..(426): n is a, c, g, or t
  misc_feature (532)..(532): n is a, c, g, or t
ctttaatgaacctccttcgggccaaaagatacccaagattattctggttatcctggaacccattccaaaaatttttccaggcctgctaaaaaatcagggtgaaactgagaaacctaagaataatgattaaagaaattggaggcttagacaaatttgaagctcnacaaacccatgaaaatgagtctgtgaaaaggctttcgttaagcttaattgagaaggatttctcngtagaggaacagaaagatcaaaacgttgtaccagaaactacctctgaaggcnacactttccaagttcaggatggggctcctgggacctttaactttnaggtcatgtagctgagacataaatttgttgtgaacnacgtttggtattttgtctaaacgtttcncaactaagaactctttcttaaatgtggtttgtnactgnagcactttttacactgaaactacactcccaacagttccaactgtacaaacaaactgtatgaagcctgtcctctgactaggtttctaatttctatgtggaatttccnatcttgcagcatcctgtaaataaacattcaagtccacccttaaaaaaaa

SEQ ID NO: 640523 - DNA, 313 bp, Homo sapiens
  misc_feature (14)..(14): n is a, c, g, or t
aggcgatgtagagntgctgggtactctggactcaaagtgaaggggtatccgagttattgtatagccattatgattattaatggtgagattgattggagattggtatggtcattgtcggagagtatatttgttggagaggatagctattagaaggattatggatgcgggtgcttgcgtgaggaaatacttgattggagcttcttgtggacgagggtttaattttttgggttagaactggaataaaagctagtatgtttatttctaggcctactcaggtaaaaaatcagtgcgagcttagcgctgtgatgagtgt

SEQ ID NO: 640524 - DNA, 813 bp, Homo sapiens
ctggtggcgtttcaggcactgacacctgtagggaccagccccacagggtcagtgggtctctccctgtgtgcggcgatgagagagtgtagaaataaacgacacaagacaaagagataagagaaaaggcagctgggcccgggggaccactaccaccaatgtgcagagacctgtagtggccccgaatgtctggctgcactgttatttattggatacaaggcagaaggggcagggtaaagagtgtgagtcatctccaatgataggtaaggtcacgtgagtcacgtgtccactggacagggggcccttccctgcctggcagccgaggcagagagggagaggagacagacagaaagacagcttacgccattatttctgcatatcagggactattagtattttcactaatttactactgctatctagaaggcagagccaggtgtacaggatggaacatgaaggtggactaggagcgtgaccactgaagcacagcatcacagggagacggttaggcctccggataactgtgggcaggtctgactgatgtcaggccctccacaagaggtagaggagcagagtcttctctaaactccccggggaaacgggagactccctttcccggtctgctaagtagcgggtgtagttccttgacaaccttttgctaccgctggaccatgatccgcctggtaacgggcgtcttcccagacgctggcgtcaccgctagaccaaggagccctctggtggccctgtccaggcataacagaagggtcgcactcttgtctactggtcaactcttcactttgttccctctaggtctaa

SEQ ID NO: 640525 - DNA, 268 bp, Homo sapiens
  misc_feature (28)..(28): n is a, c, g, or t
  misc_feature (82)..(82): n is a, c, g, or t
  misc_feature (160)..(160): n is a, c, g, or t
caaaaaataaaaaaattagctgggtgtnatggcacacacctgttgtcccagctactcaagaagctgagatgggaggatcctnagctcaggaggtcaaggctgcagtgagccgagattgtgccactgcactgcagctggggtgacagtgcaagaccctgtntcaaaccaaaccaaaccacacacacacaaacacacatacacacacacacacacgaggtccaaatggtagcagggatccaaaggggacacagtatgtaggtcaaacttg

SEQ ID NO: 640526 - DNA, 368 bp, Homo sapiens
tcacctgagggggggagttcgagaccagcctttgcaacatggtgaggccccatgtctactttagaaaaaaaaattaggctggcagcagtagctatgcctgtaatcccagcactttgggaggcctaggtgggcagatcatctgaggacaggagttggagaccagcctggccaacatggtgaagccccgtctctactaaaaatacaaaaattaaccgggcgtggtggggggcacctgtagtcccagctaccagggaggctgaggcagaagaatcacttgaacccagaggcagaggttgcagtgagccaagattgtgccactgcactccagcctaggcaacagtgtgagaccctgtcccaaaaaaaaaatg

SEQ ID NO: 640527 - DNA, 220 bp, Homo sapiens
aatatatctgttaaatgtattcagtcagtacacaatccgttataaaagtagtatatatattatactgtcaataccttcatcacatctataaatacaagatttacacagcaccccatcaaaaaaaaaatatgtaaagcgcgttaacaattttctccttttttggaatccttttaaaatttcaaaggggggccccggttaaaaggggggcccctaaattaaa

SEQ ID NO: 640528 - DNA, 317 bp, Homo sapiens
gcatccatagcctacaaagtgcttttgtgtccacgatcttaccctagttcttactgagagcctgctgaggtagcaggtcattgttataccactgtgcagtcaagggactcaaggcccacactgtttatcggatccacccgaagccacagcttccgcctccttcatgacccctgagtttcctggcctgtttctggttgtgcctcctgtaactgcctgtaactgtttccctcgttttcatcagccaagccatctcctccctagccctccctgcccgtctactttaggaagcttcttcctggatctgcaggatgttcact

SEQ ID NO: 640529 - DNA, 919 bp, Homo sapiens
atgacccaccaatcacatgcctatcatatagtaaaacccagtcccatgacccctaacaggggcccctctcagaccctcctaatgacctccggcctagccatgtgatttcatcttaccactccataacgctcctcatactatggcctactaaccaacacatgctaaccatataccagtgatggcgcgatgtaacacgagaaagcgacataccaagggccatcacacaccacctgtccaagaaggccttcgatacgggataattcctatttattacctcagaaattttttgcgttcgacaggatttttctgagccttttaccactccagcctagaccccataccccgcatatatgagtggagggggcacttggaacctactaaactaggggcgtgcaccccacgacttgagattcccccttaggaacgtccctctacttcctaaaaagctagcattctctgttagtattaagttctggctagtcaggaggtgattcgatacatcgctgaaagctcactctatgaagtactacttagaaaagtcgagccgaagatccgtaaatgattcacaggcactgacttattacaaatttgaaccttgtggtctgtatgatgatccctcctacgaagtcgtcaacaagatacttcggagtctccccttcaccaatttccgaccggcatctacggtccaacatttttgtgtagccacaaggcttccacggacttcacgtcattattggctcaaactttcctcactatctgcttcatccgacaactaaatatttcactttacatccaaacatcaccttgagcttcgaagccggcgctggatactggcatttgtagatgtggttttggactatccctgtattgtctccatcctaattgatgagggtctttaaaaaaacacatttaaaaagcg

SEQ ID NO: 640530 - DNA, 287 bp, Homo sapiens
cgtgaggagcaggtaccatttttagtagtcacacaattccacctcctgtttttactactggcaacttctacttgagaataatgttctgaaaatggaggtgggggggggtttggaagcaaacacatttggggtttttaaccaattgttaggttctttttatttagggttgtgcagggaactgttgggaggtttctttaggtgggatggggggactgggtgttggtttttggggggtttttgggacgggttttattttgtcccttaacttggtttgttgggcaggtggg

SEQ ID NO: 640531 - DNA, 680 bp, Homo sapiens
ggagagaactagtctcgagttttttagggtttttttaaaccagggaaaaacatcgggattccattgggtagttaaaaggttttggaaaatgttgatatacacaagcggtactgggagcgggataacagacataggaccgggatgacagacatactttaatcctttaattttggagagtggagtttcactggtcacccaggcgggaggtgcaagggagcgatctgggctcacgttggaacctccacctcccagggctcaagcaaattctccgtggcctcagcctccgtgagtagcgttgggaccacaagcgccgtggcaccacgcccagcataatttgtggatagctatatacgataaaaagacgggggttatcacccatttgttggcgccagggcctgggtcttcaaaacctcgcatcaacctcagggtagaactccaccttggcgctcggtttccgcaaaggtactgggagatatacagggcggtagacgccattggcccgcccgggcctttaacaatgaggatttgtcactccctagaaagggcacttttcccccaaaagaagattcaactcttaaggcctctggcgtgctaggccaagttcccagtgggacgtgcccaaaagaggccagggaaaccagtccccatggggagatgtgtagtcccctttaaacaatagg

SEQ ID NO: 640532 - DNA, 656 bp, Homo sapiens
ccaggtcttccctcaagctgattctggtctctatttcttctctccttgattatgttcctggtttctgatcatatccctaaatggtaaaaactggtatctggaaaattagaacataaataaaataaagttaagtccaatttatctaactccggtattgtgtgaacaagatttgaagacagctaaaacttagaaaataaactaaattcaaacttcccaagtattccttctcccaattctgtttgaataataatagctaacatgtattgaacgtgtgttataatcccaacgattattctaaatattttacatatactaacttgtctaattcttacaagtctatgagcaagacagcatttattattcccattttgtatatgaggaaactgagtcacataggagtaaactggtctaagttaaaaactggcaaactggcaaagttaggattcacatctaagtaatctggatctgagtctccattctttgctacaccataaacctacatatacaacaaaaactctctagccatagtctttcatgagaaacccaaaattactgaagcacaggtttatataaccttttaaccatacttatgctacatggagcattattattagcaatggtacagtatgttttatgagagcgcagatattatttac

SEQ ID NO: 640533 - DNA, 214 bp, Homo sapiens
  misc_feature (23)..(23): n is a, c, g, or t
cagggggggggggccccccctgntacccttttggtcccccttgggttttctcccccaatttaaaaagaaacctttggtaaaaaaaaacgggtctttttttaagacaaaggccccccccatagaaagggtttttggaaacccctttttttcccccccattttgggtcccttttaactacccctttttccataaagcccttttgttttggttttta

SEQ ID NO: 640534 - DNA, 117 bp, Homo sapiens
  misc_feature (16)..(17): n is a, c, g, or t
  misc_feature (107)..(107): n is a, c, g, or t
  misc_feature (117)..(117): n is a, c, g, or t
tacagggatcctctanncggcacaccaaacacacgtcaactaccaccattcaaaagttgagcaaattgggctatgaagttttggctcatctggcatactcacatggnccatcaatan

SEQ ID NO: 640535 - DNA, 1303 bp, Homo sapiens
  misc_feature (219)..(219): n is a, c, g, or t
gatggtaagggagcgaagtgcataactcctaagggctagtcgatggtcaatcattctaaagatcgttcctttgtcggacatgagtcgctgtagtacaatctacatgtgagctcatcgcaataatcaacagtcatcacgtgtgactctgtacggggactgtaggttgccagggaagatgcactgaagatacatgagattgtttggggtagaagttctagntggcatgctataagatcgagttgtagtctgaatgtgacacttatgtgtatccactttagggccgctagggacgtcagggtagtgagttacataggtccatggttaaatggcgcgcaaggatactcatgttgggtgaagaggcatagaagtgtgatgtgatggaatgtggctgtggggtgtcgggacgaagtatagtagaactacaagctttgaagcctaagcatatatccaatatatcatgtaacctatataaacatttaccgatagagattcatctatctaaactcgttatcttagaaccactaatcagagagttgctacataacttaaaagccataacaaaagaaattacagcacgagcgacgtgggctatcgcaggggatggcctctgctagttacccctatggcttggaatcgcgtgataagggcttgtgatgggacagcgtagagtaacatttgtgctttggtaaaaaccccggtgggaggaggtgggtaagcgttgggtcaagaatggagagccttagaaagagatacgacagagaccgaaaattgatcaggccttctcgggggccccttggaggacagaaagaggagggcacacgcggaagaaaactttcctgggttcattcaaaagacagtgggataataattgccaaaccacaatgatctcgtctgtaaattcgttttacataggcaaaacctagaggtgggatacgagctggatcaacccgcttgtacaatatggggaagggaacgttgccccagggaaattcccccaagttatttagcaaagtgaacacccacagagttggcccttattctaccattacagttgtgcgaacacacctaatgtagtctttgggtgggagaaataagacacgactgtgtccattggcaagggttaataacattggtaccttcctgggttggagcaaatttttggcgctatggttaattactatggcgaacaagtaagggggggaacagataacaaagtgggggaaaaacttacaagttaacaaaggaagagaattatatatgaataatttcattaaggaataggggaagatacttaggggaccag

SEQ ID NO: 640536 - DNA, 290 bp, Homo sapiens
  misc_feature (262)..(262): n is a, c, g, or t
gaaaaagacaaggaaaaagtatggtccatttacatatttataaaagcaatgtaagagctttcccatcagtggtattcttggaatctatggtctttactaacttactatagctccagccactgctggggctcttccttatgggccatagctaagagtaaccccagcagttgcctagaaacataatcactcctgatgattgggagaatgaaagtttcccgtttaaactgactttattcttctagaagaaactgcctgtgctggngaatacaactctaaaactttaatttttt

SEQ ID NO: 640537 - DNA, 633 bp, Homo sapiens
cactccctgctcagtgtcttccgttatggaggacttcttgatgagacccaggatgcacaatggcagcgagctttgcattatcttagtgccatctcagagcgttaactacagtgacccatgattgtcatcatgcatcttatgacggacaacgacacaaggatccctttatcagcaggaacggttccactgtggagcgtacatcttcagtcccccggagctgaaatggctgtctgacggcaacgacaggcatgtgacccccggcttgcgctgctggcattccagtccaagcctacttctgacgcaatgacggagactgacaaacctaaccacaggcagctatggacgacacctgtgctcccagcgacaaggcactcagcatgccaccagtaccggcgcattgcagcacttcagccccagcctccctgagggccctggccctttccgaaggagatcaccgcctcattcgtaaccgcaaacagctggttccatggacggtactttctgagacttcatcctcgaggcctggtggctaccggctcttttcatcttcacggccacccacagaaatgaagcagagtggcctaggctcacagtgcacagggctgttcagcaccacagtgctgggtggctcct

SEQ ID NO: 640538 - DNA, 816 bp, Homo sapiens
  misc_feature (217)..(217): n is a, c, g, or t
gtccgctgcccctttagtgtttattgttggttgcgtcctcctggcaacgaactctcgcagcgtaagtgtagcgggagatgagtgctcgtgacgttgacacgccccgctgtcgcggatctcattgtatttgccctcgctgcttctcctcacagtgggggtcttgtcgcacctagataggtttatgttcgtgtccgcccgcgccgcactaacttgaacncctttctggtggggtcgggtcacggctctttttccgtagccacccgcctgagctccgtctcgtgccattgagccgcgtttgcgcggcgtctcgttctgctctcccgctctcgctgtttgctcacatccccttccccgtggtgtgggaagctacactctgctctgctccaggaggtctcttgttgagaatcacacacgtttctttccttctcttcgttctcgcacatataatctcatcactctctcttccttgtcactctccacctgttcggatgctctgctctcacactacacacattgttctcactcacaccccacgtgtaaatgctctgctcgctctctgacacacacatttgtccctccctcacccacgcacacacatcaggggagggctctctcactccgtctccactcaccacacactatctagaccacacaacttatacaccctctctgtctctccccagtggacacaccaccctctttatttcttaccaccctccttcttccccctatttctctctcctctttctctctctctcccccccgccacgtcacaatatcccgggtgttattctcccccaacaaatatacaaacaa

SEQ ID NO: 640539 - DNA, 207 bp, Homo sapiens
aacaagaacacctgtcctggagaccgaagtgccattacaaccttgcggccttcggcttcgggccccaccttaactttttgacaattccgtgagatgacttccggagagttgtggactttgtaggtgaagggttaacatttggcttaggcgcaatgcgcaagctccaagctccatgatttaaatccttccttctaagatctaaaaaca

SEQ ID NO: 640540 - DNA, 905 bp, Homo sapiens
  misc_feature (14)..(14): n is a, c, g, or t
  misc_feature (19)..(19): n is a, c, g, or t
  misc_feature (23)..(23): n is a, c, g, or t
  misc_feature (28)..(28): n is a, c, g, or t
  misc_feature (359)..(359): n is a, c, g, or t
  misc_feature (422)..(422): n is a, c, g, or t
  misc_feature (874)..(874): n is a, c, g, or t
  misc_feature (904)..(904): n is a, c, g, or t
agcgggttcccgangcgcngggngcggntgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgncccagccccggccccagaagagtggctggacattctggggaacgggctgttgaggaagaagancgctggtcccagggccgccaggttcgagccgcccggtcaagggccaggtggtcacctgtacatctgcagacgtcgctggagaattggcacactgggtgcaggaggagccggagctggtgttcactctgtggtgactgtgacgtcatccaggccctggatctcagtgtcccactcattggacgtgggcggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaaccccactaccagcgggcggacttcgtcctggccgccaactcctacgacctcgccatcaaggctatcacctcancgccaaagtggacatgacgttcgaggaggng

SEQ ID NO: 640541 - DNA, 905 bp, Homo sapiens
  misc_feature (14)..(14): n is a, c, g, or t
  misc_feature (19)..(19): n is a, c, g, or t
  misc_feature (23)..(23): n is a, c, g, or t
  misc_feature (28)..(28): n is a, c, g, or t
  misc_feature (204)..(204): n is a, c, g, or t
  misc_feature (208)..(208): n is a, c, g, or t
  misc_feature (215)..(215): n is a, c, g, or t
  misc_feature (217)..(217): n is a, c, g, or t
  misc_feature (221)..(223): n is a, c, g, or t
  misc_feature (225)..(226): n is a, c, g, or t
  misc_feature (228)..(229): n is a, c, g, or t
  misc_feature (235)..(235): n is a, c, g, or t
  misc_feature (237)..(237): n is a, c, g, or t
  misc_feature (239)..(240): n is a, c, g, or t
  misc_feature (243)..(243): n is a, c, g, or t
  misc_feature (248)..(248): n is a, c, g, or t
  misc_feature (250)..(250): n is a, c, g, or t
  misc_feature (252)..(252): n is a, c, g, or t
  misc_feature (258)..(258): n is a, c, g, or t
  misc_feature (260)..(261): n is a, c, g, or t
  misc_feature (263)..(264): n is a, c, g, or t
  misc_feature (266)..(266): n is a, c, g, or t
  misc_feature (270)..(270): n is a, c, g, or t
  misc_feature (272)..(272): n is a, c, g, or t
  misc_feature (280)..(281): n is a, c, g, or t
  misc_feature (285)..(285): n is a, c, g, or t
  misc_feature (287)..(287): n is a, c, g, or t
  misc_feature (289)..(289): n is a, c, g, or t
  misc_feature (291)..(292): n is a, c, g, or t
  misc_feature (294)..(296): n is a, c, g, or t
  misc_feature (298)..(298): n is a, c, g, or t
  misc_feature (303)..(303): n is a, c, g, or t
  misc_feature (359)..(359): n is a, c, g, or t
  misc_feature (422)..(422): n is a, c, g, or t
  misc_feature (874)..(874): n is a, c, g, or t
  misc_feature (904)..(904): n is a, c, g, or t
agcgggttcccgangcgcngggngcggntgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggtttcttcttantctntttcatntnccannncnnanncccctncngnngangcttncntnaattcncnnanncngctngnggcccttnnaaancncncnncnnntnatgcnaaacagcctggggccctggcccgagagttccttgctgccatggagcccgagcccgncccagccccggccccagaagagtggctggacattctggggaacgggctgttgaggaagaagancgctggtcccagggccgccaggttcgagccgcccggtcaagggccaggtggtcacctgtacatctgcagacgtcgctggagaattggcacactgggtgcaggaggagccggagctggtgttcactctgtggtgactgtgacgtcatccaggccctggatctcagtgtcccactcattggacgtgggcggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaaccccactaccagcgggcggacttcgtcctggccgccaactcctacgacctcgccatcaaggctatcacctcancgccaaagtggacatgacgttcgaggaggng

SEQ ID NO: 640542 - DNA, 534 bp, Homo sapiens
  misc_feature (86)..(86): n is a, c, g, or t
gccccccccaaatgcacaccgcgccccttttccgcatggggatctttgcgcctaatcatgttgtcgcccagtgccgcttctgggcntttggttttcagtttaaaaagatgaaaaagttttccggggggattgtttcctgtgggccggtgttttaaaagtcccccccccgggggaaaaactttggggtttgggtgggctttttcttccggagcggccccccccacatggtccgggaaaaccggggcctttcccccccagggggtgtttccccgtgcttcccaaacatggggggccggccccgcgccccagccccctccctttcgattattaaggtggggggggtttcggcccccaaattcccccggccgggtgttaaacagtttcccgactcccagatcaagtttcccctgcccccccgggttttgggccggcagccccaaccccgctttcccccccaaagggccccccccttttttttggggccggggccttgtccgggggtgcccccaattaactccgggacgccccggttga

SEQ ID NO: 640543 - DNA, 455 bp, Homo sapiens
  misc_feature (17)..(17): n is a, c, g, or t
  misc_feature (92)..(92): n is a, c, g, or t
  misc_feature (371)..(371): n is a, c, g, or t
  misc_feature (374)..(374): n is a, c, g, or t
  misc_feature (391)..(391): n is a, c, g, or t
  misc_feature (413)..(413): n is a, c, g, or t
agcggcgcccttttttngagatggagtgtgctcttcttgcccaggctggagtgcaatggcacgatctcggctcacctcaacctccgcctccngggttcaagtgattctcctgcctcagcctcctgagtagttgggatgacaggcacgcgccaccacgcccagctaatttttgtatttttagtagagacagggtttctccatggtcaggctggtctccaacccctgacctctggtgatctgcctgcctcggcctcccaaagtgttgggattacaggcgtgagccactgtgcccagccttatctgactattactgtaacagtggccaatcaaaattccttcttttctttttttttttcccttgagcctagaanttncttaatggaggggagantctagcaagcagttgagtcaangggtgtagattatcctacaggggtacaaaacgggcggccgtg

SEQ ID NO: 640544 - DNA, 100 bp, Homo sapiens
ctgcgacgttactggtgggcacggggctgtgtgggttgccgtcggagttggcccactccgcaccagttcctggcagcgttccacaaagctgcccccacca

SEQ ID NO: 640545 - DNA, 517 bp, Homo sapiens
atcagagtggattagtcattctggtctttcacacctggggggactaattcaaaggaaaagccctatcatttggccagcgtggagtttaagagtagcttgagttctcgtgtgaacaccagcgtgtacgtgcacttagaaagagtttattcaaccttttaatacattagagcattggtgataaactggtaacacttagaacatagtttcggtttactggtattaaaacatgtgtggattccgtgtaattccatgcattttggggaggctgacggtgggagcgatggcctagagttcaacgagttcaacgaccatgtctggcgcaacagtggtaggaccccatctcgtacaaaacaggaaaaaacaattgggcctgggagtgcacgcttgtggtcccagctacccaggaagttaaggtgggaggtttacttgagcccagaaggttgaggctgtgatgagccatgatcgtttcattgcactccagcctgggcaacagagcgagaccccgtctcaaaaaaaa

SEQ ID NO: 640546 - DNA, 204 bp, Homo sapiens
tgggagagggggtttggccttgtccccagggtgggggggcagtggggcaatttgggttaatggaggctttggcttcgggggtaaaggggattttcgggcttaagcctccgggggggggggaattaggggcccaattaaccaccccggttttttttggttttttaggtgaaagggggttttggcattgagggcagggtgggtttg

SEQ ID NO: 640547 - DNA, 411 bp, Homo sapiens
tctcgagaacaggtctccctgcaacagaagaattgacccaagggcctgggcgcgggtggctctacacctgggtaatctccagccactttggggagggcccaagggcaagcgggattcactttgaggcccagggaggttcgaagggtcaggcctagggttacgtgggtgaaaccacccatctcctacagaaaggtacgatacattagccgggggtatgcgtgcctgtgtcacctcgttggtcgccatgctaactcggagagagttgaaggtggggaggatcaacctgggacctgggaaggtcatagaaatgcaagtgaagccaatgaatacaatgccaaatgcaattaccaagcctaaggcaaacagaagcaagaaccataatatcaaaaaaaacaacaaaagaggggcggg

SEQ ID NO: 640548 - DNA, 539 bp, Homo sapiens
tccttcttttttctggttggttttaaaataaaaatttggaaaaaaaaaatgaaaaaatctctaataaaaaaaaaaaaaaaaaaaaaaaaaaaaaaagggggggggctaaaaattccccggggggggcccccgctgctgcgcgctctaccccagcttttctggcctcacaagggcgcccccaagaaggggagccacaataaaaaccccgagccgcggggccacgctaacacacacgctgcgcaaggagggaaacaagctgtccaaagcgcggggactcctcgtgggagagagaagaacccctcttatcttcgcgcggggggtggggaccattaatgttcgcgacaaactctccctctactcagaagaatgtataaaggcctctctcaagagggaaaaaaattcataacatcttcaagcgcgtatatagtgttgttcaacccacacagcgggaaattgatgctctggtcgcgtctgagagatagtttgtgcgcccaacacgcgaagctattatttctgtagaaaaatttttataccggaga

SEQ ID NO: 640549 - DNA, 800 bp, Homo sapiens
ctatcacgaacgaggaactctacctctctatactaagtctccctacaaatctccttaattataacattcacggccgcagaactaatcagtattttatatcttcgttcgaaatccagcacttattcccgcaccttggcctatcagtcgacgccgaatggaggcacacccacgtgcagcatacgccatgcaatcgcagcgcgacatagcttcctattctacatgcctagtggctcccttcccctactcatcgcactaatttacagctcacaacaccctaggctcactaaacattctactactcactctcactgcccaagaactatcaaagctcctgagccaacaacttaagtatgactagtcttacatcagatagtcttttatagtacaacgatacctctttacggactccacttatgactccctagagcccatgtcgaagcccccatcgcggggtcaatagtacgttgccgctagtactcttaaaactaggcggttatggtataatacgcctcacgactcattctcaaccccctgacaataatagatagcctaccccttccttgtactatccctatgaggcataattataacaagctccatctgactacgagaaacagagctaaaatcgctcattggataactctttcaatcaggcacattagcctcggaggtaacgggcattctgcattctcaaaccccctgtaaggctttaccggggccagcagttctcataaatcgcgcacggggttaaaatctcaattataatctgcgtagagaatccaattagaaagggctcccaa

SEQ ID NO: 640550 - DNA, 225 bp, Homo sapiens
  misc_feature (72)..(72): n is a, c, g, or t
agataaatatacatacaactcctaatctcagtagtcaggacacaaacactgcggaaggcgcaggatcctctngctaggaaaaccagagacctttgttcacttgtgtatctgctgaccttccctccactattgtcccatgaccctgccaaatccccctctgtgagaatcacccaagaattatcaataaaaaaataaattaaaaaaaaatgtaacacaaaacaaggt

SEQ ID NO: 640551 - DNA, 390 bp, Homo sapiens
tcacagtgcttgtattcaagtaacccttattttacttaataatgggtccacaaagtgcaagagtagtgatgctggcatattgttataattgtttaattgtattattatttttgttaatatcttactgtgcctgatttataaattaaatgctctcgtaggtacaagaaaaatgtagtatacatatggtttggtactatctgtggtttcaatcatgccctgggggtctgcaataagggcggactaggatatgtggagatggagtctttgacaggtaattaggtttagatgagctcaggagggtagaagcatcaggataggactagtgccttataagaagagacacaggagagcttgttcttgctctttttccaccatgcaaggacacagtgt

SEQ ID NO: 640552 - DNA, 303 bp, Homo sapiens
tttttttgaaaaagtcatggaggccatggggtttgcttgaaaccagctttggggggttcgattccttcctttttgcctagatttaagtatacgggtcctcgaatgtgtggtagggtgggggcatcatatagtcaccccaggttatggagggttcttctactattaggacttttcgcttcgaagcaaaggcttctcaaatcatgagaattattatattactgctgttagagaaatgaatgagcctacagatgataagatgtttcatgtggtgtatgcatcggggtagatcgagtaacgtcgggg

SEQ ID NO: 640553 - DNA, 493 bp, Homo sapiens
  misc_feature (19)..(19): n is a, c, g, or t
atggagacccagtgctgangcgagaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagctgggaccacaggctcacaacaccacacctggcaaatttgattttttttttttttccagagagggggtcttgcaacatggcccagacttccttggtgttagttaataaagctttctcaacggcctcagcctttcccagctacggggaaaggctgaggcaggagaatcgcttgaaccggggaggcagaggtggtagtgagccaagatcacaccatggcactccagccgggacaacaagagcaaaagtcggtctc

SEQ ID NO: 640554 - DNA, 573 bp, Homo sapiens
  misc_feature (7)..(7): n is a, c, g, or t
  misc_feature (87)..(87): n is a, c, g, or t
  misc_feature (288)..(288): n is a, c, g, or t
  misc_feature (393)..(395): n is a, c, g, or t
  misc_feature (412)..(412): n is a, c, g, or t
  misc_feature (517)..(517): n is a, c, g, or t
  misc_feature (568)..(568): n is a, c, g, or t
aaccgtncttctcagaacatcacctaccactgcaagaacagcattgcgtacctggatgaggagacgggcagcttgaacaaggctgtncttctgcagggttccaacgatgttgaacttgttgctgagggcaacagcaggttcacctactctgtcctagtcagatggctgctccaaaaagacaaatgaatggggcaagacaatcattgaatacaaaacaaataagccatctcgcctgccgttccttgacattgcacctctggacattggtggtgctgaccaagaattccngtgtggaggttggccccgtctgtttcaaataagtgaactcaacctaaattaaaaaccaaaaacccctgaaaaaactttctctttgccgtttcctcctttaaaaannngaaacaaaaaacaaaanctgaaagctgaatccttccatgtcttctatgcatctacatcttaaactgtgggcaaaagagaaggattggtcagagcagtgtgcaatatgatccactaagtctcntcccttgggccctccccaaatggtttgcagtgttattttgtgggttttttntaaac

SEQ ID NO: 640555 - DNA, 808 bp, Homo sapiens
gggagtggaccagacaaagaggtaagatgaaacagtagtgtgtttataatggtctgtgactatttctataataattagtactatttaatggtgagcttttaaaaatgtaggatagagggtacagtggcactgtatatactatttatagtctcagctactaagggaggctgaggcaagaggcttgagaccaggagctcgaggctgtaatgtgccatgatgatggcacctgcgaatagccactgcactccagcctgggctaataaatatagcaagaccccatcctttaaaaaattttagaacctttttcaaaatcaaagtgcagatgtgttgtatgtaaaaccaaataaaggtagagtaagtgtgatatatgggagtataaaatagcttaaaatttctcgttgaacggacatgtggctaaagggtcaaaacaaggtctgtaagacttgtggagccagagcatagttatttcctgaaataacaagttagtggcttaaactatggtacatgtcgcttaaggaatttgtgaggccaccttatttttgacagaatgctgcaggcacatgtagacgtgctatatgtaggttgagctaacctgtgatctcttaagggactaaaactaacccaggttcccaggtcttccactaaggggtactggacaagtgtttaagccttactccaacctccttattagaaatccactttaccgaattaatttccaatttccacttttatacgaccctccctttggtaatatgcctaaaatttctcgggcagagaacggctgagttcccacagggcaacggttgca

SEQ ID NO: 640556 - DNA, 528 bp, Homo sapiens
  misc_feature (10)..(10): n is a, c, g, or t
actagtccancggttggctggtggataaggctgaggaggcaccgctagatggaccggagacctgtcttctttgctgaatgggggatgggcctcagcgatctccaggcttatactgctggggacatgcctgaacacagtcaccgggcacacggaatgggtcaccaaggtagtttggcaaaaatgtcaagtcaagtctctcttgctcagtcctggagactagatcctcttaaatgcagaccaattagtagattcagattgggccaatcgggcacagaaatcaacagttagtggttaaagaccttgtctgtctctggagggtagaagtatttgtctgtagcccagacctcattctgatggcgaataccttggccggagttcagcacctgggcgctaccagtgggactttgacagttatgatattctcaggggcctcaggacacctgtgatagctgacttgggcttgcctggctctggagatctctttgccctggtgtgtgagaacccgctacctgttcagtcatggacttg

SEQ ID NO: 640557 - DNA, 363 bp, Homo sapiens
ctgttgtcttcagagccctatggggtctcccgtctcctccaagacagagtccgtttcggataaggaggactaatctacccctgagcaccatcagcgaggcactgatgtgggccacgatgtcagcccccaccaccttgtccaagccctactggcagccccccggtgggcctccatcaagggagaagaccaagataagggccctgtctgctgaacaaggctaatgaagatcaagcgttgaagccctaatgctaaggacgttcaatcctactagagcctctgcttgtctgtgaataaatccaccagtacccctacttctccggggccccggactcattcaactccctctaccacggtgctataacg

SEQ ID NO: 640558 - DNA, 370 bp, Homo sapiens
  misc_feature (105)..(105): n is a, c, g, or t
ggggggcccctttgggggaaagggccccccccctttgtagtgttacagggtcccaaataaaaccgggggttccccccagggccccaagggcgcctttagcaacgntttttcaactgtcccccccctccctcccaagtggggtccccccgggccaaaagtttccccaacaaagcccccaaaggccagggttgggcttccccccccccctttccccagtgggggcaaaatgcatgcccaaaaacccaaggggcccccccggttttgttttcaacgcctggcctactttttggatttgccaggggggtttttaattaaagccctttttttttttttttttttcctggggccccataaatgggttttaaatcca

SEQ ID NO: 640559 - DNA, 676 bp, Homo sapiens
gctctctcttgtaaaggaggagctggagatgagtggtgaacgcagaatctttcgaataggtgcagtactctgctctcggacatgagaggcagattaccatcatgtgactgaaatatgcacgttatacatgatctccaatgtctaaaatcagtcaccagtccagaaaagttcttaaggacaatgtttaaaaataattttctaggtaatggctaaaatcatttattaaaaaatgggggcagtaggtaacgtggattcctctctttaaaatttctacggaatttagtgaatgaaaaagcaaattcatccaatgtgtactcatttcaggcacatctgaaatgatcttaattactagaagatctgcatataaatttttgtgaagagttcctcctaaaaactttaagtaaaatgtaatggtagcttgtgataacatcaaatctagggggagaaaaaaacaattattaaagcgcccaagcagtgtgcccttagcagaggaaaatgcaaatctcgcaagcggtggtgtaacgacttcaggagtcactagattcagcactaaatttccgtgttgtggaaaaactcattcttttaatttgagcggtgaatagggcgctttataaattgtggtcctattgaaattctgacattgctatacaaggatgatatcattaaattttaaacc

SEQ ID NO: 640560 - DNA, 1407 bp, Homo sapiens
  misc_feature (1239)..(1239): n is a, c, g, or t
agcgggggcgcaggcgcaagccggcaagatggccggcggctgggagctggccgtctgaggcgggtggcatcgtgctctgctgcgtgcggacgctcccgacgtgcccgcccggagaggtcgtgtcaggcctccggacctcggacttcttatcactaagacaggtggtatgatcactatatgacaagatcgctagaaacgtggcggtcctcgttgacaaggactgtcctgaaccatatgttaggaacgtggtacttggtggtgggctccgatgcagtggtggcgtggcactgtagagtgaaacatgtaccaggaatttccagaaggtgcgaatcgaaacacaagggtggtgcacaagactatgatcgtgagtggcctcaagggtttataaacaccactagtttggagagcctgtggttgtgcttcaccgccatattgtttgtccctttcccaaggactttccattatacaagccctaacgtggacaaccatggcgcgtttgccacacaggtggcaaagagaaaccgaggagtgacgtagcgtgaaagaccccctttgttggagagcttaaattctgacaacatacaccaccaagagaatcaagtcggccactgaaaaagggcaagtccttcagtggaacacttttcccgtccacacggggggataaacacgttggcaaccttgtcttccctatgttgcacctgggagcctgttggtaaccacggtattggccaatttttcccacagtgggcgtacaccgggccacctctgtggggtctcttggaaccttttgaaccttaaaaaaaccttttggagaaaaacgccattaggttaagaactcccaccgacgaaaaaaaactgggggtaacgaaaggggttcccatagcacaggtaacatctgtaggacgcattgtggaattgggcctctccctttactctcgcattcccgggggacacgagaaaaaagaacccttttctccccgaaggtgccagagttggcttctatatctgacaccctgagtctcagttggggtggtttgccctcgaaaaccccgattttggcgcggtggtggtgtcacaacgggttctgaccccacattattggtggacaattgggtttgcccaatagagaaacacgtgctccgtggcttgtatcacttgtccattccctcgaggcgtgtgtaaaaccggaagcgcctattattttgtgaaggagagattaaccgcggcccagccaataanttaacctttttgggccttgtgttgtacaaccccgggttttagagtttggaaaccctttccgttcacaggtttgtccagagaaggggcttaggagaatatacgtaaaccacaccacacaggttttgttcgcacagtattagggctcgccctgtgggaaaaatttcccgg

SEQ ID NO: 640561 - DNA, 1326 bp, Homo sapiens
  misc_feature (592)..(592): n is a, c, g, or t
agtgtgaagaagaggcgagaacgtaccccggtacgaccaagagcccgtcgcgcctgctgtcatccctgctgtccaggcacgctacgtccctgctgcctgtcgcccgccgccagccatgccctaagatgaataggctgacagtgggatgctagagggcagataagaggcaacaggtgaacgtgacgaaaccagcagacgacagatcctgcgacgggttggtcgttgcctaaatcgctgcgtccttccaaaaagccaagatgcccaaagccctatacataacggcccccgtgtcaaaacgaaccggcgacgcagacaacgtgtaccccaaacatgggaaaacaacgggtgaacaagtgcgtgattgctagtgcacagtgacgggcgacataaacccttgcaggacaaactgcgacgaatgcccaaaatcatgatccatgttgcacatgacaaagcctgacagcggtgctcggcagattgccaaaggtgcaacgtgtagatgcactttctctgactaacctttgtgttacctctctggcgctgaacttgtaccacgggttttgaagagtagctaactccttcctattcaacggtntttactacaacagattgcacgacattttcgggtgctaacaacctatctgacatactcttctagcttcctaaaccaaccgccatacgtcgttgcgcgtacaagcgccaacacaccgatgaagaccctaccttcttcactttctgcggtcccggtacacactcggggggccgtgacacgtgcgcgcaagtatataggtcccacgatacaagtactcacacacggtgtttcttcccccaaaaaatgaccgtgggagatatgtggacactgtgtgcgcgcaccgcaaaacataagccacgacatttttacaccccgtatatcataacgatatccgcgggaagcaagcaagctgtaccatcactaggggacaatccccaaaggggtacgggcaagcgggggaactttaccccggttgaactcttttgttgatcccaccgaccaattttgtggcccaaccccttttgggcgctcctacacaaatggcccctttgtagtgggggcgtactattgtcgaactagacgacgccaaaactattgggcgtcgtgtaagttgagtcaccgactcttatcgttccccccatttatccccaacagatggttgatacaggcgcgcattaggcaccattataaagctatcccccattataagacccccacgagccaacttcgtggttgggagaccccatgagagccccaaagatactattgggtgaaccaccggctggcacaaggccacc

SEQ ID NO: 640562 - DNA, 241 bp, Homo sapiens
tttttccccctccccctttttttttgggccccccccccctccctttttggccaggtaaatggaggatgggctatgggtttgcaaacagtgggacggtcagggggctttttttccagaggttccccctaggcccccccttccccccctttcccccccttttccttccttccttcctttccttggggcactgggccccatttggagggttgagggaaaccaaaattaaagagggaaagaggga

SEQ ID NO: 640563 - DNA, 194 bp, Homo sapiens
taatctaacacatttaattggggaacaagggagcaactcctttaaaagttggagagtcgcataaattattctcatatacagctaaaccctaagctgggtcacacgatctattttggagcagcaaaaaaggagggctagagaaaggctagagagtgtcttactcgtacacaggggaaccctcaaaagtcgcccgg

SEQ ID NO: 640564 - DNA, 381 bp, Homo sapiens
gccgtacaagacactagaaaaaagaatacgaatgctgaagcacatgtacagcatctggaaactagcctcacaggggcaaatctaagagttcctggccttcaagagcaggtagagagaaatcggggtagaaagtttactcagagagggataatatcaaagaattttccaaacctagaaaaagataccagcagctgagagtacaagaaggctacagaacaccaagcagatttaacccaatagagactacctcaagacatttaccaatcaaactcccaaagatcaaagatgaagaaagggttctataagcagcaatgagaaaaaatcaagaaatcacgtacaacgcagctccagtacgcctggcaacgactgctctgctggata

SEQ ID NO: 640565 - DNA, 126 bp, Homo sapiens
cgtagcccggggcggcggcagctggggcggcgggggcccttcgcggctgtcctcctccgtgtgaagccgttcatctccccgcccgggccggtctctgggggagggtccccggacagtccgcgggcc

SEQ ID NO: 640566 - DNA, 325 bp, Homo sapiens
ttcgattggcgggcaacttagtgagacctcatctctacaaaaatcaccaaaattagcagggcatggtggtgcacaccttgtagtcccagctacttgagggggctgaggtaggaaggtcactggtgcccgggagatcaaggctgcagtgagctgtgattgtgccactgaatttagcctggatgacagagtgagaccctgtctaaagaaaagaaggagaaggagaaggagaaggagaaggagaaggagaagaagaagaagaagaagaagaagaagaagaagaagaagaagagagaagcagtaaggtttaagtttgccgccaatcgaa

SEQ ID NO: 640567 - DNA, 90 bp, Homo sapiens
  misc_feature (1)..(1): n is a, c, g, or t
ntgcgtttgacgtgcggcccggcggcgtcgtgcattccttctcccataacgtgggcccgggggacaaatatacgtgtatgttcacttacg

SEQ ID NO: 640568 - DNA, 189 bp, Homo sapiens
aagttatcactgaagctcttaccatcatctttcagttagtctcgtagattaaatagggaatctatctaagtgatggtatctagcaaataagagtgattagagttgacatttatgtgatgcgtctcggtcttgttgtacgtgactatatctgggcatcaaccctcagcacttgaccttttctccattacc

SEQ ID NO: 640569 - DNA, 392 bp, Homo sapiens
cacaggtctaacagtattgacgttcatggtacaggacacctcataccggtgcataactgcgcctagtggataggagactagcaccagtgcagaggatacccaatgggagatcgacgctgccgaggcccgcacacacatggcacaatacacacgcacagggacatggcagacgatgtggcacgcgctctggaagtcgaacgagatcgtctctacacaggctaccgctgatctatctggtaagcgtctccagagcaccatctcttagatccaccagaccatgtagcagctgaccgtggcacacgcggtcctctgaggtgcatcgtagccgtacgcaccgagcacagtacactctgatggcgatgacatgtgacagtctggcctgcccgctgtgg

SEQ ID NO: 640570 - DNA, 334 bp, Homo sapiens
gttaccaaccatgtgttacaacgtatgttcatagtattgcctcttgagtgtctagtatatgatacagagtgatgggataacctaatgattgcccttctgcaccaagcgtctatcgaggttcaattcgatatcgtctgcttaggtttctcagtgttcataccactctcatctcaagctctggggcttcttgtgacaatgtcaaattctacttcctttcatgttagctgcctctggcagtccatatgatttatgggtgcatcttaacctttcacctggtagggaagacaatcacacctggtcagaagagaggtatcctagtctccataattcctat

SEQ ID NO: 640571 - DNA, 322 bp, Homo sapiens
agggattttatggaaggagtgtgtgtgtgtgtgtgtgtgtgcgagcgagtgtatgtgaatgcatgagcaggagcaatcacaagcgcatgtgcctgtaggggagtcagtgggagggcgctggtagggcccgtcgggacgctgttgctagctcagggcaactgcagggcctcagttgccaagtcgccgctcctatctgtcagctgttcgcaaactgtttacccataggggatctattacaagtgctcaaatgaacaggcagcttaggaactagcagcttcctgggagctgcaattacataagcatatatttttaatataatcac

SEQ ID NO: 640572 - DNA, 896 bp, Homo sapiens
atggcacatgcagcgcaagtaggtctactaagaggctacgttcccctatcatagaagtagcttatcaccgttgcatgatcacgccctcataatcatttcgttatctgctatccgtagtgccgtgtatgccgctttgtcctaactactcgagcaagtaagaatgtagacgtacctatgtaacatctcagacgtctcaggagatagaaagccgtctgaactatcctgcccgtcatcatcctagtcctcatgaacctcccatccctacgcgatcctttagcatagcaggacgtaggtcgaacgatccctcccttaaccatcaaatctagtggcgcaccgatggtactggagcactacgagtgacaccgacctacgggagactaatctttcagattccttagaatattccccccattgattcctagaaatctaggtgatctgagactcctgtgaggttgaccaatcgagtagtagctcccgattgaagcccctatttcgtgtgatatttacgttcaccaagtaggtcttgccactcatgagtgtgtccccacattaggtgaaaaagagatgcagtcccgggaggtctatgacaagccccacttttaaccggtacgacgaccgggggttgtcattagggtcactgctcttgaactcggggtgcgcaaaaccaaaggtttgcatgcccatcgtctaagaattattccctgaaagtctttgaaataggccgtagtttcctatgtacccattaacccttagagcaaaaggaacaaaaaaaaacgtttcggtccgcgcgcctcaaactaacactgtgtaggggggcgagcagaacaggacggtcgactggaagactggtcaaaagcggggccgtcacaggtgggcgtaacgcagcaacccggaag

SEQ ID NO: 640573 - DNA, 473 bp, Homo sapiens
caccccagaggagcgcatctagtccaagatgcagcagcacggctacgaaaatccagcatacaagggcagggagcagctcagaactagacccccgccacagcagcctctgaagtcggacagcaaacccattgcttcactaacccatcggtgtccatttatagactactgtgggaagaaacaaacccgtattatgatatactcattatcgccttggggccagctgtgctgtaacacaagtagatgcctgcaacttgaattaatccacacatcagtaatgtatactatactctctttacattttggtctctatactacattatataatgggttacgtgtactgtaacagaatacagctgtatcaaactagtgcatgaatagattctctcctgcttattaatcacatagccccttagccagttgtatattattcttgtggttagtgcaccaatacagtcctactttacatatgcttt

SEQ ID NO: 640574 - DNA, 386 bp, Homo sapiens
gcagcaatcgcggcagagtcaggactcgaagatgtaacaaacatcttctgtagcgcactcacacagcctctgcagatggctccctgcacgcctctttctgcatgaagtgattgtagtcggtgtctgtcagctagtcttcaagcacacacctggcagagtttctgggctggctttaagtactgttagaacaagcaacccagtcagctgacttcctcgtgcaatgtgttaaactgtgaactctgcccatgtgtcaggagtggctgtctctggtctcttcctttagctgacaaggacactcctgaggtctttgttctcactgtatactatatatcctggggccacagttcttgcttattcctcttgtggttcacgactgaatgtgtcaa

SEQ ID NO: 640575 - DNA, 95 bp, Homo sapiens
gaatccaacaagacaacaatgcctccaagaagccctagcctaagaaggaggcagccaagccagcgtcagcatcagcatcagcccctcaccacccc

SEQ ID NO: 640576 - DNA, 447 bp, Homo sapiens
  misc_feature (434)..(434): n is a, c, g, or t
tcagagaaaggatgagcttgctttttatttcctgaccatgttcataggtaatagtcaattttgagaagacagcagataccaaccctaaacagctaactgaacttcttttgattactaaagacaatacattggcttcagtgcaatgtttggaatgcatgagaagcatcatcaaaatagtacaagctggtaatgggaatacatgtagctgttcttcataataggtattcattctgatcttcctttcagttctctggcgaggaagaaagagtattaggcccctctctaataatgaagggggagggcatgggtgaggggtgtgtgtgaaagaaattagcctttgaaaatgtgccttaaaactcattagacttaaaaccttaatagcaaagattgtactctcaatacctggcatatagtgtagctactcaataaatgtntgaatctaaaaaa

SEQ ID NO: 640577 - DNA, 446 bp, Homo sapiens
  misc_feature (356)..(356): n is a, c, g, or t
  misc_feature (389)..(389): n is a, c, g, or t
attcggcacaggaaaacaacaaccaacaaccataaagtaataagccaggcaaggtagctcatgcctgtgatcccagcacttctggaggctgaagcgggaggattacttcagtctaggagtttgagatcagcttctgcaacatggtgaggccctgtctctacaaaaagtttaaaaaattatttgggcatggtggcgcacgctgtggtcccagctgcttgggaagctgaggtgggaggattgcttgggcctggaagctggagcctgcagtgaactatcattgtgccactgtactccagcctgggcaacaaaatgaaatcctgtctaaaaataaatacatatgtgtgtgttaaggttgncagctgggcacaatgcttttattgcgttgttantcctagccactttttgggaggcccagatggcaggatttgctattagcccattagttt

SEQ ID NO: 640578 - DNA, 183 bp, Homo sapiens
cgatctaatggagagtagcacggtgctcacgatgatcgacggaacttgtacaggaggcatgcaccgacaatgagtgaatacacgtcgaccaggctccatctaaacgaactttggaggtcagcacggttctcaagtgtcgacggaactagtacagggaggcatgcaccgcagtggtgaatacac

SEQ ID NO: 640579 - DNA, 188 bp, Homo sapiens
cagatccccataccatcctgtggtcaattctggtagcacactagtatgaatcctaacaaggtatatcacactcttcgacatgagtcatgactccttgaaaaaagtgaatattccacatccgtaggatatatggacatctgcaaacaaaaatatgccatagaaagcttacgaggattctgtagaatgct

SEQ ID NO: 640580 - DNA, 477 bp, Homo sapiens
ggcccagtgaaagccggccagactacagcaccccatatggtcacaccccaaggtgggcgcaggggaccttacctgttgtcccaagcttccagcagtctgagacacaacagtatactaccttatcctacagctgtgggagactgctccacccacagccggaacacgctgcgacgggtggagtgtgggtgcatgtgaggagccgagggcttgctgcccacacactctaccaacaccccacatacaccacatacatgataaaccatccacaccacacacccactgatcaacacaacaagacgacgcaacgaaggacagcacacatacaaccaccacacaggatcacacgcacacaacaggcccaagccgccacacattcagcagcactacatacaggagccacacgggctcgacagacgagccatagcaactagccccccccgaagaacaacgagccgcagccacaccatgagtacccat

SEQ ID NO: 640581 - DNA, 393 bp, Homo sapiens
ttctttgttgaaaaatgccctgaagcgaaaagatgcaggtttatatggaacccgcgcacccgctcccccactctcccactctgttcgttctgaatgtcttcacgagcgtgcatcaggacgcctggtcccccactcagcagtgagtcagacacgggttcggagcatgttctggctccgagagacacgggtggcagcgcccgttagcatgaccagagccactggtccctacagggtcgccgcacaacccagcaggaacggaggatgcgctcgtgatcgcgacagcctggcggcgagaggcggccatacacccaagtatgtgagttgcaaggaatcctgccagaaccacctggcccctactgaaagagcgcgtcaacctgacaacataccccacaa

SEQ ID NO: 640582 - DNA, 644 bp, Homo sapiens
agaagtcagctactctagttctgttgttttgtgtatataattttttaaaaaaaattgtgtgcttctgctcattactacactgggtgtgtccctcgtgccgttttttttttttttaagacagggtctcattctatcggccaggcgggagtgcaggggggcaatcacagctcacggcagccgttgtcgctccacaggctcagagctatcctgtgcaccgtcgagcctcccagagtagcatgggaccacaggcgatgcaccagctacgcatgactaatttttgtaaatattgtgagacggggtctcccgtggtgttacccaggcgggtctcaaactcctgggctcaagtgatcctcccatctgggcctcccagagtatggggattacagacatgagccactgcacctgccagttccccaagtcccggcattttttaagagacagtttcgctccatcgcccaggcctgggatgcacgtgatgtgatcatagctcactggtaagctcaaactcgtggggctcaagcagttctcccaccaagctccttttgatcttttggtacagatggggtctggactatgtggcccaagcgggtcttaaaactcctgggctcaagcaaacgttcttgactgggccccccaaagtgctg

SEQ ID NO: 640583 - DNA, 560 bp, Homo sapiens
ttgtcagcctgaactcctatagcgcaagcactgcctgcctcagcctcctcccgaagtgctgagattacaggtgtgagccactgagtccggccttacctttttttcttttttttgagacggagtctccctctgttgcccaggctggagtgcaatggtgcagtctcggctcactgcaacctctgcctcctggattcaagtgattctcctgcctcagcctcccacgtagctgggattataggcgtgtgccaccatgcctagctaattttcgtatttttagtagagacggggtttcatcatgttggccaggctggtcttgaattcctgacctcaggtgatccacccaccttggcctcccaaagtgttgggattacaggtgtgagccactgcgcccggccttcatgcattttaaatagttaattctgagacatggaattattggtcaatggatacaaatacccacctcccatggttgtgttcattttattgatgtacactaatgagaatataatatttattagtcttcctcattggaattctacattggaaaccaagcaacccct

SEQ ID NO: 640584 - DNA, 287 bp, Homo sapiens
taggaagagatagatctttgccatcagtcaactgagtgacagcagcattgccctcacgagtgtagagtgagcctcatccaaaccatggacggcttgaatacagctgatgggttaagaaaggtatctgctccactgtctttgagctgggacatcagtcttctgccttaagccttggcattggtctcgaactatatgcgactctcctaagtatagagcttactcagagtacaacttgggctacactgcgtgcgtgcatgcatgtgtgtgtgtgtgtgtgtgtgtgggtg

SEQ ID NO: 640585 - DNA, 950 bp, Homo sapiens
  misc_feature (1)..(1): n is a, c, g, or t
  misc_feature (347)..(347): n is a, c, g, or t
  misc_feature (350)..(350): n is a, c, g, or t
  misc_feature (412)..(412): n is a, c, g, or t
  misc_feature (432)..(432): n is a, c, g, or t
  misc_feature (435)..(435): n is a, c, g, or t
  misc_feature (441)..(441): n is a, c, g, or t
  misc_feature (447)..(447): n is a, c, g, or t
  misc_feature (453)..(453): n is a, c, g, or t
  misc_feature (467)..(467): n is a, c, g, or t
  misc_feature (505)..(505): n is a, c, g, or t
  misc_feature (529)..(529): n is a, c, g, or t
  misc_feature (566)..(566): n is a, c, g, or t
  misc_feature (587)..(587): n is a, c, g, or t
  misc_feature (609)..(609): n is a, c, g, or t
  misc_feature (612)..(612): n is a, c, g, or t
  misc_feature (630)..(630): n is a, c, g, or t
  misc_feature (636)..(639): n is a, c, g, or t
  misc_feature (650)..(650): n is a, c, g, or t
  misc_feature (657)..(657): n is a, c, g, or t
  misc_feature (673)..(673): n is a, c, g, or t
  misc_feature (841)..(841): n is a, c, g, or t
  misc_feature (883)..(883): n is a, c, g, or t
  misc_feature (932)..(932): n is a, c, g, or t
nataaatatctgaagaataagaatacagggctgggtgcagtggctcatgcctgcaatcccagcactttgggaggcggaggcaggtggaccgcttgagcccaggagttcgagaccagcctgggcaacacagtgagacccccctctttacaaaaaatacaaaaattagccaggtgtggtggtgcacctgtagtcccagctacttgagaggctgaggtgggagggtcacttgaacccaggagtcggaggttacagtgagccctgatgggccactgcactccaacctgggcaacggagcaagaccctgtctaaaaaaaaaaaaaaaaagaatacaggagtggggtggggtngtngggctggagacttgaggtgctcctcggctttggtagtcttcgcacgctgggggcgccagaangcctggggatctgacagctngtnctcttncccagngccagngccctgcccccgtnccccactggggagggtctgggaggctccgccagttctncgcctggcccgcggcttcccaggncgggggcgctgcgtcagcggaaaccccgcgaccgggnattagacgccctgagcgcccngcctagcgcccccggggctctnttngggacgagggctgggggnaaacgnnnncatttggggcnctcttancgccggacccttaggnctggaatcccaggccgggaccccgcgtgggtgccccgcagcctcaagtgatgacccatgtcctccatgcccacgcggccccagacgcccagcacgaagctctcgatgtcgcactcattgacgccgcgcacgatgcggaagtggcccctctcgccccaggctgggcccnaggagtgggcgcagtccagtatttgagcgtcttccatctggnagcgtctcctctccccatcctgtgatcttgacttgagtgggtccatgcnggcggtatctctctggct

SEQ ID NO: 640586 - DNA, 428 bp, Homo sapiens
agcggggaacaaatcatgaggtcaggtctctctctgttgcccaagctggagtgcagtgacaccatcttatctcactgaaacctctacctcctgggttttagtgattcttctgcttcacctcgcaagtagctgggattacaggcacacctgtaaattatgccaacatgcctggctaatttctgtaattttagtagagatggggtttggccatgttggccaggctggtctcgagctcctgacctcaagtgatccacccaccttggcctcccaaagtgctgggattacaggcgtgagccactgcgcccggcctgcacatatatttctaattctattgggtatatacctgagagtagaattgctgagtcatatggtcacttaatgtttaatcttttgaggaactgctacactgttttccaaagtggcagtcc

SEQ ID NO: 640587 - DNA, 288 bp, Homo sapiens
gaggaccccaagcgttacatacagactcagatttgagacaaattttggaaatttatcagatacgagaatataaaatacctgttctaggatttcaaagactctactggaggaaacagtcaacatgcaaatgctagatgtgtcttgtaagaagagtgatggaaactctaggcaacaatcaaaaggcacacatgctagacattacatcaaaattccactgccttaactaaagaatgtcttcgaataggttcatcacacagaacaggttggaggaaagaatgagtctgtatt

SEQ ID NO: 640588 - DNA, 176 bp, Homo sapiens
ccacttcagtgacacctgaatagtttgttagttgtagttgttattaattcgtcttcaaatgaggaagggccccattaaagggtgaacattgttagataaactgggacatttcagaagtacaacctcatggtactaggtgcttatactacaacacacaacaaaacagcaacagagag

SEQ ID NO: 640589 - DNA, 269 bp, Homo sapiens
tccacatgcgaatatttgcgattattgaagctgcttaatgtccatgtgaggagaaggcatacagtgaccgattactggcccaaattgattacctggcttctagaaaaaaagtgaaacttcatggagcaagtcatatgagcaagaacagttgagccacagcaacaaatgggcgatatcttccatccagagcagggtactttacatggagtaagaaaataagcaattacaggaaaatagtcttcgtctcacacagcagattgggttcttag

SEQ ID NO: 640590 - DNA, 250 bp, Homo sapiens
cgtggttcacttcccattccctgttggagtctggctcttctattgccatgtacaccacatttctctgtgcattagtatctgtatacatgcttagaggggtttctttgctcctaactagaacctgatgactacagggtgaaaatttgagagttcaattttggaaattatttgtgtcaagtacagtatttctgtgatgcattccagtgatgttcttaggtgagtaggatagtgagctcagtcgaacggactg

SEQ ID NO: 640591 - DNA, 1391 bp, Homo sapiens
gcgcttggtgctcctctccaactaattattagagctggtgggtgagtgtttgctctttatatgttcttccttgtgctcgcagtgggagataccccacactttgatggggggccaacgaccctacttcgttggatgcttccaccagatggggacaccccgtacacattttttattataaagaggaaaaaaagtgtgttgggggcacatatcttaatcttgtgcatagaagttttcccacagagagggcctgctggggagaaaagatcttttttgtcgagcacagactttctggcccagttggtgttgcgccatttggtagaacgccccgtcctgggaagtttacacaagtggttataattccccttccaccgggaattttttgggcaaccggggggggctcgtggcgtggaaagttttgtcgtgctgtgccccacacttggggtgcccacctccccacagatgtgtgtgttgggtccgccgctgtctaatcttgctcgtgggggacgccttcgtctcgtaatcccccggagtccctcgggcaacccttgtttccggggggtgtccccccggccttttttttggtggtttattcttgaaacccccaacggggctggtagccaacccccacgcccttttttcccccggaggggcactttgtttatagggttaaaccccgtagccctaagcccactgtgtgcccctgtgtggtaaaacaccccacgatttttttccctcttttgccgcttatattttgggagcacttggcccacttccccacaggccaccacacaccaaaggggaggcctcacactcccacagttggggttttataaaagtggggttgaaatcctctgggcttccggggagaattttctggcccaatagcgctgggcaccccactgtttgtccccgtgaacacacacgcactcttgggagggtttcacacgcctctgaattcttggaatctttctacacacgagagagtctcctgagaagaagagttgtagaaaaagaaagagagccacggcttgctgcttgaaaaaggccacgtgagccacacggaaggaatttccacagggtgaatggagctctcttcccgcctccctgaggttcacactgctaatcacgccctgagggttgccacagaactggttctcgaaaggtgtacacacaggtggccctttgtgcctaattcacgccattccctatctgaaagactggaggcgctcacagcctgccccggaaagaactggtttgcacgctccccactgctcacaggccacctgaaatgggtaaggaagccacccctgactggttttaagactgtttttgcataggcttttaagccagcctgggaaaatggttgatgggaaattaacaccccgtttttt

SEQ ID NO: 640592 - DNA, 218 bp, Homo sapiens
gttttcgctactgattccttccctgtgggcctacccccatgtgacctccaaggctgtacttcaagtttgggattcaccctgtgatatcttttctggtgatcattaagggatgatggagacctctctctggaccacaaattatgacctatcagtaccatttggacctgacaggggtggattctcagtctgtggtgacccaggagccatcactctcaggg

SEQ ID NO: 640593 - DNA, 630 bp, Homo sapiens
  misc_feature (24)..(24): n is a, c, g, or t
  misc_feature (616)..(616): n is a, c, g, or t
agttcgacggagactctcactaanattagtatgatgggacatatttcaaaataataagagctatctatgacaaacccacagccaatatcatactaaatgggcaaaaactggaagcattccctttgaaaactggcacaagacagggatgccctctctcaccactccttttcaacatagtgttggaagttctggccagggcaattaggcaggagaaggaaataaagggcattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacagacagagagccaaatcatgagtgaactcccattcacaattgcttcaaagagaataaaatacctaggaatccaacttacaagggatgtgaaggacctcttcaaggagaactacaaaccactgctcaaggaaataagagaggatacaaacaaatggaagaacttccatgctcatgggtaggaagatcagtatcgtgaaatgccatactgccangtaattaagattca

SEQ ID NO: 640594 - DNA, 433 bp, Homo sapiens
  misc_feature (8)..(8): n is a, c, g, or t
  misc_feature (135)..(135): n is a, c, g, or t
  misc_feature (147)..(147): n is a, c, g, or t
  misc_feature (186)..(186): n is a, c, g, or t
  misc_feature (225)..(225): n is a, c, g, or t
  misc_feature (257)..(257): n is a, c, g, or t
  misc_feature (265)..(265): n is a, c, g, or t
  misc_feature (268)..(268): n is a, c, g, or t
  misc_feature (374)..(374): n is a, c, g, or t
  misc_feature (392)..(392): n is a, c, g, or t
aggccagnaagattgtcagatggtctccctgccggctctggggacatacctgcgtgcggcacctcgcttccttcttcgcctttcctggcagtcaggcggggcggtggaggccgctcaggtcagggccagggtgtnacgtaggggccngggcaggcaagggtttgtttgggaggcgctgtctgtccntctgtccctctgtggttccagccatctccccctgccagnccagcaccctgggaatcatggtaaagctgatncagcgttnccnagggggtgggttgggcgggggtggggccgggcccccctacgggatgcccacggccggttcatcatcttgtccctggtccccctaccacactccccctcctagaccnccgccctttaacacagtntggatttaataaattcatatgggtgtttaacttaaacccca

SEQ ID NO: 640595 - DNA, 339 bp, Homo sapiens
tgaggactcggaaaatagcgacgcatgcaatacacgattccagtcaacatgtgagcattccaggtttcctgtctggacattcaatttctcctcctgatcttatatagcaagcaggtgggaaatgcccagatggagaaaagatatttacctgtttgaaagcaaatgtggagacattttcaatcttatggccttgtgtttgtagaaattatacagaagatattcagatttgtggtatggcgcacatgatatggtcaaggtagattcctggagggtgtgtcaatacgcactggcttggagagaactttcttttttttggtcttttggccatttctggggcca

SEQ ID NO: 640596 - DNA, 91 bp, Homo sapiens
taattttatttaaaatttcatagctgtattctgaaatataaaaatcatgccagtattttaaaggcattagagtcacctacacaaagcaggc

SEQ ID NO: 640597 - DNA, 770 bp, Homo sapiens
  misc_feature (129)..(129): n is a, c, g, or t
gcaccatactgtttgattactatagcttgtaatgcaattttaaatcaagaggtgtgatgcctccaactttttctttcacagtgatctgtggctgttggggtttttgtggttccatatgagtttcaggantgtgttttcttttcttttctttgttttctttttggaggtggaagtttctcgctcgtgtcacccaagtcgggagtgtgcgaggggcttaattctcggctcacttaaaacctcgtgcctccgggatgtcaggcaattctctcgtgcctcagcctcccgggtagtgtgggaccacgggctactttgccattattgcccgggccaatttttgggatagtttaagtaaagaagacaggggttctcactatgttgggccgggtgctggtgtctccacatttcctggagccgtcatgatccgacccgttgctgtctcccaaaggtggctgggaaattacagggctgtagagccattgtgccttggccaggatggtttatcctggtctgggtgaaagactgtcctcagagaatctttggagggggatctgtgtaagatctggtatataggctaggggtaagggtgaccttttgaccaatggttaatgcttcggatccataaccatgggatgtctctcacatgggtccatggtctcactgtcttccatccaggttaatgggtttaaagtgtcacgttctctcacttcttggtaaatttatgcctaagtttggaccttggaggctgtcgaaaggaagtattctgggggcac

SEQ ID NO: 640598 - DNA, 635 bp, Homo sapiens
  misc_feature (33)..(33): n is a, c, g, or t
  misc_feature (64)..(64): n is a, c, g, or t
  misc_feature (107)..(107): n is a, c, g, or t
  misc_feature (118)..(118): n is a, c, g, or t
  misc_feature (120)..(121): n is a, c, g, or t
  misc_feature (126)..(126): n is a, c, g, or t
  misc_feature (156)..(156): n is a, c, g, or t
  misc_feature (167)..(167): n is a, c, g, or t
  misc_feature (169)..(170): n is a, c, g, or t
  misc_feature (176)..(176): n is a, c, g, or t
  misc_feature (182)..(182): n is a, c, g, or t
  misc_feature (185)..(185): n is a, c, g, or t
  misc_feature (199)..(199): n is a, c, g, or t
  misc_feature (243)..(243): n is a, c, g, or t
  misc_feature (247)..(247): n is a, c, g, or t
  misc_feature (306)..(306): n is a, c, g, or t
  misc_feature (318)..(318): n is a, c, g, or t
  misc_feature (571)..(571): n is a, c, g, or t
cctggtgtggccttgtggggaagacgtttgagntgtggccgcgctggggacctccacccgccanttgcgggagcaccagaagggccggcccaccagcaccaaccccnccgcccagcananngcagnacactggctggagcaccgggggaagctggngggaccaaccncnncggttngcccangcnggagaaggtggcgnggagacggtggagagtggagccatgaccaaggacctggcgggcngcantcacggcctcagcaatgtgaagctgaacgagcacttcctgaacaccacggacttccccnacaccatcaagngcaacctggacagagccctgggcaggcagtagggggaggcgccacccatggctgcagtggaggggccagggctgagccggcgggtcctcctgagcgcggcagagggtgagcctcacagcccctttctggaggcctttctaggggatgtttttttataagccagatgtttttaaaagcatatgtgtgtttcccctcatggtgacgtgaggcaggagcagtgcgttttccctcagccagtcagtatgttttgcanactgtaatttatattgcccttggaacacatggggccatatttagctattaaaaagtttttccca

SEQ ID NO: 640599 - DNA, 2989 bp, Homo sapiens
  misc_feature (20)..(20): n is a, c, g, or t
  misc_feature (30)..(30): n is a, c, g, or t
aaagcaggctggtactgccntggggtgcantggccggctccagctggggccggagaggctgagtggttggtacgctgctcgctggcctcccagtcttcccagcaaccggtgacactgcccgcgccagactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgtcaggaggtggaccccagagtgtgagtggcacgcttccctgtgaacccgtcctcaccatgtttgccacatctggggcagtggcagcggggaagccttactcgtgcagcgaatgtggcaagagcttctgctacagctcagtgctgctgcgacatgaacgagctcacggcggtgacggccgcttccgttgcctagaatgcggtgagcgctgtgcacgggctgctgacctccgagcgcacaggcgcacgcatgctggccagaccctctacatctgcagtgagtgcggacaaagcttccgccacagcggccgtcttgacctacacttgggcgcacaccggcagcgatgccgcacttgcccctgccgcacatgcggccggcgcttcccgcacctcccggcgctgctgctacaccggcgccgccagcatctgccagagcggccccgccgctgcccgctgtgcgcccgcaccttccggcagagcgcgctgctcttccaccaggcgcgggcgcaccccttggggacaacctctgaccctgctgccccaccccaccgctgcgcgcagtgcccgcgagccttccgaagcggcgccgggctgcggagtcacgcgcgcatccacgtgtcccggagccccacgcgaccccgtgtctcagacgcccaccagtgtggcgtgtgcggcaagtgctttggcaagagctctacgctgacgcgacacctgcagacgcactcgggggagaaacccttcaagtgcccggagtgcggcaagggcttcctggagagcgccacgctggtgcgccaccagcgcacacacacgggcgagaagccgtacgcatgtggcgactgtggacgctgcttcagcgagagttccacgctgctgcgccatcggcgcagccatcagggcgagcggccacatgcgtgcgccacttgcggcaagggtttcgggcagcgctccgacctggtggtgcaccagcgcatccacacgggcgagaagcccttcgcgtgccccgagtgcggccgccgcttcagcgaccgctcggacctcaccaagcaccggcgcacgcacacgggcgagaagccctaccgctgcgaactgtgcggcaagcggttcacgtgcgtgtccaatctcaacgtgcatcggcgcaaccatgccggccacaagccacacaaatgccccgagtgcagcaaggccttcagcgtcgcctccaagcttgcactgcaccgcaagacgcacctgggcgaacggccagcggagtgcgcagagtgcggcaagtgcttcagccacagccgctcgctgtcacagcatcagcgggcccacacgcgcgcccgcaccgctgccgccgttgccatccagtccgcagtgggcactgccctcgtctttgaggggccggctgaacaggaaaagccagggttctctgtgtcctagttgagggaggcttgctgaggcttctctaaaggtggttgggcaagcacctatatagtatcacggggacagttgaggcaactcgtagatggagatttgggaaaagacgatgtggcctcctacctttccagtttctgttggcagcccttcacgtagcctcctgcctcgcctctacacctactaccctgtcggcccttttgccatgctgtcctcgtataactcggattctctcctcaggtgtaggtgcagggagtcagggaacccttagactcccctgtgtgcaagagcccaggtgttggtgtgtccctttaatgctactgtgctctctggtgtttctgattttcctgcctttattctgtcttctcttgtcctatctcattccagcccacatcttctcctttcctgattacttttgttgtcctgcctcttcaggtaatggtcacagatttggctgtaggcacgttaccagccctgtggcttcttgactcttggttccctggcagaggtggccagtcacgtgaaggtgggcagggcccttagcatggccacacatgtccccagggcagatcaaggggcctctcagaaccatgttccccagccaggtgaggaccattttcactgggacccaggccaaaaccatgtgggtgcacaaagccaggcactgccaagtggaacatgaggttatttccaaatcatgggagccaccagcagggagagggcaggatggaaaatcccctggagccggtcaactttttgctcatggctagtgaaataaagttgtttgagtactagatgccaagtgccgcctttatc

SEQ ID NO: 640600 - DNA, 107 bp, Homo sapiens
  misc_feature (10)..(10): n is a, c, g, or t
tgattgaatncagtaccagagtctgaagaacaggattccacccaggcaaccacacaacaagcccagctggctggcagcagtctgaaattgatgaatgaaccagtcat

SEQ ID NO: 640601 - DNA, 2341 bp, Homo sapiens
  misc_feature (20)..(20): n is a, c, g, or t
  misc_feature (30)..(30): n is a, c, g, or t
aaagcaggctggtactgccntggggtgcantggccggctccagctggggccggagaggctgagtggttggtacgctgctcgctggcctcccagtcttcccagcaaccggtgacactgcccgcgccagactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccaccccaccccaccgctgcgcgcagtgcccgcgagccttccgaagcggcgccgggctgcggagtcacgcgcgcatccacgtgtcccggagccccacgcgaccccgtgtctcagacgcccaccagtgtggcgtgtgcggcaagtgctttggcaagagctctacgctgacgcgacacctgcagacgcactcgggggagaaacccttcaagtgcccggagtgcggcaagggcttcctggagagcgccacgctggtgcgccaccagcgcacacacacgggcgagaagccgtacgcatgtggcgactgtggacgctgcttcagcgagagttccacgctgctgcgccatcggcgcagccatcagggcgagcggccacatgcgtgcgccacttgcggcaagggtttcgggcagcgctccgacctggtggtgcaccagcgcatccacacgggcgagaagcccttcgcgtgccccgagtgcggccgccgcttcagcgaccgctcggacctcaccaagcaccggcgcacgcacacgggcgagaagccctaccgctgcgaactgtgcggcaagcggttcacgtgcgtgtccaatctcaacgtgcatcggcgcaaccatgccggccacaagccacacaaatgccccgagtgcagcaaggccttcagcgtcgcctccaagcttgcactgcaccgcaagacgcacctgggcgaacggccagcggagtgcgcagagtgcggcaagtgcttcagccacagccgctcgctgtcacagcatcagcgggcccacacgcgcgcccgcaccgctgccgccgttgccatccagtccgcagtgggcactgccctcgtctttgaggggccggctgaacaggaaaagccagggttctctgtgtcctagttgagggaggcttgctgaggcttctctaaaggtggttgggcaagcacctatatagtatcacggggacagttgaggcaactcgtagatggagatttgggaaaagacgatgtggcctcctacctttccagtttctgttggcagcccttcacgtagcctcctgcctcgcctctacacctactaccctgtcggcccttttgccatgctgtcctcgtataactcggattctctcctcaggtgtaggtgcagggagtcagggaacccttagactcccctgtgtgcaagagcccaggtgttggtgtgtccctttaatgctactgtgctctctggtgtttctgattttcctgcctttattctgtcttctcttgtcctatctcattccagcccacatcttctcctttcctgattacttttgttgtcctgcctcttcaggtaatggtcacagatttggctgtaggcacgttaccagccctgtggcttcttgactcttggttccctgttaactctgtttctgagaaatgtgggtatggaggtgggtgggaaagctcacttccatgaaggatgtctccatgctaggagctgcctgcaccctggcagaggtggccagtcacgtgaaggtgggcagggcccttagcatggccacacatgtccccagggcagatcaaggggcctctcagaaccatgttccccagccaggtgaggaccattttcactgggacccaggccaaaaccatgtgggtgcacaaagccaggcactgccaagtggaacatgaggttatttccaaatcatgggagccaccagcagggagagggcaggatggaaaatcccctggagccggtcaactttttgctcatggctagtgaaataaagttgtttgagtactagatgccaagtgccgcctttatc

SEQ ID NO: 640602 - DNA, 1999 bp, Homo sapiens
  misc_feature (20)..(20): n is a, c, g, or t
  misc_feature (30)..(30): n is a, c, g, or t
aaagcaggctggtactgccntggggtgcantggccggctccagctggggccggagaggctgagtggttggtacgctgctcgctggcctcccagtcttcccagcaaccggtgacactgcccgcgccagactgaccactagccgacgcgggcgagagggacaggagcgtgacctccccatcccgaggggccggacgctcgggcgcctccccgctccccccaccccaccgctgcgcgcagtgcccgcgagccttccgaagcggcgccgggctgcggagtcacgcgcgcatccacgtgtcccggagccccacgcgaccccgtgtctcagacgcccaccagtgtggcgtgtgcggcaagtgctttggcaagagctctacgctgacgcgacacctgcagacgcactcgggggagaaacccttcaagtgcccggagtgcggcaagggcttcctggagagcgccacgctggtgcgccaccagcgcacacacacgggcgagaagccgtacgcatgtggcgactgtggacgctgcttcagcgagagttccacgctgctgcgccatcggcgcagccatcagggcgagcggccacatgcgtgcgccacttgcggcaagggtttcgggcagcgctccgacctggtggtgcaccagcgcatccacacgggcgagaagcccttcgcgtgccccgagtgcggccgccgcttcagcgaccgctcggacctcaccaagcaccggcgcacgcacacgggcgagaagccctaccgctgcgaactgtgcggcaagcggttcacgtgcgtgtccaatctcaacgtgcatcggcgcaaccatgccggccacaagccacacaaatgccccgagtgcagcaaggccttcagcgtcgcctccaagcttgcactgcaccgcaagacgcacctgggcgaacggccagcggagtgcgcagagtgcggcaagtgcttcagccacagccgctcgctgtcacagcatcagcgggcccacacgcgcgcccgcaccgctgccgccgttgccatccagtccgcagtgggcactgccctcgtctttgaggggccggctgaacaggaaaagccagggttctctgtgtcctagttgagggaggcttgctgaggcttctctaaaggtggttgggcaagcacctatatagtatcacggggacagttgaggcaactcgtagatggagatttgggaaaagacgatgtggcctcctacctttccagtttctgttggcagcccttcacgtagcctcctgcctcgcctctacacctactaccctgtcggcccttttgccatgctgtcctcgtataactcggattctctcctcaggtgtaggtgcagggagtcagggaacccttagactcccctgtgtgcaagagcccaggtgttggtgtgtccctttaatgctactgtgctctctggtgtttctgattttcctgcctttattctgtcttctcttgtcctatctcattccagcccacatcttctcctttcctgattacttttgttgtcctgcctcttcaggtaatggtcacagatttggctgtaggcacgttaccagccctgtggcttcttgactcttggttccctgttaactctgtttctgagaaatgtgggtatggaggtgggtgggaaagctcacttccatgaaggatgtctccatgctaggagctgcctgcaccctggcagaggtggccagtcacgtgaaggtgggcagggcccttagcatggccacacatgtccccagggcagatcaaggggcctctcagaaccatgttccccagccaggtgaggaccattttcactgggacccaggccaaaaccatgtgggtgcacaaagccaggcactgccaagtggaacatgaggttatttccaaatcatgggagccaccagcagggagagggcaggatggaaaatcccctggagccggtcaactttttgctcatggctagtgaaataaagttgtttgagtactagatgccaagtgccgcctttatc

SEQ ID NO: 640603 - DNA, 1914 bp, Homo sapiens
  misc_feature (20)..(20): n is a, c, g, or t
  misc_feature (30)..(30): n is a, c, g, or t
aaagcaggctggtactgccntggggtgcantggccggctccagctggggccggagaggctgagtggttggtacgctgctcgctggcctcccagtcttcccagcaaccggtgacactgcccgcgccagactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgtcaggaggtggaccccagagtgtgagtggcacgcttccctgtgaacccgtcctcaccatgtttgccacatctggggcagtggcagcggggaagccttactcgtgcagcgaatgtggcaagagcttctgctacagctcagtgctgctgcgacatgaacgagctcacggcggtgacggccgcttccgttgcctagaatgcggtgagcgctgtgcacgggctgctgacctccgagcgcacaggcgcacgcatgctggccagaccctctacatctgcagtgagtgcggacaaagcttccgccacagcggccgtcttgacctacacttgggcgcacaccggcagcgatgccgcacttgcccctgccgcacatgcggccggcgcttcccgcacctcccggcgctgctgctacaccggcgccgccagcatctgccagagcggccccttttgccatgctgtcctcgtataactcggattctctcctcaggtgtaggtgcagggagtcagggaacccttagactcccctgtgtgcaagagcccaggtgttggtgtgtccctttaatgctactgtgctctctggtgtttctgattttcctgcctttattctgtcttctcttgtcctatctcattccagcccacatcttctcctttcctgattacttttgttgtcctgcctcttcaggtaatggtcacagatttggctgtaggcacgttaccagccctgtggcttcttgactcttggttccctgttaactctgtttctgagaaatgtgggtatggaggtgggtgggaaagctcacttccatgaaggatgtctccatgctaggagctgcctgcaccctggcagaggtggccagtcacgtgaaggtgggcagggcccttagcatggccacacatgtccccagggcagatcaaggggcctctcagaaccatgttccccagccaggtgaggaccattttcactgggacccaggccaaaaccatgtgggtgcacaaagccaggcactgccaagtggaacatgaggttatttccaaatcatgggagccaccagcagggagagggcaggatggaaaatcccctggagccggtcaactttttgctcatggctagtgaaataaagttgtttgagtactagatgccaagtgccgcctttatc

SEQ ID NO: 640604 - DNA, 486 bp, Homo sapiens
  misc_feature (335)..(335): n is a, c, g, or t
  misc_feature (382)..(382): n is a, c, g, or t
tggtaaagtatgcatgcagtcttgtactggacctaagaacaaaactgtaactgcattagaaaccatgaaaaaattagatattgttttgtgacttttagccagtggtaaatatagaaccataattctggtcacttccatttctctccacatgaaggatcaaaaaatgtttttcaatgtgttctttgttccactgaaacttagagtcatgagttatcactgatttggtcaccttcctccgcctttgttcccgtgagttctgatgtcttagtgacttagttttagaagctcacccttagtttgacagattctcccgtggtccccaaacctgtgcatanccataagaattgagccagggtgtttacgtgcatgagatcagttgcancagcaagcaaaggagagaggacaccgttaatcagtgtgtttgataacttcagaactgtgaacagcctaatttgtccaacatgtcagaaaggacatttaaaatta

SEQ ID NO: 640605 - DNA, 104 bp, Homo sapiens
ttaatggcattctcatgagaaaacttctgagtgcagcattgcctgtggtgaccatgttgggcttcagcaaggtgcttccaggtagacgtggtggtcactcagag

SEQ ID NO: 640606 - DNA, 1733 bp, Homo sapiens
  misc_feature (20)..(20): n is a, c, g, or t
  misc_feature (30)..(30): n is a, c, g, or t
  misc_feature (1652)..(1652): n is a, c, g, or t
  misc_feature (1654)..(1654): n is a, c, g, or t
  misc_feature (1658)..(1658): n is a, c, g, or t
aaagcaggctggtactgccntggggtgcantggccggctccagctggggccggagaggctgagtggttggtacgctgctcgctggcctcccagtcttcccagcaaccggtgacactgcccgcgccagactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgtcaggaggtggaccccagagtgtgagtggcacgcttccctgtgaacccgtcctcaccatgtttgccacatctggggcagtggcagcggggaagccttactcgtgcagcgaatgtggcaagagcttctgctacagctcagtgctgctgcgacatgaacgagctcacggcggtgacggccgcttccgttgcctagaatgcggtgagcgctgtgcacgggctgctgacctccgagcgcacaggcgcacgcatgctggccagaccctctacatctgcagtgagtgcgcccgcaccttccggcagagcgcgctgctcttccaccaggcgcgggcgcaccccttggggacaacctctgaccctgctgccccaccccaccgctgcgcgcagtgcccgcgagccttccgaagcggcgccgggctgcggagtcacgcgcgcatccacgtgtcccggagccccacgcgaccccgtgtctcagacgcccaccagtgtggcgtgtgcggcaagtgctttggcaagagctctacgctgacgcgacacctgcagacgcactcgggggagaaacccttcaagtgcccggagtgcggcaagggcttcctggagagcgccacgctggtgcgccaccagcgcacacacacgggcgagaagccgtacgcatgtggcgactgtggacgctgcttcagcgagagttccacgctgctgcgccatcggcgcagccatcagggcgagcggccacatgcgtgcgccacttgcggcaagggtttcgggcagcgctccgacctggtggtgcaccagcgcatccacacgggcgagaagccttggtgcccgagtggggcgccgttcaggacgtcggactcacaagaccgggccgcccggggaaaacctcgtggatggngnaggnccgggtgccacacagtacggacaaggggcaagccaacgcgggagcgccggccaattgctcaactcggggacaggt

SEQ ID NO: 640607 - DNA, 577 bp, Homo sapiens
  misc_feature (34)..(34): n is a, c, g, or t
  misc_feature (61)..(61): n is a, c, g, or t
  misc_feature (69)..(69): n is a, c, g, or t
  misc_feature (179)..(179): n is a, c, g, or t
  misc_feature (193)..(194): n is a, c, g, or t
  misc_feature (212)..(212): n is a, c, g, or t
  misc_feature (214)..(214): n is a, c, g, or t
  misc_feature (239)..(239): n is a, c, g, or t
  misc_feature (249)..(249): n is a, c, g, or t
  misc_feature (255)..(255): n is a, c, g, or t
  misc_feature (276)..(276): n is a, c, g, or t
  misc_feature (283)..(283): n is a, c, g, or t
  misc_feature (287)..(287): n is a, c, g, or t
  misc_feature (293)..(293): n is a, c, g, or t
  misc_feature (305)..(305): n is a, c, g, or t
  misc_feature (315)..(315): n is a, c, g, or t
  misc_feature (320)..(320): n is a, c, g, or t
  misc_feature (327)..(327): n is a, c, g, or t
  misc_feature (349)..(349): n is a, c, g, or t
  misc_feature (351)..(351): n is a, c, g, or t
tctgtcataatataatagagacagtatatctacntgctctgtcataatataatagagacantagatctngctggtctgtcataatataatagagacagtagatctagctggtctgtcataatataatagagacagtagatctagctggtctgtcataatataatagagacattagatcnagctggtctgtcannatataatagagacagtananctagctggtctgtcataatataatngagacagtanatctanctggtctgtcataatataatngagacantagntctagntggtctgtcatnatataatagngacantagatcnagctggtctgtcataatataananagacagtagatctagctggtctgtcataatataatagagacagtatatctagatggcctgtagtgaaagagaggactattagagaggccatctggcctgtaggtgaaagagaggactattagagaggtcatctggtctgtaaggaaagagaggactattagagaaatcatctggtctgtagtgaaagagaggactataggtcatcctggtctggaatgaaagagag

SEQ ID NO: 640608 - DNA, 1342 bp, Homo sapiens
  misc_feature (20)..(20): n is a, c, g, or t
  misc_feature (30)..(30): n is a, c, g, or t
aaagcaggctggtactgccntggggtgcantggccggctccagctggggccggagaggctgagtggttggtacgctgctcgctggcctcccagtcttcccagcaaccggtgacactgcccgcgccagactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgtcaggaggtggaccccagagtgtgagtggcacgcttccctgtgaacccgtcctcaccatgtttgccacatctggggcagtggcagcggggaagccttactcgtgcagcgaatgtggcaagagcttctgctacagctcagtgctgctgcgacatgaacgagctcacggcggtgacggccgcttccgttgcctagaatgcggtgagcgctgtgcacgggctgctgacctccgagcgcacaggcgcacgcatgctggccagaccctctacatctgcagtgagtgcggacaaagcttccgccacagcggccgtcttgacctacacttgggcgcacaccggcagcgatgccgcacttgcccctgccgcacatgcggccggcgcttcccgcacctcccggcgctgctgctacaccggcgccgccagcatctgccagagcggccccgccgctgcccgctgtgcgcccgcaccttccggcagagcgcgctgctcttccaccaggcgcgggcgcaccccttggggacaacctctgaccctgctgcccgccaccgtggcgcgtgccggagcttcgagggggcgggtgga

SEQ ID NO: 640609 - DNA, 402 bp, Homo sapiens
  misc_feature (147)..(147): n is a, c, g, or t
  misc_feature (165)..(165): n is a, c, g, or t
  misc_feature (173)..(173): n is a, c, g, or t
  misc_feature (183)..(183): n is a, c, g, or t
  misc_feature (192)..(192): n is a, c, g, or t
  misc_feature (226)..(226): n is a, c, g, or t
  misc_feature (236)..(236): n is a, c, g, or t
ggcgactgcgacaggaagaggtccaggattcacacgagctgaccgagggacagagaggtgcccgtcacagggactggcctttctccaagtgacaaggacaaatggatccagcgggacacgcctgtggaacatttggaaaacatcctngggtggtcgtgggctaanatgatcanagtgaaacangaaagccanggaaggattctgtgctaattccacatttctacanatttctacancttgaaatttaagaacaccaaagcagtttgtattcctccagacagaacctacatatccaaccccatcacaccctcagaccacacttcccactcacgttccacctttctccacctccttggtgactccaagtactcacacagtcatcacctgtcgggctagtcgggg

SEQ ID NO: 640610 - DNA, 572 bp, Homo sapiens
ggcggggcgcggtggctcacgcctgtaatcccagctctcagggaggctaagaggcgggaggatagcttgagcccaggagttcgagacctgcctgggcaatataggcgagaccccgtttctccagaaaaggggaacaaaaaaaaaaccaaaaggaccaaaaaacaaaaaaaaaaaaaacaacaaaacaaccggtgtgtgggcgggcgactggggccccttggagaaaaaagcgtttgaagagagcacacatgggcgggaggggcgcgcgcgcgggggccccaaagtgaggataaagtggagaccacgtggggcgccaataaagcgcggggccccaaaagaggagagaagaacccggggggaaaaaaggaagaacaacagcgggcgcaggggggtttctccacaccaaatcaaaaaaagagcgcccacgggggcgggcaaccacggggagagcttctctggggacacaaaactcccagaagaggggagactcccagaggcggcaccacaggcggggagctcatatccccagggggggcgccaagggcggaccccaggaatctacccaaaaattg

SEQ ID NO: 640611 - DNA, 679 bp, Homo sapiens
  misc_feature (20)..(20): n is a, c, g, or t
  misc_feature (30)..(30): n is a, c, g, or t
  misc_feature (660)..(660): n is a, c, g, or t
aaagcaggctggtactgccntggggtgcantggccggctccagctggggccggagaggctgagtggttggtacgctgctcgctggcctcccagtcttcccagcaaccggtgacactgcccgcgccagactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgcccagnagataagcgctagtaaagt

SEQ ID NO: 640612 - DNA, 197 bp, Homo sapiens
  misc_feature (7)..(7): n is a, c, g, or t
  misc_feature (19)..(19): n is a, c, g, or t
  misc_feature (45)..(45): n is a, c, g, or t
  misc_feature (71)..(71): n is a, c, g, or t
cccacgntctttccatagnaataccgcagcatcataaagatatcncttctctcattaatgggtgcagcacncccaacatggcacacgtatacatatgtaacaaaccactgacgttgtgcacatgtaccctaaaacttaaagtataataataataaaattaaaaaaaaaagaagtagaattactggataatatggtat

SEQ ID NO: 640613 - DNA, 690 bp, Homo sapiens
  misc_feature (17)..(17): n is a, c, g, or t
  misc_feature (172)..(172): n is a, c, g, or t
aacaatacagtgaacanttttaatctcatatatgtatatacatatctcactgtacttcagaatatacttttgtttttcaaatgcacatggaacaaaattgatggtaaagctgggccataaaacaaagctaaaaatttttccaaaaaaattgaaaacgaggaatgtttctcantcaaagaaaatatgatagatatcaataacaaaagtacagctagaacggggcacagtggctcatgcctgtaatcccagcacttagggaggctgaggtgggcagatcacttgagctcagtagttcaagaccaactttggcaacatagctaaaccctctgtctacaaaaaatacaaaaatttgacaggtgcagtggcatgtgcctatagtcccagctactcaggaggctgaggtgggaggatcgcatgagcccaggagttcgaggttgcagtgagccgagatcgtgccattgcaccccagcctgggtgataggagtgaaaccttgtctcaaaaatgaaaaaaacaaaagctacagctagaaagtttctacatgtttgaaaattaattagtatatttctaaataatccacagattgaaaaagaataaagtgatgaaaatacagaatgtctacatttgtgagatatggctaaaactgtgcttagaggggaattttttagtccccaaaagcctatatttagaaa

SEQ ID NO: 640614 - DNA, 835 bp, Homo sapiens
ggactgtatatttgaggaaatgacaaacaaagaaacaaaattaaaatggaataggcgtgccgaacgctgcacagctgaccctctctctcacccagtaaatgcagaaagctcttaagtgacagacagcaaacacctgccatggtgtgcttgattccctccctcccagggctggcggaggctccagccatcgcctctctcctcaggcatacttgaacaccgatggcaacgaatgtagcaatgtcaacctctgcagcagatatcagttgggaatgggctgggggagggggcgcccagctgcctttcctccctcacaggagccaccaccagccacctctcacggagacagccagagtgcccctggcccaccgactcggacgtgacacacatagacgacacttcctccatacggaactgctcctttactacacttgccgctgtactactgtattactatacttctagtatactattgttcacctacgtgcatatacctgcacccgactactcgtatactataatctctcaccttatctaacatcttctagcccgggccaatattgagttaaacgcattgtaacgacgcttgcctacactttcccattgctcatcaataacacattgaggacctgctaagcacgcgaaacggtacacccttgtgctgcaatagtccatattatgcttaagaaccaatcacgccgtcgacatcatgtaacaagcataaaagagcagacttacggaccatacagacccatattacaacaggctcccccctgaaaaatccccacatacttgattttagcatggtgagcagtaaaacgcattattagctgtgcac

SEQ ID NO: 640615 - DNA, 324 bp, Homo sapiens
  misc_feature (7)..(7): n is a, c, g, or t
  misc_feature (16)..(16): n is a, c, g, or t
  misc_feature (34)..(34): n is a, c, g, or t
  misc_feature (195)..(195): n is a, c, g, or t
  misc_feature (319)..(319): n is a, c, g, or t
ccagaantgtacctcntcccagggcaggaacccngggagtcacctgactacttccctcaagaaccctgttcccaggccaggtgcggcagctcacccctgtaatcccagcactttgggagaccgaggcgggcggatcacctgaggtcaggaattcaagaccattctggacaacatggcaaaaccctgtctctactnaaaaatacaaaaattagccgggcatagtggggcacacctgtagtcccagctactcaggaggctgaggcaggagaatcatttgaatctgggaggcgagggttgcagtgaaccgagatcgtgccancctgg

SEQ ID NO: 640616 - DNA, 287 bp, Homo sapiens
  misc_feature (285)..(286): n is a, c, g, or t
acactataatctgtacagcattcacaatggcacatgtgaacaggcgcaccgtacttagacatgctcaatgctcagatccaatgtcactcatctcatgctcatgttcatcctggtaaataacttcactttaggtgtaaaacctcattagagtggaattgtgagcaaacttttgtactgtttatatttctcttcgtggtcaagtatgcatagttaaatgcaagtatgttgtgattgtatattatccttctattctgctttctgtatttctaatatctctcggaccannt

SEQ ID NO: 640617 - DNA, 897 bp, Homo sapiens
gggaggctgagagcagcggctcacccctgtaatcccagcactgtgggaggctgagagcaggggctcacccctgtaatcccagcactgtgggaggctgagagcagcggctcacccctgtaatccctagcactgtgggaggctgaggcaggtgggtcacccctgtaatcccagcactgtgggaggctgagagcagtggtcaccccttgtaatcccagacaactgtgggaggctgacgaggcagggagtcacccctgtaatcccaagaactgaagggaggctgagaggacgtgggatacacccctgtatgtccacagacactgatgggaggctgagagcggggagtcacacactgtaaatcacaaggcacgtgatgacaggctgagagcagacggagacaacacccatggggaaccaccagacacagggaaggcagggcatgcagaaacgcagggggatcaagccacagggggaaatcccaaagaagaagagaacgggaaggaaggaacgaaagacgaagggggtacgacccacaatggagaagatacgcaaggagaaaagagaggagaaagagccatgacgggagaacaggaggacaaaaaacacaaacacatgggataaacaccccatgaagagagagggcggagcgcggaagagccaggcgaagcagcgagcaagagacgggacaagacaaagccccacggtgggaggggagcaacgcccagggagagcgataggaagacagaccagggcgcggcgagaacagcaacggggacgagataacaaacgaccaacgaagggagaagagcacacaacaggcaaggagagggaaggggagagcagggcggggaagaaggacccgggggcgaagaggaaccaagagaagaagagaagcaagca

SEQ ID NO: 640618 - DNA, 465 bp, Homo sapiens
  misc_feature (14)..(14): n is a, c, g, or t
  misc_feature (45)..(45): n is a, c, g, or t
aataatggattccnctgaacccggatttaggggaaaaccccaccnggtaaaaccggacttttcttaagctttccaaagggattatttttggcatcttaatccccagagtcaccaggattcccacattaactgggaagataatacagaaaaactggaagatgcagagagcagtaacccaaatctacagtcccttctttcaacagatgcattaccgtcagcgtcaaagggatggtccacgtcagaaaactcactcaatgttatgttagaatcccacatggactgcatgtgaccacgtgccatcccattagtacagattaagctattaaaaacagaactatttccctgaagttccgtaagtacatagtcaacgtgaaatgtgaagaatttgtttaaaaacatcctgtagaaagtttataagaaaaaccagtatttgagcaaattgtggattataaatacaactatttt

SEQ ID NO: 640619 - DNA, 246 bp, Homo sapiens
aagcaccttggcgcgttaagtacggctatacatgcatgcaggcgattggccagtcaactgcgtactacatcactgccgtgccgtgggcagcgtggtgccagtaactgctactaccagtctagctcttaaccatattactctgtgatacctggaccagccagttcatcggatccttcattgggtatccgtgaaatcagagcatgttcctggtagaaagactttaacgttaggcttcctatgcaccta

SEQ ID NO: 640620 - DNA, 1343 bp, Homo sapiens
  misc_feature (76)..(76): n is a, c, g, or t
  misc_feature (117)..(117): n is a, c, g, or t
  misc_feature (127)..(127): n is a, c, g, or t
  misc_feature (129)..(129): n is a, c, g, or t
  misc_feature (139)..(140): n is a, c, g, or t
  misc_feature (154)..(154): n is a, c, g, or t
  misc_feature (201)..(201): n is a, c, g, or t
  misc_feature (241)..(241): n is a, c, g, or t
  misc_feature (271)..(272): n is a, c, g, or t
  misc_feature (279)..(279): n is a, c, g, or t
  misc_feature (281)..(281): n is a, c, g, or t
  misc_feature (295)..(295): n is a, c, g, or t
  misc_feature (299)..(299): n is a, c, g, or t
  misc_feature (303)..(303): n is a, c, g, or t
  misc_feature (305)..(305): n is a, c, g, or t
  misc_feature (309)..(309): n is a, c, g, or t
  misc_feature (335)..(335): n is a, c, g, or t
  misc_feature (349)..(349): n is a, c, g, or t
  misc_feature (355)..(355): n is a, c, g, or t
  misc_feature (357)..(357): n is a, c, g, or t
  misc_feature (359)..(360): n is a, c, g, or t
  misc_feature (369)..(369): n is a, c, g, or t
  misc_feature (387)..(387): n is a, c, g, or t
  misc_feature (395)..(396): n is a, c, g, or t
  misc_feature (405)..(406): n is a, c, g, or t
  misc_feature (539)..(539): n is a, c, g, or t
  misc_feature (754)..(755): n is a, c, g, or t
  misc_feature (759)..(759): n is a, c, g, or t
  misc_feature (770)..(771): n is a, c, g, or t
  misc_feature (776)..(777): n is a, c, g, or t
  misc_feature (791)..(791): n is a, c, g, or t
gtggggctttgtcagtccctcctgtagccgccgccgccgcgcctgccgcccctctgccagcagctccggcgccacntcgggccggcgtctccggcgggcgggagccaggcgctgagnggcgcggggngngcggccgagnngctcctgcggctgngactcaggctccggcgtctgcgcttccccatggggctggcctgcggngcctgggcgctctgagattgtcactgctgttccaagggcncacgcagagggatttggaattcctggaganntgccttntntgagaagctggaanatanttcntntcanttccatctcttagttttccataggancatcaagaaatcangaacancntnnggtaatganagagttatgactgccacnttcctcgnntgaaggttnnactgccaaggacattctggaccagaaaattaatgaagttcttcttctgatgataaggatgccttctatgtggcagacctgggagacattctaaagaaacatctgaggtggttaaaagctctccctcgtgtcanccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatnngtgnaagtgagttgnntgaanngttgcagagcaatnccaaagcaacagttggttttgcggcattgcccactgcatgattccaaagccagtctgtcgtctccagtgtgcaacattccggtgccacgctccagaaccagcaggctcctttaggaaacgggcgcaacagcagctcaactcatcgatgtggttggatgtcagcttccatgataggacgcggctgtaccgatcctgagaccttcgtgcaggcaatctctgaatgcccgactgtgttttctagacatgggggctgaggtaggaatacagacatgtctctgcttgatatcggacgacgcgcattcccctggactctgcaggaatgttgaaaactacaacatctggcacaagactacacccgggatccaccacacccaagcgtagaacaaaatcaacaagacgaaacgaacatgcgcgtgcagcaacaaaagaaggagccccgggcgataccacgattgacaaacgcataaccacgacaacacacacaaaggccagacaaggaataacagaaaagaggacccgaaaacacacaatccaaccaaaacaaccactaaa

SEQ ID NO: 640621 - DNA, 289 bp, Homo sapiens
  misc_feature (5)..(5): n is a, c, g, or t
  misc_feature (26)..(26): n is a, c, g, or t
ccccnttttttccccccacaaaaggntttataagggaggaagaatttttaatgttccccccccccccgggggaaaacgcgcttttttgggggaaaaaaggcgccccccttttttccttttaaaaaaagcccggggcaaaaacccaatttttttccaaccgggggtttttttggggaggggggccgggaaaccccccccattttttttttttttttaaaaaaccgccccccccaagcccgggggggggggttttttttttgttttaaaaacccccctttggcgggtttta

SEQ ID NO: 640622 - DNA, 198 bp, Homo sapiens
gcgccgccctccgctctgtgttcaccccgcctgcatcaagcgctcccggttccctagtcgttggtgggtggcgctcgcgtgggccgagcgttgcgtgacgctctctctgaagcggcttaccttagccttgaggggacgcgagctgccacgcggcagtcagacgaggcagcgagatgtcttgcgtgttcggatccttcc

SEQ ID NO: 640623 - DNA, 427 bp, Homo sapiens
  misc_feature (20)..(20): n is a, c, g, or t
  misc_feature (121)..(122): n is a, c, g, or t
  misc_feature (354)..(354): n is a, c, g, or t
  misc_feature (369)..(369): n is a, c, g, or t
  misc_feature (380)..(380): n is a, c, g, or t
  misc_feature (416)..(416): n is a, c, g, or t
ttgccactgacagccgcggngcatcccatctgagtaagagccagcccgtccgcggcctctccagccccgggttcgcgctctcgactctcctgcctgcccagctgcgcgacaggacggaacnngagcgggcacatgcgacgtccccggcagcccccgaccactccctcggcgctgcgtgtaggccgcgccgtcaggcccagtccgcggtgccccggcgggtgaatgccaaatacagccatgaaagaaaaaaggtgcttgctgatgggggaaagaagcgggtcggggaagaaccaagcaatgaaggtcgataatcttcgccaaattaccatttgctcgcgaacaccccggcggccntggggggccaaccanttgaacgttgnaacacttcccacgttccgattccttagggaaacctnggttgcttgaa

SEQ ID NO: 640624 - DNA, 290 bp, Homo sapiens
tgccttatatgctgtctcatttagatcgaggctgtagatgggaggtaccacagctggaagtctaagtcacaccaggtggtcagagacactggtggcagatctgtgcttgcaactgcatacccagtgtgtctgttttgttcccaatgtgtctcccacaataataccccagtgaggttctccgcattaaattgtcctcagacatgacaagcctggacagcaaatcactccgtatccacttccatgagatgtcttgatgctccaggtcaattagtaccactttctcaagaggc

SEQ ID NO: 640625 - DNA, 1052 bp, Homo sapiens
taaggaactccaatccctgacctgcctgaacgtgaaacgtgtgaacggacgacgcagacagcacattagctcggttatgtatcaaagaacaacttgggaacacggcattccaaccactgtgacctccagagattgagagacgtcaaaccgcaatcaacgagaacttctagctcggcgttatacaaacgaacaacatgggcaagggacctcctttagctgtcactcccgagatggagcgacgtcgaacacacatcacagaaaactattagctcggttatagtacaaagaaaatgtggggaaagccaccgcaacccctgtcactcctgagatgcagagagtccaacgcaatcaagacacacattagctcggtatcgtaccaaagagaacatgagcaccagcaactccgacacctgttactccagagatggcgagagctaagcgcacccaagaacacattagctcggtcttaattctgatagtctccggaaaacaaaatacaaggcaaaagctgcctaatgtcatggaataccccccgacaattgccacgggtgacgggagacccaacggcccaatctccaacggtgccactctcctgcagactttgacgacccacaagggctgcttcacaaccatgtgtgcacagcatccgtaatcaatggaacgacagctccagccacgacattgccaagaactttcaatgacccttcaactcacccgacagcatcacagaggaaagctgcgacaacatggatcaacacaacggcacggacccacactctgcgccaaattcccgctcacgacgtatgagacaccaaatcacgacacacggcatgagcacagtacgtccaagcacacgacacatttagtcaccagagctcacaagtccacaggccacgacatctgcccactcccgtaacgacccgcacctgacgcggaaaatgactacacgatgagccgcacaacacgcactaaagaacacaactaaaacatcccagacacacacaagctgtctacaataccagacccagcctacctactatacaactactacc

SEQ ID NO: 640626 - DNA, 356 bp, Homo sapiens
  misc_feature (68)..(68): n is a, c, g, or t
  misc_feature (71)..(71): n is a, c, g, or t
  misc_feature (310)..(310): n is a, c, g, or t
  misc_feature (347)..(347): n is a, c, g, or t
gaattccccccctagctgtacctagacattgaaagatggcctaggaccgtgtgcatgcaaaagtggtnaantgcattgccttacagggagacaggcagagacaccttaaaaaaaaaaaaaaaaaaaagcaaagtcagccgggtgcggtaggctctcccctgtaatcccagcactttgggaggtggaggcgggcggatcccttgtgcccaggagttcgaggccatcctgcttaacatagtgaaaccccgtttctactaaaaatacaaaaattagccgggcatggtggtgtatgcctgttgttccagctacncgcgaggctgagatacgaggattgctcgagccccggnaagttgagg

SEQ ID NO: 640627 - DNA, 428 bp, Homo sapiens
  misc_feature (16)..(16): n is a, c, g, or t
  misc_feature (64)..(64): n is a, c, g, or t
  misc_feature (97)..(97): n is a, c, g, or t
gaaggttgtattgttntggcatttgtaaaaatgggttacttgtttaaacaatcttttatgtctngtcatacaaattccaaagggtctgcattccttnatctgtaattacagtctcagaatccaagttctgaaaacaaggtatctattctgatctgacactggatctgcttatcccatttagtgtgaatattcattgatttatgtgtttgattattgggatgtgctccacaggctctcttgaaggttgatgtagtgtggcgtatgcactgaattacctttctaaaatctgaacagttctcattctgaaacatctagacttaagggtttcagataaaagactgcggttctctgccttatgttaaataacttagaagatgttattttgtttgaaaaaatgtgaaatgcttttatattctagtttttcactt

SEQ ID NO: 640628 - DNA, 187 bp, Homo sapiens
  misc_feature (17)..(17): n is a, c, g, or t
gcacgggaagcaggtgnacctcagtcacatccatggtggctatgtgtatccacagggcgtgatggagcctactaccagctgtttgtacgagacggccagctccatgccagtcctagaggcagaagtcctgtcgcaggcatgaacttggctagcgtgggctcctgtatatgtgcccgagtgtgagcat

SEQ ID NO: 640629 - DNA, 770 bp, Homo sapiens
  misc_feature (431)..(431): n is a, c, g, or t
  misc_feature (736)..(736): n is a, c, g, or t
agcgggggtacggtggcgactcccacggcggatggctgggtcgagagcacatctttattttctctctagatcattcttcttcctattttgatttgagaaagggaacgtgagaattaggtcaaccagagtgttttcccaggtagttgaaaggctcagggtgctcgcccacatcagtgagggaggtgcagctgatgaaggaagtgctgggtgcagaaggggatgctctgaaataggtggcttctagtttagcagtttcaacagctacaggcctagagtaaaattccagctagacaaatctcacctgcttatatctccctatgagtaatataactcatagacgatagcgtaaagcacgagaaagtacgcttacagatagacacgttcgacagcgctattcactaattaccgcaaagggtatcttagctagccgngcggcacgtaagcaatagctagaggagcacagctatgggaaccagtaacaaccctagactacgtgcatagaacgtcacaggcacaccataggactgtaggctgagcagatcgaagtgctgatgcgacaacctacagacgaataggatgctgcagatctacgacagtgagacgctagcacgagccgcagtcggctatccgtacatagggcaaacgcatgtattcgcactatgcggacatccacgttagtcaccagctacaatgaaaagcagctaggactaatatctcgcggaacagctccttgagnagcgtgccaagccatagaaaagccagtgcgacga

SEQ ID NO: 640630 - DNA, 362 bp, Homo sapiens
cccaatatgacactttaggctcaccagcatataatctttaatatctttacttctatgatcccatatcaaagaactctattctattatgagtaatcaattgcctgcaaatagatctttctttgtaacaatctggtctgcacaaggctgactctcacttttcctttcttttgcttacttctgtctttgcttctattctggctggagaaatcacttagactctgtgtgcctcttctaaattgcattctgctctgctatggtacctgctaggctggcttctttggactccctatatgaatgatgatgtgcctattacttgcagcatatgattacctctttgatggtctcattagcctgccttcttg

SEQ ID NO: 640631 - DNA, 287 bp, Homo sapiens
aagaattgactactgtggaaaatgaagactgataaatcgaatagccgggaaggggaagggcctgtggttggactttacgattaattgctgtaacactgtccttcgggcggctgagggagtttcatatattctttacacatcattaggcgccgaagctcttgcaggacaactttgatgctatatgaattctgccattttgctagcactgatatggctcttgggtccaccactccattagaactatttactccattcatattaatttttgttacaaatcttacaaaggg

SEQ ID NO: 640632 - DNA, 209 bp, Homo sapiens
aagggacccggggtccaaaaatacccctttttattcccccacccccgcggtggggaaaaaaaaacccccgggcttggggggggggggttgggccaaattttttccccttaggggtaaaaggggttaatttgtttaaaattttccccaatttattttcccccttggcccctttttgaaaccaaaaaaatccttggggtttgggcccctta

SEQ ID NO: 640633 - DNA, 741 bp, Homo sapiens
tcaggtgatccacccccttcggcctcccaaaatgctgggattacaggcgtgagccaccgcgcctggccagctttagcataactcttaaaggtcctagaattttcagaatggcaaatgagcactgacttcaacttaaagccaccagctgcattagctcctaataagagagccagcctgttctttaaagtttgaagccaggcactgacttctcctctctagctatgagggtcctacatggcctcttcatccaagagaaagctgttgttttatctacattgaaaatctgtgtttagcgcagccgccttcgtcagtgatcttagccagatcttctggataacttgctgcagcttctacatcagcacttgctggcttcaccttgcacttttatgttatagagctggcttctttccttcaatctgatgaaccagcctctgttagcttccaagttttcttctatagataacctcacctctctcagcctccacagaattgaagagttatggccttggtctgggattaggcttttggctaaagggaatgttgtggctggttgatcttctatccagatactcaaactttccccgtatcagcaataaggatgtttgctttcttatcattgtatgttccctgggagtgaccactttcaacatccttcaacagttttccccggcatacaacaatgattactggacaagaggatactttggcgaaccaatttgaaaagcttctcacaaagtaacg

SEQ ID NO: 640634 - DNA, 115 bp, Homo sapiens
tccggggatctgttcctcgcactatcgaccgcgaacgccgaagccgtgagccaacacgagggtatggtgagcgccagcttcgtcggcgaagcggcgatgagccgcttctacgagg

SEQ ID NO: 640635 - DNA, 162 bp, Homo sapiens
ctcgggttagcgatgccatgtatgcaagtcttggcaacgggtatttcgaacgtgtgagactcacgtttcacaaaataggtcatggtcaccgtgctgcggaggaaactggtctacatttgagcctacctcgtacgtgcctgggttgttcaggcatgcctaaaa

SEQ ID NO: 640636 - DNA, 195 bp, Homo sapiens
  misc_feature (177)..(177): n is a, c, g, or t
ggtataacccgtatatcctaacagcatttgtctccgtggtattggttaaagcattttaattgggatgaggtgataccacattgtagtttgattttcatttctctgatggtctatgatgttgagcaccttttcatatgcatgtttgtcatttgtatgctcttcttttgacggaatgtnctactcagatctttagcc

SEQ ID NO: 640637 - DNA, 770 bp, Homo sapiens
gggaagggcaggctcgtgtggcggctccgctgtcaagagttgcgccctctctgtgccttgcgccgggacacggcatctgcgcgctgggcgggttctggagcggggtccgcacggagcgagcccggggcctccaggccgaggaggctgcgatgccttaaaggcaggcagatacaagggctcgtgggtgctgcggcggtggaggggagctctccacagagccgcagaggccactggagtttcctgctcccgggtgccgcactgcccactgccctcgcggtcgcgtgaggggagcacgtgggggacgccgcgccccgagggccgtgggctggagtggcagggtgaggggatgctggagtgggctgaggcctcccccgcagctgcgcgccctgccctgttgtggagactggcgctggctctgcgccggtcgccttgtgttgcctcggccccgtgagtgcgcgagctccgtggagaccaggacagcgcccagacctccctcggcgggtgggccccgacctccgggctccagggccggtattccaaccacaggtcagcgcgctggggctgaaacatacttctgttaatgcttttcctaaatttatgacttgatttttacttgggtgggaaaagaaacttaaaatgaattaccatgtggttgcgcctgtataaaaacaaacgggctgtatttttgcagcatattattttacttaatttattattctgagaccgagtctcgctctgtctcccggggctggagtgcagtggcgcgatca

SEQ ID NO: 640638 - DNA, 145 bp, Homo sapiens
cacgaggggaaacctaactttcctgcttaaagagtggatacgagaaatcagtgaaagcacgaatcttccacatcctgtgaatggaaatgttgtcagaaaaatttttacacttggatcttacagatcacgagtgcatacacttggt

SEQ ID NO: 640639 - DNA, 509 bp, Homo sapiens
  misc_feature (124)..(124): n is a, c, g, or t
  misc_feature (165)..(166): n is a, c, g, or t
gctgtgatcttcaagtatggggtctgctggcttgtcgcggctgcatgggcttttcgcggtctataagcccccgtgggctaacaattggaatggcacctgctggtgatacatgtgtgagctacanacttctgacagggtctcaatgccaggaagcctccctgctcnnctaaaacagctgtgtttcgctttccgtatggcatggtggtgtctcacccaaagtgggggaaaggggcatgccgacacgacgacagggacgcgtagacccgtcgacaagcgcacccaagcgggtaccccagtcgtttgtccgaattccgaaaacccaagattcgccagaaccgtttcggggggtgtttaagtttggagcttgggggggaaaaagccgcccgaaaggggcccgaaagtttttccccggttcggcgccgaaagattcctgttccgagaaggggggttcctggcggccggattggggaggaacccaagttccagacgtactctgggggaattgacgc

SEQ ID NO: 640640 - DNA, 339 bp, Homo sapiens
ttctgtgtttgcctgggtgtgcgtgattgcctgaggtctcggagttcgaccgcagtctggtctacatggtgaacccccatctctcctaggactcccatatacttagccggacatgttggtctgcgcctgtaagtcccagctatttgggaggttacggaagaggaactgcttgaaccagggaggtagatggttgcaatgagtggagatcacaccagtgcactccagtctggacgacagagcgaagactccgtctcaaaaaaaagaaaatcagatatatagagtattataatggggtaactggaaattattttatcctccccaccatccctgggtttgctt

SEQ ID NO: 640641 - DNA, 466 bp, Homo sapiens
agagaaccctgactaatacagttgcctttgagttcgtcaaacagagatttttcccagtgagcctggccccatcacgcaagccctttccaggcgcagtttttactgacttgtggccaaagggccattcagagggctgtgaagcatgagaagccctgtcatcgctagcttcggagatggaggggccttgaagtgaggaatgtaggagctctttgagctgagagtggcccctggctgacagctgaccaggaaatgggcacctcagtcctacagccacagggaactgaattctaccaacagcccaaatgagcttggaagaggatcccttccaaagcctccagataagatccagccctgggatgccttgattgcagccttgggagaccctgagcagtgcaggcatccacgccaggctggagttcttaagtacagaactgtgagctaataaatagatgtggttgtaagccga

SEQ ID NO: 640642 - DNA, 383 bp, Homo sapiens
aaaccaggaatattagccctactgccaacggagctacagactgcattcactagcagagctcacttggccactcatgatgaactaattgccaagtcataccaaggaagtcaaggacgagcatacctctttaactcagtagttaatgtgggctgtgggcctgcagaagagcgagtgtagctaacaggactgcatgcagtcgcagccatttactgtgaaaactgccaaaccactctgggctggaaatccgaacatgcttttgaacgcagccagaaatcatcaagaaggcacctacatcattgaactcagcacacatgatccaggacaatggctgggactgattggccagcatctacccaacccagtgtccacgtgcactcctgaaa

SEQ ID NO: 640643 - DNA, 476 bp, Homo sapiens
  misc_feature (250)..(250): n is a, c, g, or t
  misc_feature (284)..(284): n is a, c, g, or t
tccagcacccgttcaaagggagtacagcagcaccccccaccccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagtttttccaaatttgaccgcaccctgccccacccccgccatgtcccaataggngtcctcccgactcctctcccggagcctcctcagntactccatccttgcccccctgggggcccagcccccccgcatgcccaaagcaggggctaggtgtctcctgggaggcatgaagggggcaaggtccgtcctctgtgggccccaccctatttgtaaccaaaaagctgggaccagcccaaggcccccccctttgttctgcccttaataaatggttttgctcctccta

SEQ ID NO: 640644 - DNA, 364 bp, Homo sapiens
tctagagcggccgcctactactactaaattcgcggccgcgtcgacatttttcaaggtctgtttttctaactgaaaagctaagggcttgattcctagccccgttctgtggggcactgggtgatactcagtttcttgttcctggccgtggagaggggcctggggcactggttccggctgtgtctggtggcccggctgcagggaaggggcatgaaggcggtcaggccttcactgcatcactgagcctcaaatccgctctggaacatgaggctggattcatgtggtggtgatgccccccctgctctattcccttggtagccagtcctttgcgcttccaccttcacctttcttgatgatgacttttctt

SEQ ID NO: 640645 - DNA, 152 bp, Homo sapiens
cagcgagtgtgcggggtgactagaggacccggcttcatttttgtaagtaataaattacggtaaaggtgaagtgcagtagagtcccatatggcccagtttcccctattaacatcttacattagtatggaacatgctacagataacatgaaata

SEQ ID NO: 640646 - DNA, 123 bp, Homo sapiens
gagctcggtaccgacgctctctctgtggggcaggctgaagggcaggtagtgagtgtatctggggctcccgtggtgaagaacctgtcctggaagagctcgtctatgatgctggactgcgcggct

SEQ ID NO: 640647 - DNA, 604 bp, Homo sapiens
aggctgggtaaagtcaaatgataatggcatctaagttaacaagagcttctgcacagcaaaagaaactaccatcagagtgaacaggcaacctacagaataggagaaaatttttgcaatctactcatctgacaaagggctaatatccagaatctacaatgaactcaaacaaatttacaagaaaaaaacagccccatcaaaaagtgggcgaaggatatgaattgacacttctcaaaagaagacatttatgcagccaacagacacatgaaaaaatgctcatcatcactggccatcagagaaatgcaaatcaaaaccacaatgagataccatcttacaccagttagaatggcgatcattaaaaagtcaggaaacaacaggtgctggagagatgtggagaaataggaacagttttacactgttggtgggactgtaaactagttcaaccattgtggaagacagtatggcaattcctcaaggatctagaactaaaaataccatttgacccagccatcccattactgggtatatacccaaaggattataaatcatgctgctataaagacacatgcacacgtatgtgcatatgtgcacatacatatagtgcata

SEQ ID NO: 640648 - DNA, 267 bp, Homo sapiens
ttttatttgaatgcagtgtcattgcaccaacagcagtcagggtatccagtgactctgttgcagtaatcgaagcccataaaccacagagaaaattacaaccttgtggattgtggaacagatcaatagctctagttcactggtgtgaattaatcgatggcctgctagttatgtagactagaaatagataagaagggttatctactgcaatttccgtattgacgtatgggaggtagtgatttgagccatactgtaacagccatttaggta

SEQ ID NO: 640649 - DNA, 101 bp, Homo sapiens
tctagctcggtcccctccgatagatgctagtttgttagggtctgtcaggtgcacttgaaatttgactatttcatcggctggcttgaagaaggtggatttag

SEQ ID NO: 640650 - DNA, 607 bp, Homo sapiens
tcacttgcagatggggcggcagctgtgcagaggcactcctcacatcccagacagtgggcagctgggcagaggcgctccacacttcccagatggttgggcagtcgggcagaggcgctcctcacatcccagatgtgggtggcagctgggcagaggtgctcctcacttcccagatggggcagcagccgggcagaggcactcctcatgcaaggacactttaaaaaagattgtcctatgagaaacaatgctgccccctcgcccatgtccactatgccgaggcaatcactggacagcacactgccccagaggacaaaggttctctgggccagaagcccccaaccagatgatccaacaacaggactgagggtgcctggggcaagcaccagctcattgatggccaggaaattgacttcctcctggacactggcatggctttctcattgttatctcctgtcctggacagctgtcctcaaggtctgttaccatctgaggaatcctggaacagcctgtaatcaggtatttcttccaactcctcagttgtcactgggagacttcgctacagatagtaagtatgcttatctaatcccacattgccatactgcaatatggc

SEQ ID NO: 640651 - DNA, 322 bp, Homo sapiens
acggtcactccaggaaaatgtatgaggcatagcaaaagtccttttccagatcagaaagttactaatttgcaggataagatggtgcaaatgccttattaaaacccatttacaaagtttatggtcatacaaacaactttatacacccgtatcatgtggttatccaaccaaatatgaaaaaacttttacagtacaaaaaagaaaacacagggaaacagaaacaggggtgatacgctacccagaaaacaaagcatacatgttaacgcttggataaaatgactcattcggaattagttaacccaagaaaaaagaaattataaatgca

SEQ ID NO: 640652 - DNA, 645 bp, Homo sapiens
  misc_feature (136)..(136): n is a, c, g, or t
agaactatgataagatcagatcaaggatggcgtgggctgaagatgtctgttgaaagagtatataacagatcccataagggaaagtgctggatgagtagcatgttagctgcatcgttgtgatgcataagaagccaantaagcattcggacacggggtgggaagatggaagcagctgcttgaatgtggtcactatactgcgcagtgcgtgtgagctcagaagtagagaatcagtatgaacatggatgttgggggcgaaagatatggcatttccaaagtgcacagaacacggattggtaggaaattgtggacagtgggagaagaaaaggtaaaattgagattcctgaaaaccgattatgaaacacgaccaacagtcgacgcgaggttccccaagaaacccgtttaggcagccaaggagaaacaggacacttgccagaaggcatttcgtttgcaaagcgagcacgggaactggaagaaccaaacaagcgccccaaaattcaaaagaagacaacaaacaaacacaccgaaacaaaaaaaacaacaaggtggtgtggggccggcacttcgcgccccggcggagaaaaagctttcagagaaacccaattagggtggggaaggagggggcccaccgtgacggttagcgggcac

SEQ ID NO: 640653 - DNA, 215 bp, Homo sapiens
ggggaaagcggtacatcgggggacacgcggataacgagcgagttcggctggagtgcgcgaaaacgaaacaacagagcaggcagtcgagggacaacagaacggggtttccacgagcccgctaccgcgcccggaccaccaactacaacagcacccgctctcgattctacagtggttttaacagcaggccccggggctcgcgccggtcgccgtacgca

SEQ ID NO: 640654 - DNA, 140 bp, Homo sapiens
ggcgctacaagttgtgcaaagtgagaaagatctttgtgggacaaaaggatccctcatctggtgactcatgatgccgcacatccgctacccgatcctcatcagtgatgatacatcagatgattgagactgcagatactgat

SEQ ID NO: 640655 - DNA, 777 bp, Homo sapiens
tcagaagtcagacctgtcctcagaatgctacaaggtacagcccatttgagctcctgtatagacgttcctttttattggtcccagtctcattccagacaccagaccaacttagactgtgccccaaaaaacttgtcatccctactatcttctgtctagtcatactcctattcaccattctcaactactcatgcattccctgctcttgtttacactgctggtttacactatttctccaagccatcacagctgatatctcctggtgctatccccaaactgccactcttaactcttgaagtaaataaataatctttgctggcaaggctatgctgaatctccttaggtactctaattagatgtcctaggtcctcccaattcttagacctttaatacctgtttttctccttctcttattccgtttagtttttcaattcatacaaaaccgtatccaggccatcaccaataattctaaatgacaaatgtttcttctaatagtcccacagtatcaccccttaccacaaaatcttccttcagcttaatctctcccactctaggttcccacgccgccctaaatcccgtcgaagcagcctgagaaaaatcacccattattcttccgagcaacccaaaaatttcacgtcccaacactttaccactatttcatttattttcttattaatataagaagacagaatggtaggcccctgaggcgagttaggcaataatccactggactggggtcaccatccaggggcggtctgcctaagtggtccccaagatgga

SEQ ID NO: 640656 - DNA, 878 bp, Homo sapiens
  misc_feature (274)..(274): n is a, c, g, or t
gggcccagggggggggcgctctccccccctcttcaataccacggccatggtcttttctccgggaggccccctccccccccgccaattttttgtgggaattttggtgggccgggggcccaagcccctcacaacccgggggcccctggggccccggggccgggggggctggtgggcctgaggggcccggggatccgggccccggtgggcccgggtttgtgggggcccccgggtgaccatctcctcaccccaaggttaaccttcctttcctggaaanaggctttcacaaggttttatataggcaagtggatgggtttggagtaattatgtttcattaggaattatgtcctgggaaatgacagtgctgcatataaataaatgaataataatgctgaattgcctgaatatctgccatatagcagttccctttaaattaattgaaaaaaaatttaatgtaaaagtgaaatatctggagtgacaaggcactgcacagtgtgattttcatcaaattgctttattcctctttcttctgaagcatttgtcagttcaagttgatctaagggcattactgaatttgaattcaaatgtactccaagtcccaaggtttaaaaatgaattcctggggttctgaactcatgatatgcttttgtatctgaagatgatcatccaaaacatattgagtagcactacgacaggatttttcatttgatgtcaaagcaacttcacattgatagtgtttgatatagtcactaaaatccaaataaagctattgtctctaggaagaagaaattgtttctttagctaaatatggccatactttggtgcatctgacactgacaatgaatatggatataactttatcctaaaagggtttatatata

SEQ ID NO: 640657 - DNA, 980 bp, Homo sapiens
tctcagtgttccatctgctattctactactcctcagggattattcaggccccctcccttccctacacatcaagctcgaggatttgcccccacccaggactggcaaattagctttactcaacatgcccgagtcaggaaactaaaatacctcttagtctaaatagacactttacaactgaataagtaaagacctttcctacagggtctgagaaggccacgcagtcatttcttcccatctgtcagacataattcctcagtttagccttcccacctctatacagtctgataacagaccagcctttatgagtcaaatcagccaagcagtatttcaggctcttagtattcagttgaaccctttatatcccttacagtcctccatcttcaagaacacgtagaacggactaaaggtcttcgacaaacacacctcagcaaagctcaagcaccaacttacacaaggacctggacaattgcttttatcactttcgcttctcagcaatacaggcctgtcctcagcaatgtacacaaggttacagtccatttaagctacctgtataagacgctccatttctcattaggccccagtctcattcggagaccaagaccaacgttacgactgtgcgcccaaaatctggtatccctaacgatctttgctgactagtcatacccctaatcaccatgctcagctactcatacaaccctggctctggttacactgccggtacacacggtactccagccatccaagtgatgctcctgggaggcatatcgcccaaaggccaacataaggctcttacgctaatacgtcactttgcggccgacatcatgtgaaatccataggacatataataagaggtctatggccccaagtataaactatacgtatcccctctatcatatagatcgtacaaggcacgaccacatcctgcgggtctatacaatcaactcacgacttatgttccttttccccatcagaaatacatc

SEQ ID NO: 640658 - DNA, 408 bp, Homo sapiens
tccaaggttgtgtttttggaaaacctggcttcccaggtgggcctacgccctcaggaccccattaattgcatcccggacctgttgggttaggggactataaccggggtgttttccgcccgggggaggtttttttttcttaaccccaaagggagtggcccccgtggccaattttatccgacaggggggccgggtgtccattgccgaggttgcccaagccagcaattccctttttgcctgggggcgggggtcccctgcccaagccccagcctgaccccagtccttcccttttgggttcagggttgggggggccccccggggtaaacatttttttccctccccccccttttggggaagggatgggggggccaggcaggttttaatatttaaaggcctgtggaggtttgttga

SEQ ID NO: 640659 - DNA, 245 bp, Homo sapiens
ggtgcccgtcctgcttcaggcgcttccaatgccagtggagggagacacgacctgagtgctacagtgagaggctcgtgcatgcggcgtcatatgctcactcaggtggagagacacgcagcgtgcagacttgggcaggtgcatgaggaatttaagcagaacatcgagaacgtcagtcgtggagatagctactcaggaagtttgcagagagtaagggcacaggccgggagaagcctggacctctggac

SEQ ID NO: 640660 - DNA, 231 bp, Homo sapiens
gatccccttattttgcaatctacgcaatcatttcatagctcaattttaaagatcatatacaaatctcctataatgtgttaaaatgtacactatattattacgctaacgggtatatatcagaagattatcaggtcagttctggaccaaaataattgcattaaaatacaataggtgatagggaagaatttatcagatttgcagtgactgcttttggtgctcagctacaacaag

SEQ ID NO: 640661 - DNA, 484 bp, Homo sapiens
  misc_feature (219)..(219): n is a, c, g, or t
  misc_feature (468)..(468): n is a, c, g, or t
tggcatcaaaaagctttatttccatttggtccaaggcttgtttaggatagttaaaaaagctgcctatggggtggagggagaggtgttagggaaaagccctattatttgtgcacaggggcccttacaaaagtcgctgggctcagaaaggcgtcttaagttcgcgcttgagagtgagcccttatcagaagagatactcgcgccgaggcctcatgcctcggnggctcacccagccgggtgtggaggttgggtctggggtgtcacccatcttcgttgataagcttcgactatcctcatctaggaagtgattctccaggaagtcacagagcatgggggtccgtgggggtggaaccccagggctatgcaagcatccaaaagggcgctgggtagcaagctatttcctccgaggggcgcgcagggcgagcgttatcaagggcggtcgaggggttttcaaccccacatcatctttcnagactgggcttgcttg

SEQ ID NO: 640662 - DNA, 924 bp, Homo sapiens
attctgagccgagcccggtgccaatgcgcagtagctcagaggcggcagggggcctgagtttcagggcagccagtccctccggggttcgcttccctcgggtcagataaaagcttaagtcccgtgaggtccgtgaggaaaaaacagccgtgtcgggaccacagtctgggacatctcccggagcaaaaaccctgtgtggacgacccggatgagccgtgttatacaacagtgaacgagtgcttactccagggctcaaggaagcttgggtggcccagaatcccccaagaacaaagaaagggtgacggccaacgtattgggaattcctgcaaggcaggtgttcatcgactactattttgaccttgcagaatcggcccgtggagctcggtatttcgccaattattgggtcagggctggatttagcccagaaaagacccggggggcaagaaaaccgaggggcgtaccaagaggaccgccggtaggaacccaaccccacaaacacgggattatcacgcaacttccggtggtcccatgggcaagggtttcatgaaattcaccccttttctgaggttaagtggtcaacatttgaacaggccaaacgcactggtggtggctgaacataacgcccggtgttccagtagatttccattataatcgtgtggcacaaacaaaacaacacaccaaccagaatttcagcggactcctttacagagctgcatgagcactatatttttacaaacccagtatcccccaggggagcaccacgtagaagtggcccctttttaccaagggataacacacatggggggacacactaaaaaagtgacttccccagggggtcctctaacctgggacgggaattcggattatgaacaactttaagagcccaatgacggagagcggtttaataatcccccggggaggcaactt

SEQ ID NO: 640663 - DNA, 1746 bp, Homo sapiens
ccgtcgcttcctcgcggctcttcgtcttgtctcttgatgatgctactgatagataggtgtgattaagaacatatcgaacatagatggtggttaactacccaatgtatggtgagcgacgttacgtgatatgataactaaccaccgtgcttttctcttgtgggtaggcagccgacatgaattatcaattcagcatggaaggttgtgggtttgaacttacaagctacgcgcctagttagtctgccgtagtttatggctagcaaatagtacacacacccggtggttttgactccccgggatttgttcattagcggacgatcatcgggcggttaatattattgattaagagacagagggggtacttaagagtgtcgcgcgtcatttgttgttgtaagaccaactgctgtgtggcagttctacaccaagacgcggggggtttacaacagggggttatagcaacttattatgttgggccgagtcaagaactcaacgtatttcagcattgtgggggtgatagaatccacagcatagcatacaataccgtcggggcaccgaccactgagaaacaatggggggtgaactatatatactccagtggagtatagtgaggttttgtatccacactgtcctccccactgaagggggggtaattctttattacaaccctgtgttgtttacagggccgtaaatttataagaggtgggcacgcggcttgtagagagaagattgtggcttgtgagcccatctggcgccgaccgaggaagtaataagaacgctgggttggttgcccacacatttgttggtgaaagtgctttacaccccacaccgttggtgaacatgtttctgtgcgtgagtcaccgcaatattgtgcgatggaaagacttggggggggaaattatatatgatctacaacagcggttggtgggaatcacctttttgatagaggtgtgcgcacacccctgtcgtctcgtgatattccacatcgggggatgcccccaccacacacatatttggtgttggcgccacagcttgagggcgacatttatcagagatggttttcggtccccagctcggggggggtggccacaaaaaagagattcctctcgtcacagcgagacttgacacagatattctcccttctctactgggagttatatacacattgggcacacatacacgtcggggatatatggagatgagaaccctttcttgtagtggagaagaacacacacagtgtggagccacgcgtggtaccccgcgtgtcccccgggggaaatatatacacgcgcgcttgttctgtggtgtgtacacagacccacattcccacgcggttggctcgaggggtttgtaacaacacacggtctaaataatgggggaaaccttggggataccccctcgaagagggaggagccacttccaaagggagattccacgcacgagttcttgggacacaggtgaaatatatgagccacattttccccgagaacacgcgccttttaatatatgggggggacacccttgtaagaaagactttggccaaaagactggataaactggctgtaagagccattcgatcgtgaggggttctttgtcctcttgtactgtgttttttccttgccccgtaacaccccaaaaggttctatattttttgtgtagggtgctacaagagaccttgtattgaagaaaatattttttttggaccaatatttaaggtttcccaaaaaaaagtgaccacccctccagggaata

SEQ ID NO: 640664 - DNA, 109 bp, Homo sapiens
gccggtctcagtctttaatcgtggcaggggatgaattgtttcaggggaaaatgcccacattttaacttttaaacttctgaataaactgtgttaaaaccaaaaaaaaaaa

SEQ ID NO: 640665 - DNA, 804 bp, Homo sapiens
taggtggtttgattttaaatcactataactaaaggggttgggacttccagattcccaaaggatccttttaaaccaaagtcaaacgtgatttaatcgttttactatttacacattttgtgtgcaccacattcacacttacaaacttttctttctaccttgacaactaaatccaaggtggtaccttggtatctgtctatcacaataagttacctaacacatgtgggacaacagagacacatgtttatgacacgaacattaacgataccaactcttgactacttagttggctgaacttacagttgtgtaacccgtctcattgtacacttgaacgttcctttctctacagtaacaggcctcacttatccttctataagtgtgcaacacagagtttttccatagtagacctaatctttgtggtcaaccagtgtatctgacggttgcatacaatgtagacggctacactttcattgatgccaaatccacaatgacataccagtagacaccattgactacacaaactgtttgtggacaacaactggcttactagtacacacttaacttcatgtacgacgccacagactggcttgatggctccacctatgtacatagctttcagaacaattgcataagatggtgactatatagggaacaccacagcgaatttcagacgacagcactatctattactttacccaggaccatgccctcattagggcccttgggaataacacgtgccatgttgccacatgccactgcattgcctatattccatggcccgcatatctaacggcattacgcctttgc

SEQ ID NO: 640666 - DNA, 363 bp, Homo sapiens
  misc_feature (78)..(78): n is a, c, g, or t
  misc_feature (104)..(104): n is a, c, g, or t
  misc_feature (151)..(151): n is a, c, g, or t
  misc_feature (157)..(157): n is a, c, g, or t
  misc_feature (174)..(174): n is a, c, g, or t
  misc_feature (254)..(254): n is a, c, g, or t
  misc_feature (263)..(263): n is a, c, g, or t
  misc_feature (277)..(277): n is a, c, g, or t
  misc_feature (298)..(298): n is a, c, g, or t
  misc_feature (327)..(327): n is a, c, g, or t
  misc_feature (329)..(329): n is a, c, g, or t
tcgacccacgcgtccgctgtctcaaaaaaaaaaaaggcaccatccaccactcttctctttgtctttatccttctctgntaagtctgtcctttattaatttaaangatgggctgagtcccttgaattatcctttctctcctgtggtctagangtgggntccttgctgtgctcggntatgtgtccagaacagtggggcagagaaaaaaaatatagtaaaacaccagctctggtatctactgttaagaagctctgangtgctgtangccattgcagctangtgagacttgcagttgggganctgagggactggataagattccagtgganantgttgggggtcctggcccaatcccattctccaga

SEQ ID NO: 640667 - DNA, 354 bp, Homo sapiens
gcacgagaaattccttatatttttagtaaacaccaaataaatatttatcaaataagtgaagaacttgagagctaacataagagaaggtattgacgcttactatcaaatttggcccttaaaaaaccttatgaggaaggcagggctcagagagctaaatggtttgcctgaggtcacacaacagaaagcagcaaaaccatgatctcatccaccgtgagcatggtgagctgatgaagacttactgctagaatttatcaaagacattgttaaaggaaaataacttacattggtttacttcttaaatggaaataggacatattgaaatattgaatatacaaataaagcaaaaggtagaaa

SEQ ID NO: 640668 - DNA, 379 bp, Homo sapiens
tcctatagatcagtaaagaaaaaaaaacaggaagagctgggacttttctgagatacattcataaagtcttcttcctccctgctgcttctgctgcgtttttttctgttgaacaagaccccttccttcccagaaacatcgaggttgacgggaagtgcccagcagaattaagtctgcgtgttccacttaaacaattggactgagaaaaggcaaccctttagccaatccacagaaaaagctcactgtaagccaaaagccaagagcacaggaaaatggtcttcaaaacaaacacaaaacgaaacaaaaacctgtgctaaaaagcggaggttcagaaaagatcacgaaaaaatgacagaagacactgatttataggaagttggtg

SEQ ID NO: 640669 - DNA, 436 bp, Homo sapiens
tctggatgcaaagtgtctcgatgttgcagtcacgccattcagagtggtttggtcatagctagctatgaatggactaatgaccctcctctagtgctcaaagaggctgcctcagggacatgcgacacgaccatgtgtctaacagtacccctgcctcctgcccaggaacccaggacttgtgccacaattaaggccctctcagggacatgtcggccagcaacacagtaagctgagtcattggaatattcacttgccacaagcccagaaacttacaatacaaagtgctctttaaactgaaggacctgacatgcccttgctggcttatggcagtgtgaaatcataagaggaaagctcagcccacactccccgaatcaagggccactctcagagccacctgctcaaggggccactgcaggccccagcctcctacagatgggga

SEQ ID NO: 640670 - DNA, 387 bp, Homo sapiens
tcaggttttgaaaatcagatgattttttttccttttccaaaccccacacgttgaaagcctttataaatccaagtctgaaactttgcgcttttgtacttcttttaaggtacccaacttggttcttagttcatataatctcggggtacacccccccccccacctttttttacccccacctacgtttacccccacctacctttttttaaatttacctgattcccgatttttttcataaatattctgcctactgtaaatatgggttcctttgagttgtttttgaaaattagcgcaatgttttaaaatcaagtttttggaaatttcattgttttacctacaataacttttattttggaattgaactttttttaaattgtatcttatcctgga

SEQ ID NO: 640671 - DNA, 535 bp, Homo sapiens
  misc_feature (123)..(123): n is a, c, g, or t
cagtaggccccagcgcaacgtacattgccctgaaacacgtggccccttatggtctggcctgtgccggcctctccagcctcatgggtccccagcacggctcctccaccccacacacgagaactncaggctccactcacaccagggaatacgcgaggtggcgagtcacagggttgctgctttcaaatcagaaccactgagttattggccatgggaggagcagagatctttatgaaaccctagaacaggtgtagtcttgcaaagaatgatttattattgtacccttattagggctactatctctgatttccacgtttaaagaggcttccagcttgctggaagtgaaagcgtaagaaagcgcaggaagaggcagagtcagattttggaaattaaaatcccaaggctgtgacaattgcaattctaggtatatgccctagagaaattaatgaatatgtgcagagagacacatgcaagaagttcattacagttttgtttctaagagtgaaaaaaattgaaaataaaatgactatcaacggaa

SEQ ID NO: 640672 - DNA, 759 bp, Homo sapiens
cattgttcgcctccaggcagggaattctctaaaaaatatgaagctacatctcgttggctcctggccaccaatatcccagtggagtgggggcacacttgggttcagttccaagctcacctctggccctgggtgtgttacataatcttgagtctcagtttccttttctccataaaccctccgtgcaaatgtgttttgaagattagacccaatatttatttagagtgcctggcacacagtagatccttaattgcagcacttttgacgattttaggagcatataattcacgccatagaatgttccagcagtaaggatctatgagatcacctagtccacctccaatttttctgatggagtccacaggtggtaggtgttttccccaagatcaccaggctggtttggcagatccagaattcgagtgtgggctcaccctctcacttcctgtgttcttgtctttctaccaatcaggaccaagataccttgcagtgatagtgggtatatgctttagcctatatatcatttgccactttggtcggctctgaggtatgaatcttagctggaatggctttgtgtaatcctctccactgcccttacatatgccactagtcctgcccctgctctgagcagctgaccatgcctatctggtggcacttttctagtccttccggagaccgagggacagagagaggcttcgcgagcgatatatgagagagagagagagagagagagagagagagagagagagagagagagagagagag

SEQ ID NO: 640673 - DNA, 331 bp, Homo sapiens
gggggccccccccccccccttttttgagccggtttttttttttaacccggttttaaggggggctttttttaaaaaaccccccccccccccccgggggggccaatttttcaggggggtttttttttcccttggggtttttttccttgggtaaaaggggggggggtttttgggggggggggaatgcccccccgggaattaacccggggccggggtttttaaattttggggggaaagggggccaaattgccccccggaccccctttttttcttttttttttaacccagggtccccccccccccttttttctttggttggggggttttttttcca

SEQ ID NO: 640674 - DNA, 432 bp, Homo sapiens
aggttatcctgactttgaaatcacgcttaactcttaagtgatattttttgagacttcctgcatcacaggtacctgggccttgtcctagacctgttgaattataatttcaagagtaggggaccaggagcctacatttttaatatggtccctaattgtgcaacacacaattactgccttcaaagattatgtgtctaggagaaagaaggagtagaattgagttttgtgtattgctccatatttatcttaaaatattaaaagcattgctatgtgtatgtcatttattttttacctccaaagttggtttgcaaatatttagatttctcagataaaggccattgctagtcatatggtgcacctttgtacaaaattattaaaaggcagtgccctgggaattatttagcaagcaaacttcattaccctagtgtacactag

SEQ ID NO: 640675 - DNA, 999 bp, Homo sapiens
cacgcgtccggaggtgggatatccctatgctggctaggctgagcttgaactcctggttgctcaagctagttctacccacctcaggctcctgtgtagctgggattatagattggagccagcatgcccagctcaaagggttgtcctcctagactgagcctgatgcagtctctggatgggtggggacgtcctgtcatcttgggtcagctcacctgcctcagatcctcgagaaggacctccttgatccgatgactcatggtgtcttctaatcctaccctgaaacttgtcctatccagtgagatgccatcttgtgtgggctacggctgttgaggcagagaggaggtagcttgatttctctagtcaacattagggggatgatgttgtgtactgtggagagggatgaggtgctgggagggatacagggcgtggtgttgcttggtcaccccgagcgttgtgtggttaccatcatcatggtgtctaggccgcaaaggaaaggactgtcgcagggtggcgtgacgctggaggggacatgctggtgagagatggtggagagagtgtaatttgggatggagctgggcattaatgagtaagagagtatgtgtgagagcagattgtacttgcgtcgtactggcgctttggtggttgaatcagggtagcgtgagtacaagtcctcgtttgacgatcgctgaccccacgggtatgagagggggggctgtgtattccacttggtggtgcacgggtgtgtgacgtgtggtcccgattgtccgtagagggtcgtcttcctctgcttgtgttcataccgacgtgcctgtcgccctgcctctggagcctctggcggacttgttgaggtctctttcattccctggtatcgccttctgcattggtctcgttcttcttcaccccattgtgaccggttgttttgcctaaaccggggctcttggggggcctcgtcaccccacaccatggccccggttcggcgggggccatctcgggggaaccgcg

SEQ ID NO: 640676 - DNA, 392 bp, Homo sapiens
  misc_feature (71)..(71): n is a, c, g, or t
  misc_feature (73)..(73): n is a, c, g, or t
  misc_feature (87)..(87): n is a, c, g, or t
  misc_feature (92)..(92): n is a, c, g, or t
  misc_feature (94)..(94): n is a, c, g, or t
  misc_feature (96)..(96): n is a, c, g, or t
  misc_feature (120)..(120): n is a, c, g, or t
  misc_feature (143)..(143): n is a, c, g, or t
  misc_feature (157)..(157): n is a, c, g, or t
gccacaacagctcccaccacacccacgacgtcattattcgccgtctcgtcacatcactgggtacatgaacntngaagctctatgacncactngntngaatatgacagacaccgaaaatcncgactcagccccctccagcaccnctacctgttgcccnccgatcacagccggaatgcagctgaaagattccctggggcctggttccaaccgcccactgtggactctgaggcctctgcatttgcgggtggtctgcctgtgatattttggtcatgggctgttttggtcggtttcccatttgtctggccagtctctatgtgtttttttttccttgccttcattaaaaccaaaactacagaaaaaaacaaaacaaacaaatggtctcattggcctca

SEQ ID NO: 640677 - DNA, 1044 bp, Homo sapiens
cctgaaaatgctggactccaatgcctctggaatagggagtggctgtggatctctctctatcagccctatgctgaaggtctttcattattaccatgctctgtaagccagaaacgcggacccctaatattgtcttcccaagcggtatgccccacaagaagacattcactaaagttcaaccatctgtccactacgtgggagagtcctccttccttcatgcgacactgaacccatggagcacaatgaactgagcacgattccaagatggcttcacttgacctaaaattgtaatacatccaccaacaagacgaagtgtttaccgccacatcttaacgaacgtagccaagggacacctataacaccggatatccttattacccaagaagaaacttcagatgaaccactcacactgtacggtggcccatgattagttcacctcctgattgccaactgacagccagtagccataatacatcatacaccccacacgacagaaaaccactagaactgattacccgtttgaaacagatttcattgctggaaacaaattgcatcataccaatggcatagggctacatgggtgcaaccatggggggaagcccattccggacaaatatgttaacactaacaataactgggccattgcttgaacaaagttgacccccctattcaatggcacacagtatttagcatcactggacacgcaagccgtacattcaagagacagagcacagaaaaaggagattgacaacatagagatagacaggcaaaaaaaccccgcaacgagacgccaaagagaggcacagtgaagcaaaattagcaggcggcaaaggaggaaacaggataacgagatacaccagaaacacgaaccaagggccaatacaagcaccaagatacaagtggccccacaaggacaacaccaaaacacgacacgaaaaaagaggggaggacaacaaaagaaaagcaaagggacacaccaacgaaagagcggcacaaaaggggagacagaaagctgaacacagaccagaaaagacataacgaacagag

SEQ ID NO: 640678 - DNA, 658 bp, Homo sapiens
aaaccccctcttcaagaggcaggctccaagaaaggtagagaatcagttcctactaaacctaccccaggagagagacgttatatatgtgctgaatgtggcaaagcctttagctaatagctcaaatctcaccaaacacaggagaacacacactggggagaaaccttacgtgtgcaccaagtgtgggaaagctttcagccacagctcaaacctcaccctccactacagaacacacttggctggaccggccctatgactgctaacgtgtcgaaaacgcttttggcgcacgcacgctcagcacccttcttaaacactcacgcacgcaactgcacacacgcaagcagcgcgccactactcagctgcacaagacttgctggcacacggccattctcacggcggcgcaaacggcacgccctcactccgctcacctatcgagatccacaactgggcgagaagccttactcagctgtaacgaactgctgggaagagctctcagctcacgcatgcgggcctcagctcccaccagagactccacaccggagagaagccactataacgctgctcaggagctggtggcgacagccttcaaccacagctccaacttcaataagacaccacagaatccacaccggggcaacaagccctactggctgtcactcac

SEQ ID NO: 640679 - DNA, 997 bp, Homo sapiens
gaaaattccgaaatgggtggggaggaacattttccgggaatttctcaatgagggccggcgccttttttgagaaaatttggaatgtccgtgttcttcttcgccaaaccattttcccagaatctcttggaaacaatggaggtttttacacgacctcctgtctcttagaccagagtaaccccgcgagcccagatgggtttgtgaagagagtgtcccctgtgccgaccttgtcccggctccccgcggcatgatggcacacaacctggagggaaagaaaaattttgtttccacaaacgaggatggcctcggccatttcttccaccacacttgggggtttcatataagcccgggggggaggggacctgggatttttattatggggccccccatttttttagagggagtacacccaagggccgccttgtgttgttatccaacaacgtttgtgataatcctctgccacaggtgtgcccccctttatattttttagggtgtgaccaccgcccaccaattgagccgttgttagttagaggaagtttgtgttcgcccccgccgacacacacgtgtgatatctgtctggtctcgctgtgtggtatagtgaaaaccccactcctctctgtggaggcctcccggcgggttcactttttgatcacttccctgttgcttggagcgcaagcatgaatggatagtccgaccccaaccactcgcacggtgttattattgaataggatgtggaagacacacctgttgttatagagtgaaaattccaggaataggggtggactatttaatgtgagcgctaccacgaagtcacacccaaactgttggttagttctcatatagaggtgacagtcaccaataagagtaacgggtgtttttttttttccagatggatgtgggggttaaataaaagagaaataataaagagaagattctgtttctaatgaaccgcttttttaaaaaaattttttaaccctaaaaaaaggggaataaaaaaaaa

SEQ ID NO: 640680 - DNA, 384 bp, Homo sapiens
  misc_feature (63)..(63): n is a, c, g, or t
  misc_feature (65)..(65): n is a, c, g, or t
  misc_feature (79)..(79): n is a, c, g, or t
  misc_feature (84)..(84): n is a, c, g, or t
  misc_feature (86)..(86): n is a, c, g, or t
  misc_feature (88)..(88): n is a, c, g, or t
  misc_feature (112)..(112): n is a, c, g, or t
  misc_feature (135)..(135): n is a, c, g, or t
  misc_feature (149)..(149): n is a, c, g, or t
aacatcaataccacctctaaaagccacaccatatcccacccttgatataaacgggagagaacntngaagctctatgacncactngntngaatatgacagacaccgaaaatcncgactcagccccctccagcaccnctacctgttgcccnccgatcacagccggaatgcagctgaaagattccctggggcctggttccaaccgcccactgtggactctgaggcctctgcatttgcgggtggtctgcctgtgatattttggtcatgggctgttttggtcggtttcccatttgtctggccagtctctatgtgtttttttttccttgccttcattaaaaccaaaactacagaaaaaaacaaaacaaacaaatggtctcattggcctca

SEQ ID NO: 640681 - DNA, 391 bp, Homo sapiens
ttcatgtttcttcatttgacgttactatattccttctcactgagtgtctgttctgcattctgggtaacttatttagatctatcttcaagttcaataattctctttttatttttgcccactctgctgcttagttcatctaagagtttagcattttaattattatacacaccatctctaatcttgtctgaaccactgacactcaattacttgataactcttcagtcatttgcgtctcctagctaactgcttccctaaatccttgcaccctctacccaaaagctacccctcactctgagcaaggacctcaccatccccttgacatccaggaaaaccaaggacattaacatgggacttctctccacagtgttccacaggacttgcactcctggtc

SEQ ID NO: 640682 - DNA, 289 bp, Homo sapiens
tcgctgtttgctgtaggtcgtctctacaggataccccaccttcgatcgcggagaatttgcccgtcgattgggggggggtccttcagagacccacaggccggttgtcttggcgctggtgtgccctggtttacagctgctgcttgtggatcgtgttcttcttgcaggtagctcttcctccacatcacgactggggtctcgaacagcacgggggtaggaaatcctccaggatcttaggacatttcactccggttttcctgctcgatggtctctttggtcggacagggttccc

SEQ ID NO: 640683 - DNA, 1028 bp, Homo sapiens
  misc_feature (844)..(844): n is a, c, g, or t
ggggcactgcggcctcgaaggcgattcctggagcatattcagtggagcgagtagggactcttgtagcttagaagtcaggaacactgtttgcatgcttgtgtctggagtgtttgcgcataaaggaatggtggacttgcacgaatatctttttaagaatcaagaccagcagggatctcaagcttaatctcctctgctctcgaagtcttagccacttttgcgttgttccttcccaagtgcagagatcagtggacacaaatatagaaaaacatactgaaagaatatagtgcgccgaaggcgcctaattcaggagtttgtgggccaagatgatcagcgtctgtgagagaaggcatttccatttgtttcaccacggcattgggacatggcgcaacacagcgggattgaagcatacattccgcttgtagatccacatatgttgggacgaacacggtgaccaacgggacaaacgcaatttgctgcgacatcagccacaggagcactcgacacttgatgagaactcaaggacgccctcacgtctcaataagaacctgggtcacctttgctacagggcgcactggtgcaatataacccgctaataactttctttaggatcgcgcgaacaacctccagcgttaccatttgccatattcgcggttaaccgacttagctgtcgtgacacataccaagcccgtattaggaggcaaaaacgagggcccaatggctaatgggctctatatttcagacggaataagctgggccatacgactggcactgttcggcactcagggggcctggagtggcgagtcgcgggctcatataacggcagagtgccattccttgacgacanttccgaagcaatcgggcacgataatgaactcggaggacactgcgcatatgagcatcagcagtagggtgaaacagctaattacagcataggaaaaacaaagtcgccgttctgtgtctgtaggtgctctcttgtcatctgagtctcatatctgccgcgacaagcataacaaacaaagagccactaa

SEQ ID NO: 640684 - DNA, 175 bp, Homo sapiens
ccagcaggctcattgagaagtcggatgaccaggcacagctggtgggacgaaatgctgcgcattttccatgccctcaaggaggcgctcaatcatcatcggtgacatcagcaccagcactgtgtccacgcctgtacccccgcctgtcgatgacacctggcttcagagcgccagcaga

SEQ ID NO: 640685 - DNA, 266 bp, Homo sapiens
gctaccctgggcttttttttatgcgtcccaaatgtgtcatgtgtctcatgtcaattcccatctatgagtgagacatgcggtgttgggttttttggtccttgcaatagttggctgagaatgattattttcaatttcatccctgtccctacaaaggatatgaactcatcattttttatggctgcttagtatcccatgatgtatatgtgccacattttcttaatccagtctatcattgttggacattggggaacgcattaaaaaaaaag

SEQ ID NO: 640686 - DNA, 275 bp, Homo sapiens
  misc_feature (18)..(18): n is a, c, g, or t
cgcaatagtagagtgcantgcgctccagcctggtcagaagagcgaaactccatctcaaaaaaaaaaagaaaaaaaaaaatttacaacaaaataaaaccatccaatatttatcacaatttttttctctcctgggtaccatattttggtctgcttgctcagggagcatgtccggggatgaagcgggccggttttattacaaactccaacactagaatgagtgggccgggggacaggagtgtggggtgagtgggtgattggagtacccaacacccgag

SEQ ID NO: 640687 - DNA, 161 bp, Homo sapiens
tctgcattcttagtggtcacaagatgttagggttgcaggaacagattaataacgttcactagaacaaacccaggacgttaacagacccaggaaacagttttgatgtcgctcgtatcttgttagtccaaactgcaccatttttctttctttctgtttttttg

SEQ ID NO: 640688 - DNA, 556 bp, Homo sapiens
cagcctggtgctgaacttctgcttacaggtgtgggtcatctccacattgtagctggtctgagcccgcaggtcaggattgccgagacagtaggtgttggcgtctatccagatgcgaaaagggatgagctgccggtagccgggacggtcgatgcggcggctgagcgacaaggccagctcgtgcttttccgacagcttcttctggatgcccgcgctgggaaacagctggaaatagttgcgggtgaagccctggctcgggtcctgcgaccggccctcggcgttggtctgctctacccgcaggcccccggaaagcgtcaggtcgggccgggggcgggtcagcgtcaggtaggccgcgttgatgttctcgtcgtaccggaagcggttgctctggttggggtcgggccgcgtgatgccttccacggtgttagtgaactgcacgtcgttgtccgaggttaccaggctggttttcaggccggcctccagcgtcattttgccccgcaggggcattacatagtccagctttgccgcctgaatggtgagccggcctttctgcacgttg

SEQ ID NO: 640689 - DNA, 513 bp, Homo sapiens
tacattcagggttctccttaggactatgacagtagaattgtgtggaacagggaatcacggatgcacatagaaggaaagaaatatcgatactaatgtactacagaagatctggcagggataagcaggacatcgactggaacgtatgctaaatgaaagcagactaatttctattttcttacctgagcaaatatattattgaaactgcttatgtatgtcacaggagcccacaactatcagctacacaactttttgtattgcaagaactcatacttatagtagctataatttacacatttaatttaaagtgacttttagcactaaaatgcctagaagattttactccagacctataaggaaatgttaagtttatatgaacaatgacaagtcgatagataaaacttctcatgtctttggtgctttggacctaatagcactggacaacaccacgaccacatggaaacatatatatggaagcaacaatttactttatataacgtatgctaatggagagct

SEQ ID NO: 640690 - DNA, 826 bp, Homo sapiens
  misc_feature (810)..(810): n is a, c, g, or t
gcaggttattaagttgggccgcactgaagacttaagggcagtgaacacatcggatgtcccacagcacaacagccctgcatgggtttgttttgttctttctactgctcactcccaaccttttgtaatgccagggttccgtaaaccttactttctgagatgtagtctcagctctaaactttgtgtaatactaaaatcacgagaacacctaaacgcacaaccggagaaatctattgtggtatgcacttgattaacgttataaaatgttagaggaaactttcacatgaataatgtagtgtcaaattttatcatggtataatttgtaaaaataaaaagaagttggacaagaagagaattatggatttgtcaatgtaagtatttgtcatatctgaggtcctaaaccacaatgaaagtgctctgaagatttaatgtgtcttattcaaactgtggtctcttctgtgtcaaatgttaaatgagaatataaacattttttagttctttaaaatattcccgtaggtcaaaattcttcctcactataattggtatttactttgtaccggaatttcttgtgtacatgtaagtgtgactggcttttgaggctctcccaagggtctgagtgacgtgttggcagagagaagcatccatggtccagccaccaggctccgtgtgtccctctcccatgggaaggtcgtccgatgtgcctctcattccaagggcaggaagactgtgactctagccatgacacgctcggttctggtgggatgcacagtcactccacatccaccaactgaaggaagggaaacaggcagaaantaccacgagatctaga

SEQ ID NO: 640691 - DNA, 194 bp, Homo sapiens
  misc_feature (83)..(83): n is a, c, g, or t
  misc_feature (132)..(132): n is a, c, g, or t
ggattttattgaacttttcatattacacaatttacccaaaacatttaaagtaacagtaagacaaacttaaaataaataatgtnatacttgtcaaaacatctctaggtgaggcaatatgtaaatttcattgtnaaataatgattttgttactttgttatacaaattggtaccatatcaatgatactaaatgactt

SEQ ID NO: 640692 - DNA, 323 bp, Homo sapiens
gtcgctctgcggatctgaaagaagagaagaaggaggtactgatcatagttacgaagcgtggagcacaaagacggattcatccttcctgaagtttcccacaagggctccaggagagaggtcttgggcacaagaagaaatgagtttggcagagagaaagtgactatgggaggagagggctcccagggcaagaggaccacacggggcacaagagaggaagtcccaggggcccaatgaacaggggacatgggtgggctgaaagcaaggggtggtaaaaagggcaaacagcctaaggttgataacgaacaggcccgtgaccttaggtc

SEQ ID NO: 640693 - DNA, 230 bp, Homo sapiens
gaattacaccatcttgagaggtcagcacggtgctcacgtgtcgacggaacttgtacagggaggcatgcaccgcagtggtgaatacacgtcgaccaggctgcatgtttacgttcttgggtcgtgaacacggtagctcatgtattgacggaacttgtctccggaggcgtgcaccgccgtggtgatatacccgtcgagctggtggcatgccttgcatgctccgggtcctgcac

SEQ ID NO: 640694 - DNA, 464 bp, Homo sapiens
gtggaggtcaatagagtcagggcaagattagatggggggcggttatagatggagggtgagatgagagacgagtgagctgaagaaggactgggggtagcaaaaaggaagcatgacttcaagatttggaagatgctgtctatccagtacggcaaaaaataagaagagcgtgcactggagagacaccaagagtgtggctggctcatcatttgttaaagagattctgggtatgatgcacggatccaatcaaccatctcaacagaagccaggaacagagatgaggttatccaggaaggtctatggagggcaccctcgtctgacggcctgcaaccctgtggactgcatggagggcagggtttctgagtattatataccagcagaaacactgccagctggaactgaaaggaaaagagatgggatgaaataaaagaaggctaggacttctgggattctacaaactggccgat

SEQ ID NO: 640695 - DNA, 116 bp, Homo sapiens
aggaccccgcatttcgtcccatcagcaatatctcgcattcctcaggatagtacagcatgtaacctataaaccactttcaaccagatctcaattctccctgatgggagcaagactgg

SEQ ID NO: 640696 - DNA, 434 bp, Homo sapiens
aaacatacagtttaggctgcttgtgaatgcctcatcagctgctgaagccatatggcagcatcttcaactgatacagaagtgggtcgcagaggtgcaatatcaacccatgtgccagagctgatggcttcttctactgatgcttccacttgatccagaagtccttgcacaacacaagctgctttcaaaaacaagagtagtgtagtcttatatcttttctttatgtagcttacagcatctgggattccaagtttggaccaagcatcacattctagatagacatactgactgaaaaaggatccacccaagtactctgtgtcctggagtagatgtcagggacaaacacagctatatcctgtctcccaccaaccacagtgcctcgaaagcgtccgttattaccacgttcctcaagcactgcgtatagaagctgctcctga

SEQ ID NO: 640697 - DNA, 313 bp, Homo sapiens
caggatcccctactgtctggttgtctctatataggtttggtcctagccttttctattagcgtctttttatgattacatcgtgcgagagcttccccgtttcgagtgagttcaccctctgaatcaccacgattcaggatggtgactagcatcaagcatgctacactgcatctcaaaatgcttagcctagccacacccccacgggaaacagcagtgattaatcctttaacaagtaaacgagagttgaacaaagttatactaaccccaggattggtcaaatatcgtgccagccaccgcggtcgcacaattaacccga

SEQ ID NO: 640698 - DNA, 818 bp, Homo sapiens
  misc_feature (6)..(6): n is a, c, g, or t
  misc_feature (83)..(83): n is a, c, g, or t
  misc_feature (95)..(95): n is a, c, g, or t
  misc_feature (168)..(168): n is a, c, g, or t
  misc_feature (187)..(187): n is a, c, g, or t
  misc_feature (192)..(192): n is a, c, g, or t
  misc_feature (225)..(225): n is a, c, g, or t
  misc_feature (273)..(273): n is a, c, g, or t
  misc_feature (282)..(282): n is a, c, g, or t
  misc_feature (288)..(289): n is a, c, g, or t
  misc_feature (435)..(435): n is a, c, g, or t
  misc_feature (477)..(477): n is a, c, g, or t
  misc_feature (685)..(685): n is a, c, g, or t
  misc_feature (816)..(816): n is a, c, g, or t
gggggngggggggaagggggcgctagggggaggggaaaggagggtgtggggagcgagatggctccgggggtttagacactgcngggttgggggcnggcgggcacctgcctctgactccagctgcgagcagcttcacttggggccctgggcctccgactcctcctcgtngtcttggtacatgtggggntcttngtggggggtggcgtcctggtactgctggtactnggacaccaggtcgttcatgttgctctcggcctcggtgaactccatctngtccatgcnctcgcnngtgtaccagtgcaggaaggctttgcgcgggaacatggcggtgaactgctcggagatgcgcttgaacagctcctggatggcggtgctgttcccgatgaaggtggaggacatcttgaggcggcggggcgggatgtcacacacggccancttcacgttgttggggatccacttcacgaagtaggtgctgtngttggtctggatggggagcatctgctggtgcacctgcttgatggacatgcggccccggaacacggtggccaccgtcaggtagccggccgtggcgcgggtcgcaggcggccatcatgttcttggcatcgaacatctgctgggtgagctcgggcacggtcagggcccggtactgctggctgccccgggctgtgaggggggcgacggcgcnatgaagaagtgcaggcgcgggaagggcacatgttgacggcagcttgcgcaggtcagcgttgactggcccgggaagcgcaaggaggtggtgactcgctatggtggcgatacaggtggtgaggtcccgtagtngg

SEQ ID NO: 640699 - DNA, 441 bp, Homo sapiens
  misc_feature (80)..(80): n is a, c, g, or t
  misc_feature (216)..(216): n is a, c, g, or t
tggaggctttcatctcttctaccatctgccagagtcagcagagctttccggaagtctccagacgtctcagagctaatgtnatccccgaggctcttcttatacactgtataataggcctgcgagatttccttcatctgcctgcttgacctggttgttaggatttcaatcagggcatcttcatctgtgccagttcccttcatggatttcttcaaggtngtcgcatcaaacagggctggtgcagtaacaagagccaccatgacgtgctcgaagtggccagagagatcacccttcaagtcatctttcagctcctgttcatacgctgcttggtactgcttgacaaatcagcttgtctgcgcgttcgaccgctccgtcagaatgttgatgagggttttctcgtcagtcccaagtcctctgatcgctttccggatagcttcggcatcc

SEQ ID NO: 640700 - DNA, 263 bp, Homo sapiens
ttgtgtcaaccactcactcaaacacactcagtcactgctttagatataccagacatgctggttaataaaattttaatctctacttacctatttacactctataatataagccgtcagctcagacaacttaggcctgtggctcttctttggggaaaggcaggaaaatgatagctaattataaaaatattgggaagaaagtttatagctgctcctgaaattcttttaactgtgacactagatgctaatttctgcaactgcaaacc

SEQ ID NO: 640701 - DNA, 359 bp, Homo sapiens
  misc_feature (9)..(9): n is a, c, g, or t
  misc_feature (312)..(312): n is a, c, g, or t
ttgcgtgancccccgatttcaacaccgcagtccacaacaccacgccaacaaagaatatagacgccgtccggcgtgcaccacacagattcaataccgcgagtaccgcaattcctacagccgcgacgccaagagaggccatcgataagtcattagtgtagaacaatgcgatgataatgatggccccaagatcgtcgataatagccagagccatcaaaaagatcttcagcgctaacggaacacgacttcccaacagtgtcagtacaccaagtgcaaaagcaatgtcagtagccgtcgggatcgtccacccttcgngggtaatcggatcgggcatagttaaaagccagatagagtaatgccgg

SEQ ID NO: 640702 - DNA, 476 bp, Homo sapiens
agcaaaaaaagcgggcaaagaatcccaaagtttgggccatgcgatgttcgcagagaaaaacagacattccgaaaagtgtctgaaatgtttgccttactcccagccttatctaaagatatcctctcccactgtgatggttaatactgattgtcaacttgattggattgaaggatgcaaattattgatcctggttgtgtctgtgagggtgttgccaaaggagattaacatttgagtcaatgtgctgggaaaggcagacccacccttaacctgggtgggctccatctaatcagctgccagcatggctagaatataaagcaggaaaaaaatgtgaaaaggctagactggcttaacctcctggcctacatctttcttttctgctggatgcttcctgcccttgaacatcaaactccaagttcttcagtgttgggactcggactggctctccttgctcctcagcttgtagacagcctactgtg

SEQ ID NO: 640703 - DNA, 402 bp, Homo sapiens
  misc_feature (40)..(40): n is a, c, g, or t
acacacacaaacacacatatatattcttttttttctttgnttgtagaaacaggggggcgctattttggccaagctggtctcaacctcctgacctcaggtgatctgcccacctcagcctgccaaagtgctgagattacaggtgtgagccactgcgcccagcctataagacatagctcttggcttagaggcactgatacaaataagctccctggactgaggagcaccttggaggtgaacacaagggcctctgacagcgagcatggaatatctcagtcggactgcatgacctgggcttgcgttgcataaaacttctggaaaccccgtaaaaataggccaacatgattttgactttaaaagagagctaactctaaaataactattctatatcgaaatccagagtct

SEQ ID NO: 640704 - DNA, 265 bp, Homo sapiens
tgtggcagacggggtctcagaactagaataaataagcttagaatatccaagaagtgccaggggcggtagttcacgccggtaatcccagcacttggggaggccgaggcaggcggatcacctgaagtcaggaggagaccagccgggccaacagggagaaggcccgtctctactaaaaatacaaaaaatagacgggcgtggtggcgcatgcctgtaatcccagctacccgggaggctgaggcaggagaatcgctggacccgggaaggg

SEQ ID NO: 640705 - DNA, 139 bp, Homo sapiens
cttgatgataaggataggaagatatgtcaagattatttctatgttaccagtatgggaaccagtgtgaatggttggtggcatgcactgaggataagatgcctatggttagtactgtaggttaacacaaatcttattaaga

SEQ ID NO: 640706 - DNA, 412 bp, Homo sapiens
  misc_feature (394)..(394): n is a, c, g, or t
tagagacagtctcactcttgttacccaggctggactgcaatagcatgatcacagctccccgaaaccttatgctcctgggctcaagcgatccgcccaccccagcctcctgagcagctagagctacaggtgtgtgccacattgcccagctaattggtgttgttttttttgttttgttttgttttgtttttttgtagagatggggtctcactatgttgcccaagctggtatctaactactggcctcaaatgatctttccatctctgtcttccaaagcactaagattacaggtatgagccactgtacccagccagctattgctaacattaatacaagtaattttaattaaacatttattacatagcaggtagtatgttaagcacgtcgacgcggccgnaatttagtagtagtagta

SEQ ID NO: 640707 - DNA, 1079 bp, Homo sapiens
aggcctagtacgaggcgggtgttaatcggacgaggatgttacaggagcagggtccccacagtttcaagaggtggtccaggaccctatgatatttctcttctttcgttcttttttttttttttttggagacaaagtctcgttttggtcgcccaagtgggagcgcaagggtgtgatctgggctcacggcaaatccgcctcccgggttacaggtgatctccggcctcagtacttgggaggtgaggtgggagaatggttgagcccgggaggggaggttggtgagccaagatcagtgtcacgtgccactacagccggggtgacagaaccagacccgtggtcttaaaacgggcagtggggtggggagaggtcctagcaatgtcagtgtagcaaccagttaagggacggggactcagggaatccagctccccacagtttcccgtggtgttgaccctaggcattgaatttagcctttctgagcctcagggtttttggtttctgaagataaacggattgggactagggtaaatctccaagtatccatagggaacccgagggagcaacgaactgagcaaacggtacccaggacgtgaacactcagggggaaaggcgtgcaatccgtgagaggctcccgaggcatgaatttgaagggccaggagcctctataacctacagccggtcccccctcagaagcggggtttcgcaaaaccttggtgcctaggcccccttcaaagcggggaaacacacagactatataccaagctaaggttcaagggactctaaatcgcattataaagcgacgcccacaagcataggcctgcagcgagggaacccccgtagacaaaaggaaatccaaagggaaggcctgcgctatggagcaagactggcccctgcgggccgggacgatcgaacgaccgcgtgacggggcgaaaccctggcagacggtctgtgtcgccacacacactgcagtgcagcgcaggacaccgctaaacctcgggctgcagccaggaagcagacagacggcataacacgcgaatgacgccggaccaacaggcaagaccaacccccaacagtcgctggcggcc

SEQ ID NO: 640708 - DNA, 836 bp, Homo sapiens
ccactgtcagcacctcttctgtgtggatgagtggaccgcttacccctactaggtgaagatgtcagcccaggagagctgtctcagcctcatcaagtacttcctcttcgttttcaacctcttctatcttcgtcctcggcagcctgatcttctgcttcggcatctggatcctcatcgacaagaccagacttcgatgtccttatgtgggcttggccattcgtgccatctgcagatactggtccaaagatccgtggcacatctcaggaatcttcacacatgggcatcgccctcctgggattgatgtggagggccctcaaggagctcacgatgaacatcctgggcctgtattatcggagatgctgctgctcctgtatgccacacagatcaccctgggaatcctcatctccactcagacgggcccagctggagcgaagcttgcgggacgtaccgtagagaaaacacatccaaaagtacggaacacaacacccgcaggagaccgagggaccgaggagagcagggacaatgtgcagataccagactagcgcatgatagcgaggaggacaatacccgaaggacatggaaccaaagatacataatccatgaagaggtaacagggatcgaaagacacaaccgacgatgacacagatcaaatgaatcacaaagctttgggtccgggagaaacagaggaccatccagaagctcctagaatgaaaggtggacatagccccaccagcatacagccaggactgggacacacatggggagcgaacccagacacacagtgagaacaatcatggcgccaggacccagacaagagaagccacatcgtaccgaaagag

SEQ ID NO: 640709 - DNA, 337 bp, Homo sapiens
catgatatctgatcacatcatacatagacttctactcaataggcgtcctggtgaccatcgcttcttatacgtgtccccctgcagaaatgggtgctccttgcccgtcttcgttctgtcaatgatgcgtatgtccattgtcatgacggtccaagtacttaagacttgtgtgtgtataagtatggcagatcctttataactcatcgtcagtgataccacccagcctaagagcgagacacacagtgctcacctacaacatctcctcacatcgtcatagtctgtcatgtcagtgtcaaataccagttctttttcctgagcctggaaagctcccagcttcact

SEQ ID NO: 640710 - DNA, 301 bp, Homo sapiens
gaggattaagcaattttccctgtctccttgtctctgcattgctggagcctcatcgccctgtgctccttcttagccaggcgcaggggctagcttgtcttgcgtaccatcctttcatgtccagatttgcagggtgtcctactggctgatgctcatcttcactgtgctggagctcttatcagctgcatacagttatgtcttatgattgaaaccgctctacttcatcctacgctggagtcagtgtgctgacatgtcggcctgatacctgctgtgtttcaggtccagcctacactggtccaacctc

SEQ ID NO: 640711 - DNA, 158 bp, Homo sapiens
cgcgcgattgctaccataactctcttcttccgtcgaccacttgttggaccaaacgacccgtgcagataccccttcggccataatcccgacctttggttcccccttcccccaagaccatagcggtttgggcacagatttgggatagataaccctatctc

SEQ ID NO: 640712 - DNA, 237 bp, Homo sapiens
  misc_feature (143)..(143): n is a, c, g, or t
attacagatctagcggcggtggagtccgtgtgatctttgtgttgtgtcgggctcgtgtgctcatgcctcctgtgtgccgtcgtgtgttgggaacagttggttcccaccaagccatgctgtgagttccaaaaaaaagggggggnttttttgggggggaaaaaaaggggggttttttgtgaaaaagggggggtttttttaaaagggggggttttgggggattttataaggggggggaat

SEQ ID NO: 640713 - DNA, 372 bp, Homo sapiens
ataaataagaaagatcatcaatgtgctgcggcataacattgatatctggatatcaacatgccttcatcctaaaaccccacaatatttggtcattatgaacctaagaatacatcacaatacgaaacaaacgataaaaacacttcaaaacaaatcttaaaatgttactgaggatctacaaaaaaaacttctaaaaataatgagttcaggaagaattcaagatcaacactcaaatatcaatcgcttctcttttctttctagagacacagggtctcactctgttgcccaggctggagtgcaatggtgcaatcatacctcactgtaaccttgaactcctgggctcaacggatcctcctgccctccacctgccaagta

SEQ ID NO: 640714 - DNA, 1642 bp, Homo sapiens
cttcctccgcatcagcgctatatgtgtgcagccactattgctttctgtccccaagcacaagttaacccttgcagtctttgtaccatggctgttttgtgcatcgtatcagccagctcatgtgcaacaccagcctttcacctgcatgcagtttggccagctcacccattggcagccgaggggccatgcaattgtgctccagtgcacaccagctgtgcacggagcaagatgcagtgcacagcacacatggcagcatcaggcaagcacaggccacacagcagccagctcttcagcaaaccaggaaggccagtcggggcaagcatgagcccagtgacacatgccccccacagtagcagaaccaccccaccacagcaagcatccaacaggcccagcacctagacctccaacacaaggcttctaataaccttacagatcttcgtgaacactcctcattggcacaacaggcttgaccataaccattacactttgaccagccttgcatgaggaacacactcacttcaacacctccacactcctccgcatccctcacacacctcggacacccattgcggcatttgcgggcaccaactcgcaacacacctcctggggcagcaactttatcacttcatcgcaatgcaagcgacatgcacatcctggcaggcccttcaccggcagcacagccaatggttgcagcccatggttaggccgagcaccatccaaggcacaagcacaggcaaacgccaggaccaacgaggttgctagccccattcgcaagcaagacacattggcactcgtaaatgacttccaatatcaacacaaacacaaacttgagtacagaccacccttttgaggcggaagaccagatgaaacacgccagttgggttatacttggtccacccaaccacttgatcacatcaaacacccactcccaaccgatggtcacacaccccaaacaagagagttgtacgcacccagataattgtcgtcactattggacccgactaggacactaccagtggaaggcgacaccacaccaactccacaaacggacagcctaacgtgtccacacacacgggaacgtcagcttgggaaaggagcgcacactcaaccgaccccgcgaaacagaacaagagccgacgatacgaagacgtctaccccccagaccaccgagcagggcgacgcgacgaaccagtcgcacgacaagatagtcgtcgcgtgcgacaacgccagtcacaagacaagaggacccacaacacctgatgccacgccacaccgccaccgaccaccggagctccccagcaacacacaactcgagacgacaaagctgcggagacagaccgcacacaccagccgcacgggacacacaacaaacactgaaagagacaccagagaccaaacgacgagccgcacaccaggtcacggcgcgagcgagcgacaaacagcgaacgaccgcaaccagacgagccgacaagagcccagacgagaatacagaccagcgagagcgacgagacacacgagagacaactgacacggagacgtaacgaggacacacaacacagcgcgacagaacaaggacacgccaccgcagacgcacaagtgacgagcaccagcgagacaggcaggaccagacaagaaggagcaagac

SEQ ID NO: 640715 - DNA, 748 bp, Homo sapiens
tcacccaggcgggagtgaagtgtcacttcttggcccaggctcaagttgcaggtgtcgcagtctcggttcacgtgcagcccccgccctcggggtttcaggcgattctccgtgtgttcagcctctccgagtgtggcgtgggataatacccgccttgcgggtataactcgggctaatttaaatatttctagtagagagtggggtttgggccagtgtgggccaggcgtggtctcaaacctccgtgacctcagggcgagtccgcccaccttcagtttcccaaaggtgcggggattataagctggagccaccagtgccgtggccgtttttgtctcttatactgttttactttctctctaaagttttttataaattttcttggagacaagagtttcgctctattatggcccaggcgtggagttgcaggtggcgtggatctcggcctcactgggggcctcggcctccggggtctcggggcgatctctctggcctcaagcctccctagtggtgctggggattgcacggctatgtgccaaccgcgcctgggcttacatctgggtcattctacagtaccaacatggggggttcctcccatgttgggtcagggctgggtttcgaaagtccccggaactcagctcgaggtgatcacagcccacctgtggtctcccccaagtgctgtgttttggcagggtgtgtgaccaacggtccccgggccttttatctttcttctaacggtttcctttaggggacctcc

SEQ ID NO: 640716 - DNA, 672 bp, Homo sapiens
cgcagtggtgacgcctgtaatctcagcactgtgggaggctgaggtgggcggatcacttgaggtcaggagtttgagaccagcctggccaacctggtaaatccctgtctctactacaaaaaaattacccaggcatggtggcagtcacctgtaatcccagctactaaggaggctgaggcgagataatctctggggagtaatcccagctatgaaggaggctgacgcggaggttgcagtgagccaagatttcgccatgcactccagcctgggccgacagagcaagactccatctcaaaaacaaaaaaaaaaaaaaaaaacaaaaaagaaaaaacagttgggtgggcgcggcgtggggccagagaaagaaggtttctataaaaaccatctcggtgtggtggagcgggcgcggcaccccacagtggagtgtaactggcgagaacctgggcgcaaaagtggggcaccaaagaggaagacccggcgcagaagaccaattggtccgcgggcttcccccaccaaataaaaaaacaacagcgcgggcggaagcccggggcggggttcggaacaaaactccaagaagggggttccggacggcacacacagcggggtccaacacaacgcggggcccaggaggagccagagataaaaaatacgacaggcgacgcagggggtagagcg

SEQ ID NO: 640717 - DNA, 485 bp, Homo sapiens
agagattcccaagatgttcgaagttctcctggacctgaactctgtctaagaggcttacaacgaaattgtccacctcgttgaagagtcaggccacctggattgcctggaagaagactaagtctacctctctgtagctgttgatgtggcctgctatgcggcggatttagtacaatttgaaccggttcacctctttgatggagagaaaggcgacacggtcggagttctcggctagctccaccacgtactgcaacagaaacactactactactttcagctagatcctcaaggcctggcgcgacaagccagcccggaacaggtagtggtatttgcggtactaggcgtcccccgacctgtcccctgcggccccggacccgtcaattcaagttgccgttaacagctgtatacctactctcaggcggccgtacgtgctagctacatgtgggcccttaacgcccatatgagtgacgataatcttaactcaggcc

SEQ ID NO: 640718 - DNA, 401 bp, Homo sapiens
  misc_feature (37)..(37): n is a, c, g, or t
  misc_feature (323)..(323): n is a, c, g, or t
tttggtccttcattttaaacttttaaatttccctcantcctttatgtctcccttgccccctagtttcaagtaaacaatcccctcctagcctctgtcacctgctctgacctgagtcacctttagtcaccctggtccgtaaccatctttcctgtctaaacttctcaccccaccactctggcttatacccctgctctctttaaaatagcccagtcagaattagcttagattgtgcggtccaaccctagcccataggggaacaacacagcagtagggggtacctgcatcagggataagaacccattcccctcccttgttccggtgtntctcgccattgcaccatccatgagacgcactcttgtatagaagtaaaattgccttgctgagaaaatgtaaaaaaaaaa

SEQ ID NO: 640719 - DNA, 123 bp, Homo sapiens
taagacgactgaacagctgcttgtaatgtcctccctgtgcccggtgacaggctccagggtctggcatccctgctaagggatggattaacttccttgtcctataagtcttatagatgtcattta

SEQ ID NO: 640720 - DNA, 100 bp, Homo sapiens
agtgattaacatacattaagctttcttcgcatcaaagctaattgaaaccgtatattagtaaaattaaaggcagagctgtagcagttgaacttggagagtc

SEQ ID NO: 640721 - DNA, 1735 bp, Homo sapiens
  misc_feature (421)..(421): n is a, c, g, or t
  misc_feature (463)..(463): n is a, c, g, or t
  misc_feature (498)..(498): n is a, c, g, or t
  misc_feature (502)..(502): n is a, c, g, or t
  misc_feature (568)..(568): n is a, c, g, or t
  misc_feature (582)..(582): n is a, c, g, or t
  misc_feature (845)..(845): n is a, c, g, or t
cgacgacttgacaaccaaggccctctctctcgaaaccataccactaacgtacaccctgctaggacttgttatgaagggacatagataggtccgtatcaagacgggcaaatgcaccagtagagtagtgccgtcgttcacgacgcccgtgtgtcttcaaacgaattggaatccagtgtcatcgctgcggtcttcgaagacctattgacagtccatgtgtggcgcatgcctcgaaggtgtaacggtaccaagacttgagagcttgcataggtaggtgcatccggtgcagtgacttcaatcaggaatgtgggaactatatggtactgcgggttccgcacggaatgactagctcggggacgaaccaagggcccttgcataatgttggccgtgcacatagattggcatcgactatgaggaaatccgnagctctctcagctgagtgttgtgttgagacgcaagactcccnaggctgcagccgcttctctctgctatccggtcganttcnttgctgagcacccgttgaggatggtccttaacttgtgctctcgtgtggagcggactttccgcatgntagcgcacacgganttcttcccactaacactgttaccctgaagactcacctgctatacagtactcggggtccctggagtgttgcgagtcgcgtggttcggggcaaaaactttagcaacatggtttgaaggggtagccgtggagaatttcaatagagaagacgcaccaccaccgttggctcagaggtgactacaaccaggagtacgtggccaactcccatagggctgggcgtgccctgttcgcaaatgcaggggatgccctttcctagaggcctcgtntttgttgcggttcccccccggatatccaacacaacacgcaattctcaatcggggtgagaagactgggggcgagacaccatggtgggagacccatacctatttggtggctcttacggtgtgcggcaacacaccgacacgccaccatgacatcggaaggggttgacctgcgacaggcctttgaagttggtagggcccccgcccagccctttgccattgtagggggggggatttgaatacccccgttgaaccacttggcgccagcgcttggcgttttccaaggaaaccttacgccatgcttttctaaacctttgttgtaacccacttgtgggcgcatttctgaggaatcactctttgagggtggactatgccaggctttccccggcgatttgcgggcgttgaaggccgaatctgccaaaccttgaaatatcttacccaattgagaaaaaagcgcgatgtatatggccgttggtcctgaggccctctgtgaaaagttgcacgggggcgcccggacggataggtggaggtgacactggtcctttgcgcggtgcaatccgtttgagccaccggtgggtgttgtggccacaggggttcttttggccctggttaggcaccaggttacctgcttgggttttaaaaactgctccagtttgaaacctttaccaaaattttcccaaccaaatggtgtcaacaggggcggcctgtaaatttgagaggtcccgtccgggactcaaccacgaacaagagaagcacttaaaaggggaagagaatgcacataaaagggggaaatattgcaaggacgcccacgtgtgttgtttcaccggggtggtaaaaaacatgagacggggggtacctccaaaagacacgcgaacacgtaggaattggtcagggca

SEQ ID NO: 640722 - DNA, 158 bp, Homo sapiens
taccatcactatacaaactcatgtatggcagttgccctgttgataattccagtagcatcataataaatgtccagaagcatcagtaaaggctaactcaaaggattgttggaacgtcaaagggataagatctagcttaggactaaaggtaagtgcaggca

SEQ ID NO: 640723 - DNA, 930 bp, Homo sapiens
tacttgctgaagtcgtctttgatggtaggcggtagggtatatctagggcgtcgcgctacattctcaacctccctgaatgacgagattaccgagcgcgcttgcacttgtaactatgcgcgctaatgtagggcctaattgataacatgctgccgtcgtgcctaggatgaatcagacctagagatcgcgcattgcgtattcgtcaagtcatacaacatatggccgtcgagtaggtaacagccaatgctcatccaagatgcgctctgaaggctactagccggcgcgagtccatgacctcgagtatagtcggccactggagcgtgtaacaattccctcgaatctactagttctgacctatgcaaaacctcatagagcgaaccgaagctgctagctctagccagtcggctagtcaatagttccctcttctgcaaggtgagcttctagacatcgtactcggcactaagtaagctcctttggagtcgcacttctatgacgagggcgctcagctgagccgtcagccttaaacgccccgacgtaatgtaatccctatcgtgggcagaaactcgtctgtgtcgtagttaaccccacgttctccgtgagtcaacactactcacgtcgttggcgtaccttgacatgagatctcacaacgataactatgtcacagcaccctaatagctttcccgtctacactatttaccaataaggacaaatgggggcgcactcacccagccagatttaaacagagtagtaaagacccccggtcattcacaccggaaggaaaaactaccccttccatggtttgcattacaggctaattccccgcaagttctcctcgcttagttgccttcaaggcccggaagaattcaattaccgggctttttcccttccttatgaagaaaagacctggtggacacacaagccctggaaccgggg

SEQ ID NO: 640724 - DNA, 445 bp, Homo sapiens
  misc_feature (68)..(68): n is a, c, g, or t
atgtttcctgttgattttgatgacaggttttgggccccattggtgggactcccacaaggcgactaggnagccgaaggagagaggaggaccaaacctggtttccactccaacccctgttgctttttagctgcgcgatcctcctgtgtactccccccatgacaacttgtaaaatggagctaatggtaaagatagggctaggccgggccctgtggctcgggcctgtaacccagcattttgggaggctgaggtgggaggatcacctgaggccaggaattcgagaccggcctggccaacatggtgaaactctgtctctgctgggaatgcagaaattagccaggcatgtggcatgcacctgtgatcccagctactcgggaggccgagacacgagaatagcttgagcctgggaggcaggggctgcagggctagatcccgtctcaaaaaaaaa

SEQ ID NO: 640725 - DNA, 1371 bp, Homo sapiens
  misc_feature (446)..(446): n is a, c, g, or t
  misc_feature (725)..(725): n is a, c, g, or t
  misc_feature (1092)..(1092): n is a, c, g, or t
gctagaacgagctggaggagtctgctctaccgatacagagccttcgagtcgtccggggccgccattagcaactccacctccatccggtcttggtaaatggccttcggtcccggcctatgactgggtcccagtcgggtcagtagcaggacccccgtagaagcgcccatggagctgccccatttttcgggccccggaccaagtcgctcggatcgtctgggcgcagcgccgctcgtcatactccgtcccttcaatgacggagtttcgaagaagactggagggcggcgaggatcccttaagatccatcttttatcagatgttcgatccgagcctccattcctgaggatcgaatagacggtgtaccatcggtgcgtggcgctccggtgagagggtccgcggacagagatagacgaggaatcgcctgtcgaggagctctatacaagacgcgncatatcattcgagcggacgcgttgtctggaggactccgggcggaacgccggtcatctctttgggacagggagtcctaggttcccatcgctttagctatagcgctcggtcgctttccacgactcgcagtggcctgccggcgcaagttctttctttgcttgtccccgccggtcttgccagagcggggcccaaagcgtggtccacgggagctgcctgcacggaggaagggaccccgaaaagggaagaacttggcttatacgggtggcgccgtgcgcaaggcnacgggcgggtgttcggtctgcccttggggaaggggccccaaaggagggaaacgggcgtcccgccccaaaatttagccggggtttattgctggggagcccggggcgcgtggacgggggaaccacgaaggccaacgcggtgaactttccggcgcggtagaaagggcaagagcccggggatccctcggcgggccaacaatgcgttcgcaaacacgtggatctccccacaataaagtcccccggggggacagggggcagcacgcgggtgttcgtttcgcgacgcgggatccccccaagaaacagatcccggcggtacaagagtattcagaaagaacacccccccttcttcctgtgagagcagcagatgacnacaccataaaggctgtttttgtcgccagctgcgcggaaacacccaccgggggatactacatgcacctcgcgacggggatccatcaaacgagggagcagtaatacacgaggagggcacaaacgtgaagaaggagtgcgagcacaagactcatgatcacccaccaagatgatggactgatcacgatccagatataaccacaccgtcgtaggtgtcgagatcgtatcgactcagaacagtcacacggtcatgaagaaagccacgcgacgccttcatacgtgc

SEQ ID NO: 640726 - DNA, 251 bp, Homo sapiens
ctacgacctacttcatttggaactatgattgtggacttaccatcatacactatatggccaccatgtaggcggatgtgtagtgagcagggaagggaactttcctgccttatttaaacctgggccgaggattcgtggaatcctgcttgatcacgagactctagaggccacaaaactgcatcatactatcttggacatgcttcttgaccacgttttttattcgttggttgagtttttatcagcgcctcgagtgt

SEQ ID NO: 640727 - DNA, 91 bp, Homo sapiens
taggcacgaggttttttcttctgaacgtgtgtcaccatttattgtagtttgcgttaggaattgaacagaggacattgtctgtggggggata

SEQ ID NO: 640728 - DNA, 884 bp, Homo sapiens
attctagaggccgagccgggtgcatcatgaggtcaggagttcgaggcgagcctggcccaacatggtgaaaccctgtctctactaagagtacaaaaaattagccagtcattggtggcacacgcctgtaatctcggcatagctcaggaggctgaggcaggagaatgtgcttgaacctgtgaggaagaggttgcagtgagcatgagatcgtgcaattacatgtccagctctgggcgagaagggtgagactccatcgtcaaaagaaatcgaaaatggtgaggcattggacgcgtatatgaggtgtggctaggggtggagcgccatactaggagaaatttgcctgattgataagccttgaaggatgcttgtggggacgaagtttacacctggggctctggagtacgtggggtaatagaggtcacgaaagggaagaatgggttgttttgactcgaataaatcctatattgtaaccaatgagggaccgcaagtagaggaagcgatggcgcatagtttcgatcaaaaacgcgggtggggtaaagaaagtgggcacacgggagtaaagtgggcctcgtggtattgacagagtaggaccttagatgattgtggggctcatttatatgggttagagaaaaggggagacttttttgggagagacaacactttgggaaagtagccttcaggcggattgactaggggagaatgaggtaggtgggcaaaaagaggaaaaacgcattggtggttggcaaaagaacactctttaaaaaataagagttgggccaaaaagaggtgttgtcatgttagcttggacgtgggaaaatttttgagtattattgcagaaatcgcaagggaaggttaggagatgacaatgggccattggagcctggagg

SEQ ID NO: 640729 - DNA, 237 bp, Homo sapiens
cgatgttaaccaaatgtacaaaattcagtaatcctcagttatcaacgggataggttccaagacccccagtggatgcctgaaattggctaatgctgaaccttacatattatatgttttttctgtacatatctatgataaagtttaaattttaaatgaggtacagttacaacaataacagtaaaacaacagttataacaatttactgtaataaaagtcatgtgaatgtggtgtttctca

SEQ ID NO: 640730 - DNA, 151 bp, Homo sapiens
tagtcactgtatgtcatactgtaaaacggtttccgaaaaacaatctacttcaggatgatatttggcttattttttcctcttacatcatgctatgtgtcagtctgatcatttgacaccggaaatttcagttgttattctagctacgttttga

SEQ ID NO: 640731 - DNA, 227 bp, Homo sapiens
ggacacacccccagggtggccagcggcagagccagcagacacagcatttctccttgagcgggtcttcatctctgcccccttctcttacaaacccctaatcaaggatcttagccttaagatcttcgagggacaaagccttctcatcacaggcaacacggggcacttgcaagacctctcttgcttccgggttctaggtggccctcttggacgagtacacggggctcagt

SEQ ID NO: 640732 - DNA, 733 bp, Homo sapiens
tagttcgtgacatcacagtgccaagtaggaaggggcccctaggataggaagcgaccacgtgggaaccagagcctgatattgtggttcctgtggggaaggcagggtaagcagatttggattggctggctgcaggagttgcagaggactcaggtatcggggctatctctagttgtcttgtacctggtcctgggatgatgaaggcagaggactgctgccttctggagtgtaaaaggcaggagtagaagaggtgattctcagtgtgggatctggattgttaaggtatgtatgaaacgatgtgctcctgggtgagtggtttgctgtctcttcaaggaactggctagacctgggggaggggcagtttctccaccagttcagtgaggcccagatggcagagctcagaaatatagaaccatgaatgacaaacttaccggttggggcgcggtggcttatgcctgtagtcccaggcaccttgggaggctgaaggtgagccgggtcactgaggtcaggagatcgagaccattctggcccaagactggttgaaaccccgtctctgttagatatacaatgattggtgggtgtggtggcacgcaccgtgtagtcccgggctgtcttgggaggctgaagcaggagagcgttgagccggaggcggaggttcggtgaggcagacaggatcggcatggcgtcaggctgggatacaccagatctgcgtcccagacaaaaactccatcccacc

SEQ ID NO: 640733 - DNA, 1622 bp, Homo sapiens
  misc_feature (1243)..(1243): n is a, c, g, or t
taattttaccaaaagggtaggccccgtttataaaagtcacaccaaactgactatctcagggtgactcaagaaccacaaaaaacccatttctccttcacttctggagtccgggggtaaatacctaaaccaagcaagtggtcacgtggcgtgggggtccattcacagggtttacaatgtttttcattggaggtgcaatctggggactggggtggatggttggccagggtagggtcaccactcaaagagggtcatatggaatgtgtgggcgtggtgggacgcattgggtcctcaaagagtcactcgggagaaacttatttatcggagatacttggtgttaaaccagggcctcactcaaagagaagcgcggcgccacgaggatattgtggtcagagtgtgaaacacccttgtctccgagaaagagaataacactctcctcgaggacatatttgtggaaacaagggtggatacttcgaggggggcactcgcgtggagagtggcaaggcgtgagtgtgccctctctctaaatgtgagtgcgtgtgccagaggtttccactgtgtgagagagagtctcccaaatctcacccctccgtgggtgggggggggctataaagagcaacgagggtatcatcatcaaggggggatatccgagaggtgttccaaaacctgcgcggaaagagtgcagatatactacacgaggtgtgttgccgaaatagaacataaacggcgcagattaatataatttcaccaagctgtgggtaccgagagacagaggggcggttcggaaaacatcctaattaacaaatcatcccccccaagggagggttcaccctacctccacaggagggaaatcttcaccccaaaatatacaacagacagggtgggcgtagaaaaacggaataaagggaaccatatggaggagaataggaccaaccaaatagaggcgagcgaacgccgctaatctgcggaggagaaacactgttgtggtgttggttccctccacccacggtcttggaagggtggtgctgaggccacataggacggaggactcagtgaggagagggggacccctcctcaagcagaagaagagacgaaaacacaaaactcccacatggtggacgactccacgaggcacaagaagaagagtgtggtctcccatagaacgaaagaagtgtcatcattgggagcccccaccgagatcaagatacgtgataaaaccacaagccccccacgaggaaaatggaangcgctccccttcggcggcgacgacaaacaacctctataaacaagagggagcaaggatgacaacacaacacgaaaatatctccgtactaggcaaggaaaaaatgtctcccagtgaggccaacaacacgggccccaattaaacacacttacgagagacaccaaacgagagtgaggcgggggcagctaggaaaaaaaagcgaacacaggaggggaaggacgccccacacagtgagatgggatgtgggtcggcggcagagcagaggtatccctcaaaagagggaggctcccgacgaaaagctgagtaagagagacccaccgtgcgagtgagctctcccgaagagagcacacaaaggaggacgcgaagcagcacagagtgatgg

SEQ ID NO: 640734 - DNA, 118 bp, Homo sapiens
agtcaactgcaaaaggtcaggttggaagctgtagggaacatcgccaataagcccacctactttgacatctatatggcagtgagctggtgtggttgacattggtgtggaggtggaagat

SEQ ID NO: 640735 - DNA, 227 bp, Homo sapiens
  misc_feature (5)..(5): n is a, c, g, or t
ggtangatgaagacaagtaggttacagagtacaaacatatagttagatataattgaaattcaatgtttgatagcagagtagggtgactacagttaacaaaatcatagctgggtgatggacactctaaatactctgacttgatcacgatacattatatacatgcaacaaaattttacatgcaacctatcaatatgtacaaatttttctaaaaagctcagcaaactgga

SEQ ID NO: 640736 - DNA, 128 bp, Homo sapiens
gcaaaaattagcttggcatgattgttggtaccttaattccagctacggtaggcttaggcaagagaatcacttaaccccggaggcagagcttttagtgagcccagagtttcgccacttaactccagcct

SEQ ID NO: 640737 - DNA, 107 bp, Homo sapiens
  misc_feature (77)..(77): n is a, c, g, or t
  misc_feature (107)..(107): n is a, c, g, or t
gatcaccatggcggctgggacctgtacacgtatcctgaaactggagggccttcaagacgtctacatcgctgctcagntacagcgggggctcaggtaccggggctctn

SEQ ID NO: 640738 - DNA, 140 bp, Homo sapiens
tgctcatagaggatcccatcgccaacaccagcctcctttctgcctgccttctacctgatcccaccttcagcgactgtctacctgcccatgctggagaagtagctaggtatcccacctacagtgccagtgctatacccagg

SEQ ID NO: 640739 - DNA, 863 bp, Homo sapiens
  misc_feature (506)..(506): n is a, c, g, or t
  misc_feature (594)..(594): n is a, c, g, or t
cacggtgggtcacgcctgtaatcccagcacttgggaggccgaggcgggcggatcacctggggtgaggagttcgagaccaccctgaccggcatggtgaaatccatctctgctaaaaatacaaaaaaaaatgtggccgagcctggtggcgcacgcctgtgatctcagcctcccgagtggctgggattataggcatgagccaccatgccagctaattttgtatttttagtagagacggagtttcaccatgatggccaggctgggtaatgatctgtgggatgtggcatgtctgtttctggtagcatttttctattattatgtgtgctgtccatgtgtttgagatgttattgaatgcttgattatagctacatacattggttgagtcgcatttatgtggtcttctaaggggtgttgggaatacatgccaagcgtctataaagatgcattgattggatgtgtgtgtagaaactctttaggcattcatttcaaatggtctgagactacatatnattagtcccttgatttttctggcagttgttcaaaaaagaatatattttcatcaagtacatgtggagtgtgtctggtaatcggtgattnaggtatgagttggcattgttggatatctatgtattcgaggctcaggaatttttacggtggctttagtacgagtggtaggaacagaagtagtagtagtagtagttgttgtatctgttatatcccttttatattctaaaatatcttaggctgcgtgcattgcctcacacctataatcccagcacttcggaaggtcaaggcgggaggatgacttgagaccagcaacatagggagaccccatcactacaaaaaaagtcgacgcggccgcgaat

SEQ ID NO: 640740 - DNA, 546 bp, Homo sapiens
  misc_feature (358)..(358): n is a, c, g, or t
  misc_feature (492)..(492): n is a, c, g, or t
  misc_feature (520)..(520): n is a, c, g, or t
cacgaggcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgttttgttttgttgttgttgttgttgttgtttttgagacagtcttgctctgtcacccangctgggagtgcagtggcatgatctctgcaacctctacctcccaggttcaagcaattcttgtgcctcagcctcccaagtaactgggactacaggtgcacgctaccacacctggctgattttttttgttttagtanagacagggtttcaaccatgttgcccaangttggtctcaaactcctgagctcagg

SEQ ID NO: 640741 - DNA, 128 bp, Homo sapiens
acatgcagcagcagtagtatggcagcggcagaagatattaacttaggaaacaaagctatagcaggagaggagagccagagcaagtgacagggcaagctacaggttacaacagatattgtcgaactaca

SEQ ID NO: 640742 - DNA, 339 bp, Homo sapiens
atgagctgaaattgtaacttatgtttaaaagggaagcagagcatataagttaaaaaaaaattgcagcttggccatgtggtagaaaagaaaaacccattttatggggagaaattcaagctcgctgcagaaatcttcttaagtaatgaggagctaaatattggcaagacaatggggatgacttcaggccatttcagagatcttcaaggaagcctcttccatcacaagcctggatatctaggaggaatggttttgtgggccaggctcagagccccactggtctgtgcagcctcgacagggtgacctgtattggtgttgcttcagctccacccatgggtcctt

SEQ ID NO: 640743 - DNA, 1055 bp, Homo sapiens
  misc_feature (240)..(240): n is a, c, g, or t
  misc_feature (271)..(271): n is a, c, g, or t
  misc_feature (335)..(335): n is a, c, g, or t
  misc_feature (337)..(337): n is a, c, g, or t
  misc_feature (351)..(351): n is a, c, g, or t
  misc_feature (373)..(374): n is a, c, g, or t
  misc_feature (396)..(396): n is a, c, g, or t
  misc_feature (422)..(422): n is a, c, g, or t
  misc_feature (432)..(432): n is a, c, g, or t
  misc_feature (491)..(491): n is a, c, g, or t
  misc_feature (512)..(512): n is a, c, g, or t
  misc_feature (514)..(514): n is a, c, g, or t
  misc_feature (549)..(549): n is a, c, g, or t
  misc_feature (580)..(580): n is a, c, g, or t
  misc_feature (622)..(622): n is a, c, g, or t
gcttccctgcgccaaagtgagccagtcagcccaaccatgctcagggatgggcagtccatcattcacaaacaccgcagggcgatgaagaagcagaggaagaacaagaagagcaaccttgaagccaagtggcagactatcacaatcttcaggaagcagcatagtttgatttttttggttgatgcctccaaggctatgtttgaatctcagagtgaagatgagttgacaccttttgacatgagncatccagtgtatccaaagtgtgtacatcagntaagatcataagcagtgatcgagatctcttggctgtggtgttctatggtaccgagaaagacaananattcagctgaattntaaaaatatttacgtcttacanngagctggataatccaggtgcanaacgaattctagagcttgaccagttnaaggggcagnagggacaaaaacgtttccaagacatgatgggccacggatctgactactcactcagtgangtgctgtgggtctgtgccaancntctttagtgatgtccaattcaagatgagtcataangaggatcatgctgttcaccaatgaagacaanccccatggcaatgacagtgccaaagccagccgggccaggaanaaagccggtgatctccgagatacaggcatcttccttgacttgatgcacctgaagaaactgggggctttgacatatccttgttctacagagatattcagacacgcatagcaagacggcatgaagagaccccaagggatcaacagagagagaaatacaagcacaggctagaagaccctgtgcgcagaaggaccagaccacaggagaacccaaggaacaagcgaacaccataacgcacagggtacaacggctgaaacgcctcaaacgaccgcatacagcagaaaccacgagggacaattaatacaccgtggcccaacaaagggaccaaagacatcataccagataacgcactactcaggaaaacacactgacacagcggcacaccaataccggaccttatagacagtacagacggctgcacaacaaacagcaacag

SEQ ID NO: 640744 - DNA, 595 bp, Homo sapiens
acattagttctgagatagcgaaaaaagacgcaggattcccacagaagagaacctgggaagatggtatgggccttggccagtggagtaggatttaagcagagaacgggggtgaccggacaggagagaaggtgacccagtgcatatgggaaaggctggatcgcagctccggacaccaggtcggtctcttggttctccaggctaattcctcatggcaaagcaccctattgtggaggaggcaatattaagggaaatccagacggtaatgggtggagagagacataaagatggatgatatacaaaatttaagggtgagggaaactttcatttatgagagcatgcggtaccagccggtcgggtcctgggtcaggcgcaaagccttagaagatgatgtaatcgagggcaacccagtgaaaagggggacaaacataatcctgaatatgggagggatgcacagactcgagttttcccccaaacccattgaatttactctggacaatatggcaaagtatgtcccttaataggtacttccagccattgggctatgggcccgggggctgtgcagagaagtacatcggcatggtgatgatgaaagcat

SEQ ID NO: 640745 - DNA, 893 bp, Homo sapiens
gggagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagcccgggagtccatgatgcatgtcacgtctgggtcgcgcggctggagacccgggactgcggagaagccggatcgtttccccctggaactttctctctcatgattgtgtggatcagcaggcgctcagaagcctgtgcgtgcttatcccggcgggaatgggggacacgctgcgtgtgtccctcccctcgttttgcaaagtctacggccaggattgtggatttcggagcctcggtgggggaggtgttcaaggctggtggcaggtgctcctggaaacttggggaggaagcttgcagccctgccattttttcctcccgaggattcaaagcccggcacctccggggtgggtggggagaggaaagcttaattgatctcttttattaataaagcgactgaataagtccacgcctcccaggcggtcggtttcactggacaagggcttttgtctttaccttcacctctcttctttccgtgtcttccattccccccttttgaaacagtccttgctaaattaactgcctagtcctctctcgaccgagccacgctcgggtcctatgggattgttggtctgcca

SEQ ID NO: 640746 - DNA, 720 bp, Homo sapiens
gggagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgagcccgggagtccatgatgcatgtcacgtctgggtcgcgcggctggagacccgggactgcggagaagccggatcgtttccccctggaactttctctctcatgattgtgtggatcagcaggcgctcagaagcctgtgcgtgcttatcccggcgggaatgggggacacgctgcgtgtgtccctcccctcgttttgcaaagtctacggccaggattgtggatttcggagcctcggtgggggaggtgttcaaggctggtggcaggtgctcctggaaacttggggaggaagcttgcagccctgccattttttcctcccgaggattcaaagcccggcacctccggggtgggtggggagaggaaagcttaattgatctcttttattaataaagcgactgaataag

SEQ ID NO: 640747 - DNA, 275 bp, Homo sapiens
cagtggctcatgcctgtaatcccagcattttggtaggccaaggcaggaggattgcttgagcccaggaattcaagatcagcctgggcaatatagggaaacctcatctttacaaaaaattgaaaaagtagctgagtgtggtggcgtgcatctgtagtcccccctactttggaggccaaggtgggaaaatcatttgcgcccagcgggtgggggttacaatgagccaagatcatgcccctgccctccagcctgggtgacaaagtgacactcctgtctca

SEQ ID NO: 640748 - DNA, 828 bp, Homo sapiens
ggcgctgccgtaaatcaggcggtctgctcgccgcatcacgcaagatggcgcgccgcggcggtgaacggggcggcaggcttctcgaagctccgggcccgcggcaacctcgggcgctgtcctgcagagccgcgaccggccatgtcaccgacgccaactcaaggcgcgagtgggacaccgtcaaaaaagccccaatctttaggccacgctcgcggcgccacacagctgcgcgtccgactcaagcgaagtgtcttcctggaagctcaacttcccttgcccaacacacaggggacccaagcctgacccaaaccagcagcataaatttcctggccccgcttgcacacatacctgggacgactcgtggggcccccaaattcggacgacagtaccttaacgacaaggacaaccattcccccgcgataccttgtaccgaaggccggcctaccactggcggcccccaggctatccaaacagttgcataacactaaccttctctcgcacttacaacccacaacggggaagaccaagaccatccccccccgcgccaaggttttccgagcggcccctgcagttaagttgccgaagcgcaaagcgctattccgtttctggcgaggcccccgttcaacaaccgcaaattccacgatccgatcatcccctcgtggtccgattggcttacccgcacctacgataaaaaccaccggagagaactggccccatggtaatgactgtatcgcacccaagccagcgcaacccttgggagcaatcgaccgcgcgcgctgtctggtgccctcttgggggccccccaaaagggagggggtaagcacaagtata

SEQ ID NO: 640749 - DNA, 1286 bp, Homo sapiens
gagagcgcgcgaggttcggggagctccgccaggctgctggtacctgcgtccgcccggcgagcaggacaggctgctttggtttgtgacctccacggccaggacggccatcctcatccagcaatgcaagcatcttactctgccagctgactgcctggcctgaccctctctgggctgctggagccgagcccagcctcgcatgactgatgcatatcatccctgacttgaacaaccacgcacagcacgcaactcctgctacatgccctgcaacgccgacccacatctgacctcccgcacccacgcgaccaacctacctcgcgctgcccctgctgctacctgccctcagctgccctgcgccactcggcgcacatcctcgctgcaccaactcccgcgcccacagccccctgcgcccaagcaaccctgcctctccccacagggacacatgccgcaccaatcccccagcccacgggcacgaactccaccaactcgcatcagacgctcgctgccgcctcacaccaactagagcgccacctccaccgcacatggcacttgccgccaacgcacgccgtacaccctctgccgaccaccccaccactcacaagctcgccgtcggcccgcgactgcgcccgcgcgcccctagcccacgaagcagccaaaaaaccaccccagcgctcaaatcaaccaccattggaccacttgacgagcgcatagacaccggagcggacactcgagcacatgaacccacagcaaccgccccagtctgtccttgctacccggcagacacccaacatggacactggcgcggagacatacaccagggcgaacacccaccctatcaaccgcaagagccacccagacacacccccgatgggcacagaccacctaccagcgaacctcgccccgaacaaagcgcccatccacgccgcgccacacccgccaccaccgcgcccccccacggccccccccctcccaccatcggcggcctccaccccaacacgcgcacgcaccaaccgggcaccctgcgccccacccacagcgcaccgtcacccgacaagacggcgctgacacctggaaacacaaagagcaagacccccacctcgcacgaacacccacacggcgcaaccataggaacaccagaatcaacacgcatggacaacaacactaaacaacacaaagaacaccaaaacgccctcacaccgagcaccagcaaatgccaagacgagacacaatggaacgcacacacagaatgacaacagatacacaccacaagcacacccctcaccacccaa

SEQ ID NO: 640750 - DNA, 458 bp, Homo sapiens
agaggatccccctcctggacttaagagagaactgctgctatgaggactgtgctttgctgtgtgggacggtgatctgggcggccaggcgacatctcatcggcagcactttgtcctgcttcatcgcccctccccctgggtggagcgcctacccgagagatcatccgtgcacacgacatggacttcactgacatcatcaagtttttcaatgaacgtgctgagcttcacgatgcccaggagatcctgcggattgcccgggacctcgtccactacgtgcagatgctcattgagaacaagtgagctggggccagtgatgccgcagtcgtgctgcagcctgggctccggcagggagaggtgcatgggagtcaccgcccagacctccccagtctgcatccgagcccacctctgttcctaacaaagcggttgttagccttgatcctttagctcctgcgggtcccgcg

SEQ ID NO: 640751 - DNA, 1010 bp, Homo sapiens
agttgtcgggatcccgcaagatgagtgctgcagagagttcacccgcatagtgggagggtgtgagcttacccataatgatcatgtgatgataatggcggaattgctgagagtttgagggctaattgatgcctagagtatgccgcgaagggtggcgggcaggctgccacaccagacgtaggctcagaatgcgggagagccgcaggtaggggccaataaaaacgaatgggacatgcctgcgccgttcagcgcgacagagacgcgctgacaaggcctgcaacaggagaacccagcgaagaaaccagagaactgagttagaaatgccgtccttgtaagtcttgtaatggtgagacggttcgacgagtgccaccagcttgatcaccgggatatcctgtatatgcactggccgattggaggccccgcactatcttgcatactctcgaccgtttggtacatcaggtttatcacaagggcatcgcacgtccttcccgcttttgggtgctcccatgttagctggtgacaatcggtgcctaagttccgcggaagtatagtacggatagaactctgcctggtatgagtgttctaaagtgtttccggtgacaattgtttaacctgttcgctgacggtttgatacggatacagtatgacatggataattataacaaggttgaatatgaaaggtaacgtgagaatggcctagcggtggtacatcgagcaacagagttgtgcctatcctcgtgccacgggtgtaatttggtactgtgctctcgtgctaggcctccgacgagagacctagcccctttgatgtggatattattcgtcggagttttacatgaagtcccattatggcggttcattagtgacaccacctataggttaatagcaaggttatcgtatgtgccgggtccggccgagcggttgaactcaggaattatttataaggccggattgcgacctacggtgtgagtggactagatggtgtatagtatttcgtgtgtatgagaggatacctg

SEQ ID NO: 640752 - DNA, 646 bp, Homo sapiens
ggcagtgaccgagcttatacccatcgctatgccgatggcagcgacggtcggcagcgtcgacgacaacgggtggatcgcctcggcgacgacgagaacggctatgtgacccgctacggctacgacgtgatgggccgcattgcgagcatcgcctatcccgacggcgacagcagggcctggaacgccaccacgcagagcttccagcaggtcgcaggtaccgaatacgggctgggcgccgggcattggcggcagaccgtggccaccggcaacgcgcgcaaggagacgtatttcgacgccttctggcagccgatcgtgacgcgcgagtacgaccttgccgcggtgggtgcgacccagcggttccagcgcttcgcctacgaccatgcgggacgccaggtgttcgcctcctacgcaggtgccaacgacgcgctcagtaccggcgtatggaccggctacgacgcactgggccggactacgtcggtctcgcaggacagcgagctggggctgctgacgaccctgaccgactatctggcgggcaaccggacccgcgtgaccggcccgcggggccaacagacgctgaccagctaccaggccttcgaccaacccgtctatgacgcgccggtggcgatccagcatccggagggcgcattcc

SEQ ID NO: 640753 - DNA, 1043 bp, Homo sapiens
  misc_feature (442)..(442): n is a, c, g, or t
  misc_feature (797)..(797): n is a, c, g, or t
agcggaggggcgggagggccgggcgccagagcagcggggccagagcagctgcaccatcccggcgttcgccgtgtgccgccgcatgtcctcctccatctcttttcctccgcctccgtccggcgcgatggcgatagccgatgactggactagcgagaagcggaaggcgagatcaggcgtgcgcggccctggacggggcataagcagatcgtggaccagaagggtgacggaacgagcgtatcaaaccgtgcactgagcgagtcttacagcatggatcataaggatccggatactgctggcacacgcctctcgtcgatcttacgttctggctgtcagcatggtcggcatcagctgggtgcggcggactcatcgcattgcttggagccccgtcgtgagaatcgcgtaacagcatccgagacaatatatcgtaacagagccgtcggancaccccagaaggcgcagtctaagttaatctgtatccactgtgagaatttcatacaggtgggaggtacagccagcagacgtgacaagaaagcaaacggaatggcgtggaaacctgtgaggtccatgtcaagaatagtggccttgacggaatgtaaatgccgccattcattaatcgaaagataagtgtgcgctctaaggacctatgcgtacgcgcaaacttctggatggtacgtaatacggaaatcaaaaggatttgcgtatgcgtctctctgtgtgggacattgggaacggccattgagcgagaagggcgtagtgtccacgccggatgattatgtccccttattgtaagcgttccnaataagctgcgtgaaccccatttagggggccccttgggaccgacgacgattaaggcaggctttcattggagaaaattgcccggccgtaaatggcaaactattgcggcggaatttacatgtgaaactccagtgcaaacggaataaggtacacaatctgggcctaggggccagccgtttcaacacgggaacgggccccggattagatccttgggacttggttggctttgcaagagtattacccctgca

SEQ ID NO: 640754 - DNA, 167 bp, Homo sapiens
  misc_feature (8)..(8): n is a, c, g, or t
gagagtantcggatgctacgcctatgacaggtgcacccattaatggaagagatgttatgttccccacctcctccccactaatgcactaaaaagctgcagtgatagggaaaaaattttagggtaggtgtgaagaaattagtaacttgacccctctatcccagccaaac

SEQ ID NO: 640755 - DNA, 209 bp, Homo sapiens
agaaaggaagaaaacccccaagatttttaaaaggattcatagcaccataatgggtccctgagtaaaggatgctgctatgggtgggttcatggccccaagttgatttcatggtttttagaattataattatggattttttttttttcatgggggggggtttttaaaaatataaaaattaggaggccttttttaagccctgtttttcccca

SEQ ID NO: 640756 - DNA, 1602 bp, Homo sapiens
  misc_feature (313)..(313): n is a, c, g, or t
  misc_feature (452)..(452): n is a, c, g, or t
  misc_feature (598)..(599): n is a, c, g, or t
  misc_feature (1163)..(1163): n is a, c, g, or t
tgggtataaaaagttttttatttcaaaatgcaaaaggggtggctcattgtgtaattaatttaattaattaattaacattaaaaagcattttactcctttccctcccttagtgtgcaaaagtggtagacgcattttagaataatttcacacaggtgttgtggaaatgtgtcagtgacaatgtgcagtgtgcgtgcacagacaccaaacacctcaatctccacaaacctccttgtgggtgtggatgtgcttgtggtggatgaggctcagttctcataaagtgtctcagggagtttctcctcgtgagagttataangtctcacaaatatacaaaacacagcgacagcggtgtgctctcctgtgcgactctctctccacaggcggagaggtctcagagggctctctctgtgtgtgcgcgcgcgcgctgcccctctctctgtgtgtctctctctccncattctcctcttatctctcgaggcgtctgtgctcttctctccacaggggcggttcccgggacctataggtcctctatagaagatctcgcgcgagagacgcggggggcgcggctctctatagagagagatatctccccctctcgagnnaggggggcccccaaagcgctatatagcgcgctggtataccccgagggctttttctcgttgtgtctacccacacagggcggtgcgctcccctatatatagcgggaggatgttgcggtaatattatataaagggcttaaagcgcgccatcttggcggcgcgtgtgcgtgtctttctacaccaaccgtggttccgtagtgagcattctgggggcagaacacaacatctggcgtctaaacgcctttgaggggcatccatttgtcggtcgagaaaggggagacacctctttaaaatcttcccttgggggggtgtgggtgcgaaccctaatcaaatatctggggcgcacccaatatataaactcctaaaacgagagaagaaattttaaaaaagaaggacttctaaaacgaggcgttgcaacaatcttctattcaacacccacatatttcttctcaccagcagggtgtggttccctcccacgttgcgtgtggttttcaacacaatcttgaagggttgttgggccatttatattagggcttatgggactaggattttgtgaacagaaacagnttttaagcggacataacaaaggcgggggaaaggtataaatggaggcacatttctcttcgttgggaacacccacatctcttcttttttacactcgcagcacgaggagttggtctgctgaatcattacattaatcaaacaaacaaggggaggcggccagagcacggctggcacacagacagccagaagacgacgtaggagagagcgagcgacagggagcagcggaggacgacggaagccagcgcaacaggagagacgcgcggacgcacggatcaagcagtcgaggcgccgaaacgcgtcgcacagagagagatagagagcgaggggagagaagcacacagaacgaagggtggagaccgacggaacggagcaccacagcacacaccagacgaacaacaactaccagcgcacgaggagagcgagactgaggcaagcaaatgaa

SEQ ID NO: 640757 - DNA, 335 bp, Homo sapiens
  misc_feature (40)..(40): n is a, c, g, or t
  misc_feature (68)..(68): n is a, c, g, or t
  misc_feature (70)..(70): n is a, c, g, or t
  misc_feature (91)..(91): n is a, c, g, or t
  misc_feature (97)..(97): n is a, c, g, or t
  misc_feature (102)..(102): n is a, c, g, or t
  misc_feature (247)..(247): n is a, c, g, or t
  misc_feature (262)..(262): n is a, c, g, or t
  misc_feature (331)..(331): n is a, c, g, or t
ctggttgcagttgaaatgtacctgaaatgtagtcctctgntccttgtaagttcagttgtacttgtccngnacatcttctttgtgtacttgntacggntactngtcagaaaaggtcatttttcaaaagccataggctttttccttgtcccttagtctgtaataatgcatctgattttgatttcctccagagctgtgtttctgtccatcacctgtgtattggccctgtgtttaccactctggcccactnctcacccccttgctnccctggtcttctggagtttgtgacattgatttgaaatggattgggttctcttgagagcaagtgagattnttag

SEQ ID NO: 640758 - DNA, 468 bp, Homo sapiens
atgggagacccagtgctagaggcagtggttcaccctgaggtcaggagttctagaccagcctgaccaatatggtgaaaccctgtctctactaaaaatacaaaaattagccaggcatggtggtgggcaattgtaatcctagctactcgggaggctgaggcaggagaatcacttgaacctgggaggcggaggttgtggtgagccgagatcacgccactgtactccagcctgggcaacaagagtgaaactctgtctcaaaaaaaaaaaaaaaaaaaaaaaaaaggaaggggggggtccaacaaggggccgggggcccccaggggggatccaggggggacggaagaagggaaaacacccgtgggggggacgcggctttgggatttccagagattaaggtcccaaaaattatgaggtatcttttttgggagagaagtggctttttctcgtgtaaacatttccagtcttccaaag

SEQ ID NO: 640759 - DNA, 306 bp, Homo sapiens
tcaggtctgataagtaaacttttaacaaactcttctataatggccttgaaaaatataggactaagtcccagcgcgctggctcacgcctgtaatcccagcactttgggtttctgaggttggaggattgcttgagcccaggagttcaaggccagcctgggcaacatagtgagccccatctctacaaaaaattaattacctggctgtggtggagtgtgcctgtagtcctagctacttgggaggctaaggtcagaggattgttggagtccaggagttcaaggctgcagtgagctatgatctcaccactat

SEQ ID NO: 640760 - DNA, 124 bp, Homo sapiens
ccaccggcaggttgtactcatggactcactgagccagcaattcaactcataggtgtatatccacggaattgaaaacaggtattcaaacaaatgactaggtacccgacatgtcccaggcaacatc

SEQ ID NO: 640761 - DNA, 214 bp, Homo sapiens
agtactgtgtatctattctgagagacaggaggcttctactttgcagacaaaaaaccctacctaaaagtctggctggtcttgagccttgttagacgggatctgaggagtaacataaagccagatcacgagatggctcatactgggattatcaggtttgtcttaaaagttctttatattgggccaggcatggtggctcatgcctgtaatcccagca

SEQ ID NO: 640762 - DNA, 310 bp, Homo sapiens
attggcctgtgtcccagttgtgttatttttcagggaaaatcttccctttggattgagaaagcttacccagtgcctgtgccatcactgtaacttgaaagaaaagaattgtcttttacattcagggactcataggcagaagagattgcagccttgtcttggatgagacttgaacttactacatttgagttactgctggaatgagttaagacttttggaaacttttgaaaaggcatgtttgtatttttctgtgtgagaaggacatgagatgtgggggagggatcagcccccaaagaaatgggggtgcatgctg

SEQ ID NO: 640763 - DNA, 155 bp, Homo sapiens
ctttttaaggaacggggcctcaaactgtaatgggggaaaaacccgttttcgggaaaagggccctaacgaaacccttgccttaaaagagttttggggccaaagcgccccaataataaacccaaccttaagggtgccccgatattcagcttaacggg

SEQ ID NO: 640764 - DNA, 157 bp, Homo sapiens
gcccaaaaaggttatgggggggaaagtttccccaatagggttttttttttggggtccttggggccgggttcccctttttaaaattttcaggcgggtttgggggggggggattttttgggggtgggggggtcaaaaaagggtttaaaattgcctttta

SEQ ID NO: 640765 - DNA, 202 bp, Homo sapiens
cagtttacaacagctcaaggaatagtatgctctaacaaaaaacttcaactgtggcattggcctgaggatcaggcagcaaggaaactgatgttagatgctagaaacatgacgatgcagagaacaatattattatataaaacttaacgtgcagtaacttggaaggcaagtaatatatttaatgcatttgaagctttgtaactgg

SEQ ID NO: 640766 - DNA, 235 bp, Homo sapiens
tggcctccgagcagcagcgcttacctgggtacagtgtgcccggaaggcccatgctttccaagtagttgtggcagcgctctttatgttcctctaaagagcttcgctgtttatagcttcggccacaatatccacatttgtgaggtttaccaactgcagaaaacacaattgagttcaagaccccaattaaatgccagccttctgtgtaaggggaatgcatgcaatacaattattacca

SEQ ID NO: 640767 - DNA, 132 bp, Homo sapiens
cgggggtgcctccccctggcacccggacaccagggattcgaaccagtactctgacggacggccagagactgaccgcggcccgggcggcggggggcgcctgtgaacccgggctgcggttcatgacgcggccgc

SEQ ID NO: 640768 - DNA, 394 bp, Homo sapiens
cggcatgggaaagtgccttgaaaagaatggtaatatatgatgtgggtatgcctccgtattgattaagaaggggacagacttaccttccactgtgatgagttacctgaagctcggcatccgttatggtctgcggcgcttccgaggcgattgggcagcgtcagtcttcagccactaagctaagaagatctgggaaggaatcagagagccttgggccaagagttccaggggctctggaaattggtaccaggtgagttgaaaccagtccctgattttcaggtggggtcccgcacagacgtggacacagcttaaggagggaatcctggggctgtcggcatttcctttgtggcttggggggccagaattttttgggaccttggtatgccaagctccctgg

SEQ ID NO: 640769 - DNA, 325 bp, Homo sapiens
agacatgatacaatcgagctcggtaccgtgcgatcttccgccagacacaggatgggctggttcccgggacgtttgcccgaatggagatctccgcagcgggtggggaacggctcgtctgtgcccacgcaagcgatcctacggcgtggcgaattgaccgcagtctatgtcgaaaccgccaacggttggcgcttgcgccaggttcgcctgggggatcgcgtcgatcaggagcacgttcaggttctggctgggctcgcagctggggaccgtgttgcgctcgacccggtgaaagcaggattgatcgcggcacaagcggcgcgcggcgacg

SEQ ID NO: 640770 - DNA, 207 bp, Homo sapiens
tcgactcagaggatcagctctaatttcttttgacttgcgggcagcgaaagccaccaaagcaataaatgcgatttttttcatggtaatcattaattagaaatataaaactaataaaaaagtccccaatctcaacagtgctgttgggaatggggacctattatttcagaagtacttaattacttgatttctactgatccctagagtcga

SEQ ID NO: 640771 - DNA, 506 bp, Homo sapiens
gggttgaggaaacgggtatttcgatgtctcgagggagtaggttggtgcagttacgagcttttctgttgggtatgcataagttaataattggagctgccaggcagatcgtgacaagagatggacggtcagaggaacgattggaaggacaagggttgttgacctgcctgtactggatgagacattaagaagactggacgtggtgttaggtgccagcctattcctgctgctttcattgacagtattcagcatggtgagcgtaccagcgctacatggccttggtcccatgctgctctgtgacccatcagcttgaggatatacaagggtgtgatccgagctatccagaaatcagatgaaggccacccattcagggcatatctggaatctgaagtcggtatatctgaggagctggttcagaagtacagtcatcctgctcttggtcatgtgaactgcacgataaaggacctcaggcgcctcttcttagttgatgatgtagttgattctctggc

SEQ ID NO: 640772 - DNA, 729 bp, Homo sapiens
ccagctactcaggaggctgaggcaggagaatcgtttgaacccaggaggcagaggttgcagtgagccgagatcacaccactgcactccaacctgggtgacagagcaagactccatcaaaaaaaaaaaaaaatttaaaaaattaaacacaaaaaagggatcttccggggctatccatcagggaccctaggaatggcttttaaaacttggccctggggtattttaccctgttggacgaatgaagggcctatggagggctattcttctggccgggttggcctttcaaacctccttcaaggggtagttccttaaacaggtggtgtttacttaggaagacctcaaaggttacaaccttttaggttactcccaatttttacttggaggcctggagcgcactctggttttcccatggttggacgggtagttggcggccttccccattggtgccccaccggcggacagaactagggttggtggtggtccaggtcccatgcataccctggtaccccagttcctaagaagggtaccgggcggaatccttccctgggttgggacttcataagtttaacgttgggggacctctcctggaaatagggacgacagagagcgctgagcttttttatttagcatgtgcattctacaacggcatgatctcggcgcgtgcgactacatgtgctgacacaatggttgcgcgttcacataaccaacttgctctcacccattgggttttca

SEQ ID NO: 640773 - DNA, 534 bp, Homo sapiens
tatagaggcggggggccccgggcgaggggcggcagggtgtcgggactgacctggctccggcctcgtcgtgaaaccagcgcatctccccgctgtatgcttcctcccacagaacccgtcgggcctcagagcgtcggtgagatgctggccgctgctgctgctgctacccatgtgctgggccgggaggtcaagaggccccggggcgtctccctcaccaacatcactctacgagagtccaagcctcacctgcctggacggtcggccaaccatcccattttgatcaggtcaaagatgactaattgcgattgcaaagattgctctgaccgagccaggcacggttgcctgtctaattggcaaacttccactgcaccaacaactgggttataaagccccttgttttattcccctccaaacgtggttaaaggatagtgttttgtgactttctgcggattggaacagacagagtacaacatgggcgtaattttgtggagaaacaccttgcaaaagaagaaggtgccgtaacggagagagaagtcc

SEQ ID NO: 640774 - DNA, 442 bp, Homo sapiens
agaggagttcagcggtgccctgagaacagctcggtacagcagtgtaatggaagcgatatcgaaacgcttcaaatcccaaaccgatcagctagctgctgatttaggccggataaatcttaaaagatcctgataccttcatccagcatggcatccatgatgggttcgactgttcaccttgtgatcaaaatggcagacccgagctcagggccagtccacgcagactagcaatgccgcgggaactaccagtacctcggcgtcaactcccaggagtaactccagagctatttccacaaattgcaacccgttagggttgcggagcctgggaggacttggaggccttaggagcctgggcttgagctcgaccaaattctctgagctccagaggcagatgcaagagcagtttatgggcagccctgagataatgatccaaataatggccaat

SEQ ID NO: 640775 - DNA, 144 bp, Homo sapiens
tgttatgtcccaactaggtcagaaggctggaggtgggagaatcaccgtgaacctgggaggtggaggccgcagtgagccacatgtgcctggctacttacagtataattagtagagacaggtttcgcgagccaccattgataggcc

SEQ ID NO: 640776 - DNA, 1362 bp, Homo sapiens
  misc_feature (516)..(516): n is a, c, g, or t
  misc_feature (1310)..(1310): n is a, c, g, or t
aatctaactggtgacacgttatcagcaaacggcgggattcatctcagatcgatgcccaataccagtgcacttcatcagtatggagctcgggaagcggtaggttatgagatgatctgagcgccgttcgattaccttatgagagtaggtcggaacagtcggtagtagatactcagttctctatcctgagagctagtcaagtttcctgttccctctgtactaatcacagtccgacgaatcgggtaaccttctcgagtaagagccaggcgagtcttgtgggatccaaccgatgtcacgattctaactgtccaggcgtctctgctctgtgggcttctcacgcaaaaagcatttagtcaagactgaccattggtctccttgtcaacctatcatcacaggaggaacagcaacgccttgggcaaatgcaatcgagtcctccagtggcgcaagcacacagacataaaggctcaactccactgttgacggtcccgtaaatctgacatttcatctgtctcacaaaancattcctcaaaggatcactaatagagcgctggataccagaagcgttagtgcaggaatcacaagattactctcatcagactcgcctggttagccaagggcaactattattgcgtagggtcccactacatttgtaaatattggggttagccttaccagcgaatatggcagtcgagagaaccctggcattttggggcgcccacttaggatttttacagtcagacgtacttagaacttttcaaacggaaaggtaacagtcataagcgaatataaataccgcctagatgtatctacttcacaaacacttaaaagccagttagtgtcaagaggaggccacgaatgacggttatcgtagggaaatttcaattgagacatagtttggacacagagcagttcattctaggacaggcaaccaattataataaagtggtgtatacatgttggacagtaccttcaagaactaggggaacagcagcgttcagcctgggcatttctcactagagtgggctcactgcctttttcacggtgccctttgtgggacaaacatgggtgtaatgtaagcaccccctaaggggcaatcgctgtgtacgaagaagcgcctggtactagcaagacccaagctgataccgtttgatctaatcggcatttatgtgcaccgatatttccgtacattcgcgtgtatgagcaccagagttgtagcgtatcgaaaaataacactcgcattcgaacagaactatttggggtacacggggctacgaaatgtgtgcacagctcaactaaattgaaatacaaacggngcccatgtggagaatcttgcacaagggcctaggtgacatcagtctcataagt

SEQ ID NO: 640777 - DNA, 572 bp, Homo sapiens
  misc_feature (12)..(12): n is a, c, g, or t
  misc_feature (26)..(26): n is a, c, g, or t
  misc_feature (40)..(40): n is a, c, g, or t
  misc_feature (43)..(43): n is a, c, g, or t
  misc_feature (50)..(50): n is a, c, g, or t
  misc_feature (55)..(55): n is a, c, g, or t
  misc_feature (59)..(59): n is a, c, g, or t
  misc_feature (66)..(66): n is a, c, g, or t
  misc_feature (71)..(71): n is a, c, g, or t
  misc_feature (87)..(87): n is a, c, g, or t
  misc_feature (96)..(96): n is a, c, g, or t
  misc_feature (103)..(103): n is a, c, g, or t
  misc_feature (110)..(110): n is a, c, g, or t
  misc_feature (117)..(117): n is a, c, g, or t
  misc_feature (120)..(120): n is a, c, g, or t
  misc_feature (131)..(131): n is a, c, g, or t
  misc_feature (140)..(140): n is a, c, g, or t
  misc_feature (145)..(145): n is a, c, g, or t
  misc_feature (174)..(174): n is a, c, g, or t
  misc_feature (204)..(204): n is a, c, g, or t
  misc_feature (216)..(216): n is a, c, g, or t
  misc_feature (241)..(241): n is a, c, g, or t
  misc_feature (246)..(246): n is a, c, g, or t
  misc_feature (250)..(250): n is a, c, g, or t
  misc_feature (253)..(253): n is a, c, g, or t
  misc_feature (285)..(285): n is a, c, g, or t
  misc_feature (290)..(290): n is a, c, g, or t
  misc_feature (302)..(302): n is a, c, g, or t
  misc_feature (325)..(325): n is a, c, g, or t
  misc_feature (329)..(329): n is a, c, g, or t
  misc_feature (331)..(332): n is a, c, g, or t
  misc_feature (334)..(334): n is a, c, g, or t
  misc_feature (342)..(342): n is a, c, g, or t
  misc_feature (344)..(344): n is a, c, g, or t
  misc_feature (346)..(346): n is a, c, g, or t
  misc_feature (364)..(365): n is a, c, g, or t
  misc_feature (373)..(373): n is a, c, g, or t
  misc_feature (375)..(376): n is a, c, g, or t
  misc_feature (379)..(379): n is a, c, g, or t
  misc_feature (381)..(381): n is a, c, g, or t
  misc_feature (384)..(384): n is a, c, g, or t
  misc_feature (390)..(390): n is a, c, g, or t
  misc_feature (398)..(398): n is a, c, g, or t
  misc_feature (403)..(403): n is a, c, g, or t
  misc_feature (405)..(405): n is a, c, g, or t
  misc_feature (419)..(419): n is a, c, g, or t
  misc_feature (426)..(426): n is a, c, g, or t
  misc_feature (438)..(438): n is a, c, g, or t
  misc_feature (441)..(441): n is a, c, g, or t
  misc_feature (471)..(471): n is a, c, g, or t
  misc_feature (493)..(493): n is a, c, g, or t
  misc_feature (532)..(532): n is a, c, g, or t
tctggcagcccnctcagccggttccntttatttggccggngcnaagatcngttcncccngataccngcccnggggggggggtcacgngatccttcncatttcncagatgngggcccngtntgtgggggggngagattggnacccngtctctggttggcgtggctgagtgaaggngtaaagacatgagcctggcagggaaagggnggggaaccgtcncgttattggttgggcctggccatcngcccnggcnccngtggggcccgggtaagggggggaatctgatcngggcngggagaagaggngtgagccgtggaagccgccttcngccncnncngacggccncncngtccccccggccccggcnncctggccncnnccntnccnggcccntgaagtcnccccncncccccccccccccngattggngaagaggcaacnccnttcccggagtctttgactaaaggggctccntgccggcacaatttctagagcnagggactttccacagtgacggcctcttgccggttgcccngggctgctgttgatttctggctctccaggtcctggatagt

SEQ ID NO: 640778 - DNA, 121 bp, Homo sapiens
ccgtcacagaccctgttaggatggcagaagcaggaagcagaagctgttctttccattttcttcttggatgcacccagtacccttgcagacggaagaagcaggaagcggcagaagcaggaag

SEQ ID NO: 640779 - DNA, 173 bp, Homo sapiens
caaaatcttcagcggtgatgggaatgtgcgctcaggaccagagacctgtatccttggtccattcacagtgcggacccctatcagatgacaggcataaagtaatggtagagagggtctacatcagctgggatccggtattctcctgtggaagtccctgcacgattgcttggcta

SEQ ID NO: 640780 - DNA, 669 bp, Homo sapiens
cggagaagaatactacatcgagacctgctggggaatttattttattttattatttttttaggtcttggttgtactgatgggaggaagaagaggttgtgtggcccgtgtctgaacttgttggcactgccttgaatgtgcctcccttcatgtgctgtgctgcctgctggtgcatgcccctgcatgcctgtgtgtgcctgtgttgcatgctctcctgctgtgcctgcttgtcatgtgtgaatgctgcatgtgctgtgccactttgtgaatccctgtgtgatgctgtgtctgcttgcttgctgagtgctggcatgtgtctggcatgtccaacctgcgactgccctgcaccccactcctgctggtggtgtcccccaagagcttgtgaatgctctgaatgtcttggcttgtggccatgggatgatacatgtagtgtgagcctgcccccttgaagccaacttctgagcccacttcttgtgcccaccatgggaataattggtggtggtccctgctaagtgtcatcactggagtggggtcgtgggaactatcagtgatttgaccctgagtgtggcccagaatgtgcctgccaggaggtgttggagaaagtcaatgctttttgcatggatggctgtggcagtctctagcagaggcaccccacttggaagttggtcaatg

SEQ ID NO: 640781 - DNA, 425 bp, Homo sapiens
  misc_feature (68)..(68): n is a, c, g, or t
gtgtgtaggacccaaaagccagcccctaagcccttcaagcggccctttgagagcaagcatcctaaaancccccttcctccaaaattaggtgatgttcaggcaaaaggttgtttacaggggaatttaagacccctttgatttttttacggtttcaacccttagggaaaaaacccgcagggggttttttaacaaactgttggtcagcaaaaaaaaagggggcccaaaaaccctcatttttaaggggttcccttttggggttcaagcaaaaacaattttggggaaaaggcccggtggcttttttttgggaaaatgaaaacccgcccccccctgttaaaaaaaatttttttcccatgggaattaaattgaggttcaaatgggggaaaaaaacccctttaaaaaaaaagggctttgtttttcgcccccca

SEQ ID NO: 640782 - DNA, 711 bp, Homo sapiens
acttcactctccacctccaccactgagatataagtgcataaaggcagtggcttttgttatgtttcactggcacaggacaagtgatcaataaatatctgttgaatgcattaataaatgcatgacgatgatatgaaagacaaagatgatcctccaaaatgataacccagcacatggatgacagtaaatttcaatgaaatgaagaaaaagctaaatatttagagaaaaagaaacagtgtattcctggaaaaaacaattcaacattatttgcagcaagacacattgagttaaaaaggctatatactctccagtagtccaagccaattaaaaaaagtctagaagtagggataaaagaaactatagtgttgtacttcctcataagaacattaagtaccagaaaaaatcactaatgtctgtaagattttgaaataaattgttattgtagaaatattacacccaatcaagtagatatttaagtgacaaaagcaatgggcaagcattatttaacaatcaaaaacttaagaaataatgccccaatgagcacatgttgaaaaactatgaaattaagtcaaagacctcagaaatggaaaacaatggttaaaaagactagtggacgctgggcatagtggctcacacttctaatcccagtactttgagaggctgaggcaggaggatcatttgaagccaggggctccagaacagcctgggcaacat

SEQ ID NO: 640783 - DNA, 366 bp, Homo sapiens
  misc_feature (335)..(335): n is a, c, g, or t
gttgaggctacagtgagctgagatcatgccactgcactccagcctgagtgatggagtgagaccctgtcacacacacacacacacacacacacacacacacacacacatttgtagagaaatatagagaatcttgggggttttcaaatttttcttctgaaatgtgagtggttggccaggcgtggtgttttatgtgtgtaattgcaacagtgtgggagggcatggcgggtggatcatgtgaggtcaggagttcaagaccagtctggcaacatggagaaactgtgtctatactaaaaatacaaaaaatgtagccaggcgtggagacacatatctgtatntcgagctactgagcagggtgcacagagggga

SEQ ID NO: 640784 - DNA, 1036 bp, Homo sapiens
ggaggccagagagggcacacagggggaacggtgtgcagatggcatggaagagagacttcacctgtgctgtgagaaagatgggaaggcccttgctgggtatgtgcccagtctcggaaacaccgtgaccacgccatggtccctcttgaggaggctgctgcaggagtaccaggagaagctccaggtggacattagcgggaactgagcaagaaagacagagagtttggctgatgtaagttggaaagtggtaataattgcaaatgaaatgagaagcagactgggagagaaataggagtgggaaacacagaacatctaggatttgactgccaggaagtttgtgcagcaatggaaagaacgttccgtggttgaatgaagaagctagagagcatgctgaaggagctggtagaaaggatgagagggagcagctgagaatcctggggggagaaagagggcataggtggtgccatgagagctcgagggccgcgtactaggagctcattctcagagctagatcgagaggtgccacagttcaggactggtaactgttgcaggaggtgataattgtcctggaaaggagtgagtccgtggaacctgaatggacctggattattacctctccagaactcaggagtgtgtgccatgtgccagggtgaagaagatgctgaggacatgtgcgtccacattcattctgggatcagacacagcaatccgtgggttgatactttcagaaagatcggagacaagttaggctgggaggaccccagcagaaggatacctggaatgagaacggttgataggtatctaaggccctggggccggacttcccctggacacttctgggggggcaagtcacggaaaggggctggacggggtgttggacaaactggccgagaggggttgcgtgccaaggcctgcactgggggcgtcaaattatggggctcgcaccccctgggcacagcggtccagtgggggcgccaacgcggccgcttgtatgcggccggtaagaacctgattgtgcgccccgaactctacttgcgcg

SEQ ID NO: 640785 - DNA, 137 bp, Homo sapiens
gcggccgcctactactactactgctcgaattcaagcttctaacgatgtacggggacatggcagagtctgcattaccttctagatacatgccactgcattccttcctgggtgacagagtgaaaccctgtcttaaaaaa

SEQ ID NO: 640786 - DNA, 377 bp, Homo sapiens
agctattaaagaattcgattcaagtatttaatctgtttagttatgcgtgcgtcttattaaccgataattatagtaccatttatgttaagtgatcattatgatatgcaataccatatcctatgttgctattgtattttttcctagttggtgtgcctgctcagtaaaaacatatactgtatgtgtatacattcctgtgtttgtataatatgtcaatttatatatttttttataggagaatggtgtaacaatttccctattcttccatatttatttgtccatagtataatggccactttgatgataatttctagaactatgttctgagattgtcagccctttgtctaaaataatggctgtattaatgattaacttctgtc

SEQ ID NO: 640787 - DNA, 2691 bp, Homo sapiens
  misc_feature (2657)..(2657): n is a, c, g, or t
gtcgtcctcgggtgtgggggcggtggcgtggcttttcttggttgtctgtgggtgcggtggggcggggcgggcggtgcggttggtgggtgtggggtgtgggtgcgtcgtggctggtgggggggggggtgtgtctgttgcctctgttgggtgggcggggttgctgcttgggtgtgtggtgctggtgctgtgcggggggtggtgtccttgtgtggttgtgggtgtggtggcgtgcgtggtgggcgtgtgttttgtgtgtgtgcgcttctgtttgtctttggctggtttgcgctgtgtgttggtctctggtttgtttgcgcgttggtgtgtctgtgctgctgtgtgtgtggtgttgtctgttgttgcttctgtttctgtgttctggttgtaggtgtttggtggtggtgtctgttctcgtctgtcgttggggtgtgtgggtcgggtggtgtcgcgtttttgtcgtcgggttgtgtgttggtgtgctttcgtcggtgctgctgttcgtggttgggtgtggtcgctgttggtggtgtgtgggtgtgttggttgtggatggttcgctgtgtgttcgtgttgtgttctgctgtgcgtctgtgcgtgctgtggtggtcgtgtgtgtggtgttgtcgggcggggctccgggttggtggtcggtgtttgttttgtgggtgcggggtaggtggtggtggtggttgtcgggtgggcgtgagtggtgtgtgtgtgggcgtgttggtcgctcgcgttgttgcgtggtggtttggtggggtgtggttggtgcggtgggtgggggcgtggtgtgttggtgggggttgttgtgtgtctgtgtggtggtgtctctgtgtggcggtgtgggcgggtggggttgctggtggtgggtgtgtgtggtgggcgggggggcggggcgtgtttgtctgtttgttgtgctagtcgctgtggggcgtgttggttgtggtcgctggtggcctgtgtgtgctgtgtggttgcgcggtggtcgttgttgttctcgtgtgtctggcgctgggtgcgtgtggtgcttgggtcggccgggttgtgtgcgctgcgtgcgtgctcgtggtcctgtgtgtgtggctctgtgggtgctgtgtgcggtgtgttggtggtcttgtgtgttttggtgtggttgttggcgtgggtgtgtgtggtcgtgtgtggtgcgtggtgtggtgtgcgtgtgggcgtcgtctgtggtcgttggcgctcggtggtggggtttggtgtggtggttcttgttgggtttgtgtgtctgtcggtgcgtttgtggtggggttgtgtgttgtggttgggtgggtttgtggggtgttgggtggtggtgtcgtggttgttggtgtggtgggtgtggtggttgtcgtcgttggtggtgtgcgcgggtggtgttctgcttcgtgtgtgctggtggtgcgtgtcgtgtggtgtgtctgtgtgtctgttgtgttggctgtttggttttggcggtgggtgcggtggtttgttggtgttgctgtggtggtcgtggtgtgtgctttgtgttgtgtggtgttgtggggtgtgtgttggtgggtgtggtggctgtgggtggttggtgctggtggttgtgtgggggtggtgcgcggtgtgtgtgggggtggtgcggtgggtggggggtgggtgggtgcggggcgtgtgggtgtgtgcgtgcggggtgggtggtgtggcgttggtgtggtggggggtggggcggggtggttgttcgggggggggtggggtgtgtgggtgtggggcggtggtgtgggtgtggtggtgggggttggggttgtggttgttggtggtggggggttggggtgagagggaggagatatgatagaagaggaaggtagaatgtaaaaagtgaagaggagagtataggatggagaaggtgtggtgggtgttgttggtgggtggggggggtgagaggtaaatatagaagtataagatgagaagaagtgataaagagtgtgaaagaagatatatgaggaaggtgtgtgttgagtaggatagaggtaggagataagtaggagcgacgagaaagtaagtgatcgggggtgtagtgagtgttcgtgtgagggctgggatgtataaaagaaggagagaatgaggaggtattggtggatgttggtggggcggtggttgtggtgtgtgtgggggtgtgttgttggtgtggcgtgttgtttggtcggggtggtggttgtgtgtttgtgtgggtggtgtcctgctgcgtgtggtttgtctggtgtgcggtcggcgtgtcgcggggtgggtggtggtgtgtgtggcgtgggtgttgggcggtgggctgtggcggctgtggtggtgcggtgtggtgtgttggtcgtgtggggggtggtggaggagggagagaaaatgaaaaggaagagaagtatatgatgagagagaataatatatatatatatatatatatatatatatatatatatatatatatatatatgtatatatatatatatatatatatatatatcatatatatatatatatatatatatatatatatatatatatatatatatatatatatatatatatatatatatataatatattatattatatatatatattttatatgtaaaggaggcccggacccgacctgtccttagttaagtgaattcccccctgcctgaagnggggccttcttaagctgtacggcgtgtagcccct

SEQ ID NO: 640788 - DNA, 538 bp, Homo sapiens
gcctgtctgtgtgtggcgcggtgcgatggtgtgagtgcccagtgactctgaccctgtccccgtgccttcagcgaaggcccccgtgcagcgccggccactactgaactgcctgctgggttgaaaaatatatggccatgtaacacgcttgcaatgacaactttgtctgtggaactgacagacacctgtgatgcatgtgctatgacggtcttactgcaacggtcgaaggaaattgtagcccaaacaatcagtcagtatgcagtgtgcccgtcacagtgagacccgtgccaacgaaccaacgaaagcgagttcctagatggatattgtgcccccgtgtgaccccttgctagagggcccaagacacatccaaaatgcattgccccactgctatatgggaaccttccaaattggctttccacacaattgcaccacgtggcgcccatatatgagcgacttgtggtcgaatggcaactacaacaactctacaagactcgtatatagcataccaaaccaagaaaaaacgtacaacttcctatacaca

SEQ ID NO: 640789 - DNA, 120 bp, Homo sapiens
aggatccaccgcatcttgcgtcacatcagcatttccaatctggctgatgagttgcctgaattgatcaaggtagctctgtccctcaggtgttattccaagttttctgatgggagcaagatg

SEQ ID NO: 640790 - DNA, 324 bp, Homo sapiens
  misc_feature (1)..(1): n is a, c, g, or t
  misc_feature (12)..(12): n is a, c, g, or t
  misc_feature (72)..(72): n is a, c, g, or t
  misc_feature (90)..(90): n is a, c, g, or t
  misc_feature (129)..(129): n is a, c, g, or t
  misc_feature (146)..(146): n is a, c, g, or t
  misc_feature (148)..(148): n is a, c, g, or t
  misc_feature (160)..(161): n is a, c, g, or t
  misc_feature (164)..(164): n is a, c, g, or t
  misc_feature (189)..(189): n is a, c, g, or t
  misc_feature (199)..(199): n is a, c, g, or t
  misc_feature (218)..(218): n is a, c, g, or t
  misc_feature (221)..(221): n is a, c, g, or t
  misc_feature (249)..(249): n is a, c, g, or t
  misc_feature (252)..(252): n is a, c, g, or t
  misc_feature (285)..(285): n is a, c, g, or t
nctggcttctcncgtaagaagagagagatacgtgtagaattgggtggggggaatgagcatgaactgtccgtncggttgggatatgttacnttagagtgagagagagaataaggagccgttctatggaanaaatgggagaagagagncngggttcttttcnngcngagtctagtagtttctctgtaaggngaaataatcnaaaaagactaacctgcccnccngcgccgtatattgctgtgagattgcccngancttgtgctcttctgtctgcagtgtgcacggccntgttctaaccgggaataaaggtgattgattgtattgggg

SEQ ID NO: 640791 - DNA, 182 bp, Homo sapiens
cgcttctcccagatccttgtcttacacacaggtgtgacgctgggcgcggtggatcacacctgtaatcccagcactttgaggaggccgaggcaggtgagatcacctagaggtcaggagttacgagatcagacaccggccaacatggtgaaaccccgatctctaaccacaaaatacaaacaatt

SEQ ID NO: 640792 - DNA, 108 bp, Homo sapiens
gatccggtatagtgaactgaagtgttgatagattgttatagtggcgatcggttaatgacggttgatgtttggtgagcatctgcttaataaacagacattgattccctt

SEQ ID NO: 640793 - DNA, 117 bp, Homo sapiens
ccggcccagactagatggagaagaagcgaggtatggctacacttgacattgcacaacaggtagagccataactcgcttcttctccatcttggtctcctttcctagagacagtgtgtg

SEQ ID NO: 640794 - DNA, 302 bp, Homo sapiens
tcgaccgccattctcctacctcagcctcccgaggtacctgggactacaagcgcccgctgccaagcctggctgatttttttgtattgttagtagagacggggtttcatgtgttagccaggatggtctcgatctcctgacctcgtgatctgcccgcctgggcctcccaaagtgctgggattacaggcgtgacaaccacgcccaggcaaaaaaagttttttaaagaataaattggattatactatacatattctgagacctgcataatatgtcttagaagatttttcatgtcatagctgtcactc

SEQ ID NO: 640795 - DNA, 1474 bp, Homo sapiens
  misc_feature (737)..(737): n is a, c, g, or t
gatcctggtgtcgccatgggccagcgcccgaccgttgttaccggtattgtaagaacaagccgtacccaaagtctcgcttctgcctgaggtgtccctgagtgccaagattcgcatttattgacctggtggctggaaataagtgcaaacatgtgtgatgagtttcctgcttagtgtgccactatggtgtccagatgacattatgagctagctgtcctctgaagtccctggaggctgccctgcaagttttgtgcccagatcaagtaccatggtcacaaaagcttgtggcaaagatggcttccatatcctgggtgctgcgctccaaccccttccacgtcatcctgcatcaaccaagcatgttgtccttgtcgctatgggcgactcgacatgtgctcccaaagcatggacattgccgatggttgccttttgtgcaaaggccgccgagtgtgacacctagttgtgaccaggtggtatacacactttggcccaaacgtatgatacatagatcgcagtctcggacaagcacacatgcctagcatagatagcaaagtggatgcatttgtttgactattgaaggtgccccatagctgccatatgtgggcccagatgtttccaaagcgtttgtcccttgagccctgccctagggcaaggattacccaagcaattacttcatagatgcaaatgttgtgtgtggcctttcaacgccaaatgtataccaaattggtccttgacttgaaacntgttgcacacgaaccacttgcgctagtgccttggacaagatgtcggcgactacaattcccccaggaatgtgacttgttgctggtggttcccaagttaacatttcccccatgtctgttggagcgcacggtccgtaggggaccaaactggttgggctgtgagggccctttgaccacgtccacttaggtcgggtggcttttcccacaatttgttgactagcacaccacacccttctttcaacttaccttctaccccaatgtacagattccgtacgcttatcccttggtcccaaaacgatgacatacagacaaagaagagcacaaacacagctgcgcaaggcacacccaacgcagctgtcgcataatcaatcaccgcggcgggaagaaaacacgctcatagtttgagaacaaggagacaacagccccacccaaagagtgacacgagacccaccgatggcgcagaacacgccccccacaaggaatacccaagatgcacaagaccacgatcggaacaatatggcgcaggacacgcaccagcgcgcagcaccccgcgggcacaacgacgcaccctcgcttcagagaaaccggccaacaaagggcaacgggtgcgtaaaagatcgagcgaacagacagtgttgagatagacccgacctgtgagatcgtgagccagcgggggagaacacccacaagagatgatccacaacacgccaggaaagcgtccgcacaaagaggcaccacgg

SEQ ID NO: 640796 - DNA, 231 bp, Homo sapiens
cgcgctggtggcggcggcgcgtcgttgcagttgcgccatctgtcaggagcggagccggcgaggagggggctgccgtgcgtcagtaccaccgttccttcctaccttatattccttccatccttcgttcctggtccggtcacgagagtagaagtgaagaggttgcagtaaatggatgtcgtgtcccggcagcgagccaggcggttttccaaatgagaccgtgttgaaagggcg

SEQ ID NO: 640797 - DNA, 1120 bp, Homo sapiens
  misc_feature (156)..(156): n is a, c, g, or t
tggtttcttggtgatgcccagtggatcataaccatgtcggattttacaggaattgtggaattatgtggccctcttcgtgggaatagtttctgaacattatctggagccacattctcgtggtgttacaggctcatgaaggaaacgtgcagtgctggngctttccagtgttaatacattatgtgtacaagttgtgcacattttacatctcacttagaattgtgtgccgccgatgtgtgtgggtgtggctttcggtctccctccccttcaccaggtgaacacacattctgtggcttgccagttattttcaccaaaagcaacactcttaggtgggtgtgttccccactgtgggtttaaaaggccttggtggccatctgtggggggctctcgtggggtctccatatcgagggttccactgtgttccgtttctctttactctcgtgttttcccacttccactatacctttaccctaaagtgggtgagtatatgtggactctcggagagggccaaacaccattgccattgggatttacattttgtggtacggtgggcaccaaaatgtggctcgaaaattctcactatactttttctttctcccgggggggggtattaaccacgttgtttggaccagactatttcaaataaggcgataacattgccccggaactcaaaagcgctgtggtggccaccactttttttgaagacttttaaaggggacacacacgcggaaaaacaagctcctttgggaaagtatattcctcgaaaaaggagccccttgtattggttcccccatatagtgtgaaacctgtgaaaagggacccaaaaggcttatttgggccatccccaagtttttcccccctttcccaagttcttggaaattccagaaccaccctttttgagggggagcgtggtggttggggcgggcaagcaattttcttgggcccccaggggttttttagaaattttggggagttaatcctggtcccagcggttccctttctttctcacgaagaaccccagtttactcccccgttgtgtttaagcggctttttgcgcttccccacggggggctttttggtgcacggtggttccttgtttggccccgaagtcttgaagtcactg

SEQ ID NO: 640798 - DNA, 129 bp, Homo sapiens
gaagaggtcgcagatacagaggcatagcgcccagccccatcaggaaccttgcttgtggaagtgcctgagatgcgaggtaaaactgctccagctcctggtgcctgaaactcaaccctcttcaccggccat

SEQ ID NO: 640799 - DNA, 826 bp, Homo sapiens
agcggcatttcacccttcctctggctaaagagtattcctccttctgtagagctctccccagtggattttacgcttaagttccactcccattccaacacccaagaggctagattctgtctcctctacccacaggcgggggcatgtcttagatccccagtgatgcgtgaagaaagatgtctcactttgcatcagacatctagatacccagagtgggcgcgcgggtaggtgcctatgtggcgtcgtccaggaagactgtatagatcaggactgacttatgatcttcactgacgcagaggacagagccgcgagactagacatgagaccagcagttatagactatgactatgtctatgcatactacataagataatagaactagtcacagatcccgcgcagcaggcagtctccgtcccggacaggcgatagcccacggcggccagacctgaggtgactgatcccgcgaggggacggaggggagtgacggagggctatttcccccagagaacgtcaagacgccccccagggacccggcgccgcgcagacagccagccatctgcaaacacagacggcgtgagggcggcgcagtcgccctgccagcaaccgagcagctgctgtgccaggccaagcggggactcactgcctcagtaacctcagccgcagaacccggccggagaccgcgctcagggtcgctccaccccggtagccggtggctccgagccaaagcaaggtgcttggccggggcctgcaagccggcgcggcgcgcccggcgcggaagactgggcctcacctgaggagcacgcgacggagtctcgtccggggcgccaaa

SEQ ID NO: 640800 - DNA, 1402 bp, Homo sapiens
  misc_feature (1402)..(1402): n is a, c, g, or t
gaggttcgtggtgctagtattctactaagccataccagtgccatacctcgtcgctagcagcgacacacgctctacgccgccgccatgactagagcagatagaccctatcgtggcaccctacaaggagccacaacggccagcgcgctcaaccccagcactacgctaactaaccccccgccagcttcccacgcgaccatcgcataccactcataccgcacctcatcagaagccatacagaccaaataccataccatagctagcgacaaacctagcacaccagcggcactgcacgacccaacctacatgcgcacacttacccccacccaaccacagctaggccctactctgcccgcgcagagctaccaacataacacaacaacccctactaccgcctccaccccccgcacagcataagagcgcaccccacacctacccataccacagccactaggggccccccaggacaacaccagacccaccccatgccacttccaaaacggacctatccacctggccgccccaccttgccgaaaacaccaccacattagaccgaccacaataacgatgggcgggagcaccttacctataccaatcccacaaccccggcggcgacaccactccacaagaagacaaactcccgcaacagggggcgcgaatctctctcttgggctaggtcgccggtccccaaacttacagccccctaggacggcgggcacacttggccttgcccccttcgccacgcattaggataggacgccccccgtatctttcctcataccgcccatattccggttgcataccccgcaaacacccaccggcgccccaactgccaaccttttggggtcttcccactcccatatggaccacaaacttctaatcacatcaacgcggcgaacctttacacccagtagtccactacacatatactacaaatgtgtcccctatatcgtatggccgcaccactataaggccgccccccttggcggcggcctttgggcttggcgctttgggcccacatcctcatctttaagcgctacacccttatggggggttcccccacaggccgttaaccttggcgacactgcacgtgaccccaacgagcacatacccaacacgacacgcccacggccagcgccccgggccctcaccatggctgtgcataccgccagccacgcctgccacccctacccacgacgcccgccacacgcccccacgagccccccccgaccgcacccagcccacccccacaaccacgtaccaccccccaccccaccactacaccactcccccaccacggccccgcgcggcccccccaaccgcacaaaccaaccccccaacccggaccaccaagcgcacgacttcaccacaacccgcggcaaccacacacattggcgagccacan

SEQ ID NO: 640801 - DNA, 729 bp, Homo sapiens
agcgggtcgtgctgcgctgcgtcgctttcagcctctggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgcttcatatttctgaagttcagctgaacaccatgggctgggagccagttgttcaaccgagtagtgtctcccggacctcttcattggcctaaaggtgatctggggaaaaacacgcaagggcctcgttccctggtttacgaggactagggcccaaatttagtgggggtaagccctttccagagcaatatacttggctggctttattcaaacctgcgaggaaaagttgacactgatgtatgagatcctgattctacccaaagtacatatgatttcagctgcaatgccagggtaacactgccaatcacaggaagcgaagcccattgggcttatacaagactcggtaacagcttgatgcacggaacc

SEQ ID NO: 640802 - DNA, 177 bp, Homo sapiens
actctagcgtacccttatggctgggtagcacgattgaccaggtaaatttaggatgaagacctataacatggcggctgtacatacttctacttgtgaactaattacggtaaccgtctttatttcttttcaatctcttaagcagatggattgtaatcgaatgtgacacccagtccatgt

SEQ ID NO: 640803 - DNA, 399 bp, Homo sapiens
agcgggtcgtgctgcgctgcgtcgctttcagcctctggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaacaccatggctggagccagtgtcacccaattatggcttccggaccttttcattggctaaa

SEQ ID NO: 640804 - DNA, 693 bp, Homo sapiens
  misc_feature (163)..(163): n is a, c, g, or t
  misc_feature (170)..(170): n is a, c, g, or t
  misc_feature (172)..(172): n is a, c, g, or t
  misc_feature (181)..(181): n is a, c, g, or t
  misc_feature (187)..(187): n is a, c, g, or t
  misc_feature (195)..(195): n is a, c, g, or t
  misc_feature (197)..(197): n is a, c, g, or t
  misc_feature (200)..(200): n is a, c, g, or t
  misc_feature (216)..(216): n is a, c, g, or t
  misc_feature (219)..(219): n is a, c, g, or t
  misc_feature (224)..(224): n is a, c, g, or t
  misc_feature (229)..(229): n is a, c, g, or t
  misc_feature (242)..(243): n is a, c, g, or t
  misc_feature (253)..(253): n is a, c, g, or t
  misc_feature (279)..(279): n is a, c, g, or t
  misc_feature (290)..(290): n is a, c, g, or t
  misc_feature (299)..(299): n is a, c, g, or t
  misc_feature (318)..(318): n is a, c, g, or t
  misc_feature (324)..(324): n is a, c, g, or t
  misc_feature (343)..(343): n is a, c, g, or t
  misc_feature (389)..(389): n is a, c, g, or t
  misc_feature (477)..(477): n is a, c, g, or t
  misc_feature (486)..(486): n is a, c, g, or t
  misc_feature (498)..(498): n is a, c, g, or t
  misc_feature (512)..(512): n is a, c, g, or t
  misc_feature (515)..(516): n is a, c, g, or t
  misc_feature (521)..(521): n is a, c, g, or t
  misc_feature (524)..(524): n is a, c, g, or t
  misc_feature (541)..(541): n is a, c, g, or t
  misc_feature (584)..(584): n is a, c, g, or t
gaagggggtatggtttttctgtgccaactggtgttctcactcgcagtgggctggaggcaggtaagaaaagtgttcgggaagcttgggcagggggttccgggtttgggagggcccgcactttcaggccgtcggaaggaggttttgcagtctcccggtcgcccgnggtgggntntacggcgcnggcatncgggcaantnggngggtgcctcgttgatnagntggtntgcgntcctgaatggggnnggcgtgcccnccggggggttagtggccactctgcanagcctcggggntggtggcancagggttgtcataggtaanattggngccctgatggggtacgccncccacaagtattttgatagtgaggaggatgaggagtagccagcagntcccagaacctttttttccttttgggcctaacttttccagttaggatctagaacttggcctttttttttttttttttttttttgagangggttctcnctatattgtccngggtagagtgcagnggnnattcncanatgggaacatagtacantgcagcctccaactcctagcctcaagtgatcctcctgtttcancctcccaagtaggattacaagcatgggccgacgatgcccagaatccagaactttgtttatcactttccccaacaacctagatgtgaaaacagaataaacttcccccaga

SEQ ID NO: 640805 - DNA, 158 bp, Homo sapiens
gcctgagtcgatctaaggatcccgcgctagcggcattaatgaacgcatttccataatctgatttgcttttaatctaggttggaagggatcaaagcagtggccttgaagggcagacctggacggtggccatccaggccccgttcacttaatgccgctag

SEQ ID NO: 640806 - DNA, 426 bp, Homo sapiens
tcgaccggatgccgccttacaggggatgggacgcttatgtctaagcaaggcgctacagagtcaagacaggtcgttagaagctactacaaattcagcaaagtcgcaagatacaagatcaacagaacaatcagtggtattgctatacaagagaacttcacaatacaaaaatgcaacattaagaaaacaatgtcctttacaatagcatcaaaaagattaaaattcttaggaataaattcaaccacgggaggtctaagactgaacactacaaaccattgttgccaagaaattacagcatggcctagataagtggcaaggtaatcccatggtcatggataggaagatttgcatatgttaacatggcaatactccctgaaatagactacagatacaatacaatccatctcaaaatcctaatggtcttcttgc

SEQ ID NO: 640807 - DNA, 320 bp, Homo sapiens
tcgggacacggatataccggggatggtcttacactgggagtagagatataccggagtacagcatccactggggaacacagtgtcatgagggacaaatgctgtcccggatgacagtcacgttgccagtgactagatttgtccagagaagctagcagtttctactcacgggctgatgtacaagtagatgcgatgccaaaatgagatgaaagagaatacagaataaaattccgtcccttggagcatattccattggcatattctctgctcctgcttccgctggtatctggccttctggtataacatgatgagcgttactgctg

SEQ ID NO: 640808 - DNA, 738 bp, Homo sapiens
agcgcccgcgatgactgtcactctccgcccctacctgagtgccgtgcgggcacatgcaggtctgccctcgtgcgctggagaacttctcctcccaggttgtggaacgacacaatagatgccggaagtggaagtcagtcctcgcccagtgaatttgaggaatcagagtcatattacagatgagaaaattgagattccaacagggtagacttgccgcaaggataagtacacgagaggaggctggatttcaaaaccttttcgccctgtagttcagagcctgtgctcttgctgctgagagaacagactcactgggccccgatctcggagcactcctgcgttgagtagcaagagagctccgtgttacaactctgtgacgcatcagcaggaatgacgaaggaagaaggttctgattgagggctccatgcaactctgtccgggtcagcattgctgtgaaacaggctgatgagatcgagaagatgtcttgccactaagtatcgatgcgcttcatgatgatgctgagcggcagaacttcttcatccattcgaaggacagcctgtggcaggggtatgatatcagctttctgatcaccaaggttccaaacagagcagatgtacaaacagaagttggtggacattcgtgatccaattcatggaggagattgacaacggagatcagtgaagatgaagctgttcgagtcagatgcctgtgcccgcaattgtggctgaagagttccttaagaat

SEQ ID NO: 640809 - DNA, 293 bp, Homo sapiens
cacacaggtacatgactggtatataatccctaaaaaacagatcattatgtcacactactgccacctgtcatcagaatcgcttacctattcagtgtcacttgacatatataaccccacccactcctctatgagttctcacatactcaccagcagtctgtgccggatttcttcctatcccactcattggtaataatcgcattttgttgcacgcacggcactttacattcttctgctgcaacctttacagactgctgtgacacggtgtacttccaggaacactgagtacctatgta

SEQ ID NO: 640810 - DNA, 916 bp, Homo sapiens
  misc_feature (713)..(713): n is a, c, g, or t
gcttcaggagacatcattcctgaacacactgtagggtgaattggtgcatcttccccaccatacacacacacacacacacacacacacacacacacacacacacacacacaccccccaaatcttttccatggggagtgtgtggcaatcttgccaaacagccacactcagagtgtgactctgagtgtgatcttggtcttaagtgagggaacttcttagagaagaagtttgaggcgacaagggccaactatctgtctagtcgtgggctcgtcgtgctgtcccagctactatcaaatctcgtgtacagagacagagggccaatgtgcaaaagtgaaacgccaggaacctattgctaagggcgtcgtgtggctctgtggtggtgtatcatccgccttccgagagaataagatttccccttgccatgtcccaactcgtgtatatatttcgtgtacagaagatatccctgaatattgtgtagggtgagtcgtacagcacaatatttatatctccaaaatatttatagctttttctactatgctatgaattgagatgacgtgctcaattttgtaaataatgtctttgtgtacattaaaaaagtaattttcacataatttatcttgtctatctgttccccttgaagtagttagagagaacctgggcagttatatttgggcgcatttcgaaccagaatttagggtgtaatttcctcttcaacngtgtcaacattggatatcccggctgtgccaagaagtgtttgggctgaggcacaaaaaaaacaacaccacaccaccgttccacaatcaacaaaaccacctacaacatcgaaactaacagacaaaaaaacacaaaaccgccgccatatccacgagacgacgcaatttgaaacaatgactaatacccgccacaggacacgataaca

SEQ ID NO: 640811 - DNA, 320 bp, Homo sapiens
atatggcatatatgctcaaggaaaacagatcattctacaaatggaacatgtacctaaatgtacatcatcatgctgtgcaggagagcaaagacatggaatcaactaaggtgctcattagtggtggtggatcgggtaaagaaaatgtggtataaatacattatggagtactacagagccatagaaaaaagaacgaaatcaggtcctttgcagaaacatggttgcagggggtggtcataatactaagcaaattagtgcaggaacacaaagccaaatatggcatgtcctcacttataagtgggaaatgggcacacattatggag

SEQ ID NO: 640812 - DNA, 1989 bp, Homo sapiens
agattgtccaggagaatggggactgaagctggtggaggggagagagggctaaagatgtagaccccgcgctctcctacggaggtgtgacatcatgcatcatctctggccggaagagaaagagtgtgaggctgccaaggaagctctggaggcatgggttcctgtcaccatctgaagtagaggatgcccttatgacctatcaccgtctacgtatattggagcagaagaggaagtgggatccgacgagagatagaatgggagtcgagtctctgatggctgcaaacgatacaatagttcaccggacaacgcgtgtaagctgcagctcctggaacgattcgatactgcacgagtacaatggcgccgcatcggctggcaagacctgatgagtaccacggggggctcacaggtgcctggggaaccatagcgtagcgcaagacaggtagctcgtaaaacgcgtaggagcttcacacgaagggtccccgaaaggaccacggggcagggtaccccgcggcgacgtgtttcaagaggggaagcttaacatcatacagacgtttgcacagctggttcccacctcgcacaatagagcaccggcaaaagtgtgaaccccaaatgcacgcaagaggttaatcacgaaggacgttgagccatggtacaaacgagatgagtggacgacgacttaaaattgaagcaccgccaaataaatcacgcaagtgaattcgggtaacgaccccattaggaacggaatggacaaagttaaaattcacaacaggataatcaacgcactacggaaactacacacagcggggcaccaagcacatggagggggagcacagacgcgaaagaacacaacacacgaaagcagagacacgacaacaaaaagaatatgcaacacgcaattacaacacgacatgagtgaggaaattaagccggacaagtactacaaggtcacatcacaccaacggaaaacaggacccgtcggaccccacagaggtggacacatcagggcattaacgtcaaccacttgggaacagcaacaagctctggactgaggcgcagtgacaacaccgtacatgagacgagcagaagagaagtagggggacgcaccacgatggacagcaggacagcagctataccgcgcggacatgggaaaccaccaagcgacagcgacagaaaacgaacagagagccgcacaggcacctaccaccaatacggcgagggcacccccgagacgaagaacaaaacaacagacccacagaacgcaggagcagaaacaacaacacagtgcgagcggagcagttacacatggataggggcaagacaacaattaacgacaacattacccacaagacaagaaggacaggaaggaccccccaagtaaaaaccagccaagcgtggcagacaaaccagtgagtagaccgagggggaacgtccccagaaaagacacatgagcgggaacagcagaagggccacacggagacacagagagccacgacgcacacgacgagacaagcggactgacaacacaacgaaattaccgatccgaactgacaggaccaccagagcaggcgcgcgacgaccggaacaataaagagatgacaacgacccccaggaacagaacaagacgggccagagagacgaccgcgacaacgagagacagaggagacgaccgagagcaccgatgcgaacggcgaagacgagagaagtgacgatgcaccggagaagcaagagacggtgagagaaccaacgaacggaagaccggagggcaccagaacacacaggggagcaccgagaaaggaaagcaaggagagacaacacgtagcaggaaggagctcaacgaaacaaaaggatagaacaagtagggagagagacaagacaaagaggaccagagagacgacaatgcagacagcagagaagcgaacacgcagaagcagacgaagaccagaataagcaagaggagaggtcacgtgcgcgaacacaaacagcacagaaaca

SEQ ID NO: 640813 - DNA, 183 bp, Homo sapiens
atgtcattgaggttgatggactgctctcctcactctggctccagatatgaaggtgatcccatgtgacagctggttgtactgtgcgggcgtagcgggaacggcgccattgggaatgtcgtcatgataaaacttgtgagtgcaagagtgtcttgtggggacagtgttgggctagagcatgggtgc

SEQ ID NO: 640814 - DNA, 217 bp, Homo sapiens
catcaagccgtgtcttgggaacaccctggcggtgggatccgcaaaataatggatagagttcgaggtgaacatacatgtccctggcacctgagctgcagtctgacttcattgccatcacgggcctcgctgcaaattttgaaccgggccaaggctgaactgctgaagcttgtgaaggagctacagtgccgagcagagaggcccgggggtaccgagctcg

SEQ ID NO: 640815 - DNA, 475 bp, Homo sapiens
tgattgttcctcacataggattccagaacactgctacaaggttctgaatttttgtccctcacataggattccagaacactgctacaagggtttgaaagtttgtccctcacataggattccacaacactactgctggggtctgaatgtttgtccctcacataggattctagaacactccagctggcttctgagtgtttgtccctcacataggattcctgaagactgctgctgtcgctatagtcgttgcaagtgtctgaatgtttgaccttcaccaaacaccaaatatcctgaccctttagtcttggactttccagcctccagatctgtgagcaataatctctgttgtttatgaattactcagtctaaagtattttgttatagtagcctaaagagactaagagagcatcacctgccctgtcacctcatcaccgcattactgaagctatactaacaacagtcacttttagtgggtgct

SEQ ID NO: 640816 - DNA, 776 bp, Homo sapiens
gttccgatgactgtccacaagctgtaccctgtttgacctagaagtggagtgtgtctgcacatacagcgaatggcaccgacaatgaaagcaagcatggtattcccaaggtaggaggagtataatgctgatgtacgggatgctcttctctatccgctcgtttgtcatgcaagatgtcgccgcgctagactagtgaaggatggcttccgtggccttccaaacgtatgcctgttacaaattccattactactgatgtcgcccatcatggtgatcagatagttgtcatgacagtactgacgttgggcgtgggacccatccagaggatgtgctagcggccacagtctacagtgcgctgtactgtggagctggtggtgaagaaatcccctgtgcccgcatgggccaaagctgtgcacacgtgacgctctttcgctcccgactggactcctatgttcgctctctgcccttcttctccgtcccggtgctggctgaagcaagctacctcaagtctccaggagaattcatgtctgcctggggccctatccggaacctgtgcctaactaaagggcccccctttgtcgccccagaaccagcctaatgacctgcttaccgtctgtgggctatgatgatcgcttctggctgtctgtcgcaaggaacaacctgtggtcaccctgtagtcgcctgccccccacgtcttccgcgcctatcctgctccctggcttctatggtctctgtgttcccgaatccctgctccgggtcatggttactgctccgcgctgccg

SEQ ID NO: 640817 - DNA, 102 bp, Homo sapiens
tgctcagaggatgacggctcgagatgtatcctgccgtgagctttccccccagagggccgccagtgcagtcggtggtactgagaatggagagtcgggagcaca

SEQ ID NO: 640818 - DNA, 164 bp, Homo sapiens
ccgggagtgctagactgggagtgacggctgctgggtaaggatttaggggtatgcaaatattctaaaattaatgattatatatatgcacaatcaatgaatacactaaaaactaaaaactactgaagtatatattttttttaacgatggagtcttgctccttgtcc

SEQ ID NO: 640819 - DNA, 522 bp, Homo sapiens
  misc_feature (62)..(63): n is a, c, g, or t
  misc_feature (69)..(69): n is a, c, g, or t
  misc_feature (75)..(76): n is a, c, g, or t
  misc_feature (81)..(83): n is a, c, g, or t
  misc_feature (87)..(87): n is a, c, g, or t
  misc_feature (89)..(89): n is a, c, g, or t
  misc_feature (92)..(92): n is a, c, g, or t
  misc_feature (95)..(95): n is a, c, g, or t
  misc_feature (98)..(98): n is a, c, g, or t
  misc_feature (100)..(100): n is a, c, g, or t
  misc_feature (102)..(102): n is a, c, g, or t
  misc_feature (104)..(104): n is a, c, g, or t
  misc_feature (116)..(117): n is a, c, g, or t
  misc_feature (151)..(152): n is a, c, g, or t
  misc_feature (157)..(157): n is a, c, g, or t
  misc_feature (164)..(164): n is a, c, g, or t
  misc_feature (173)..(173): n is a, c, g, or t
  misc_feature (296)..(297): n is a, c, g, or t
  misc_feature (302)..(302): n is a, c, g, or t
  misc_feature (345)..(347): n is a, c, g, or t
  misc_feature (352)..(352): n is a, c, g, or t
  misc_feature (374)..(374): n is a, c, g, or t
  misc_feature (382)..(385): n is a, c, g, or t
  misc_feature (407)..(407): n is a, c, g, or t
atttttgggacaacccactcagccgcaacctaaaaaacaagcagaacctctttcaggaaaanngaaccnttagcnnacccnnnagtncncancanaanantntnaaaatgcaatcnnctgcattttccattgctgcagatgtaaaggatgnnaaggnggctcantcaaatganaatctaagcgactctcaacaagagccacctaaaagtgaagtctcggaagggcccgtaaagccctttaattgggaccacaatgttcaaagtatggagactcaaatcgacaaagcccaagctgtnnctcancctgtaccccttgcgaataagcctgtacctgctcaatctactnnnccttnaaaaacaggggggatggagggnggaacagnnnnagcaacatcatcattaacaggngataatgattttaaacctgtgggtataggtctaccccattcagaaaacaaccaagataaaggcctgcctcggccagataataagagataattagattagaaggccatagaggcac

SEQ ID NO: 640820 - DNA, 1071 bp, Homo sapiens
taccctctctctgggtagtgttgtggatgggggagagtggaggagcatctgtgtgtgtgttctctcccatggtgcgactactgtcctgcgtgtttacacgatggtggtgctctcgtttcttcaccttgagaggcccaacggtcgtggcaacgtgtgttcctcccgacgctgtcgtcatggttcctggacgcgtcctttccgcgagttcaccgggcgcaaacgcactggtgtgagaaaccgatcttgcgagcctccgtgtgattggccccgagcggccgccgtgtggccttgcccgcctcaccggtggcgctactcgggcccaggacgccattggcccaacccgcttggaaccatttccgcgggtcaaggtagaccttgagcccggaaatatgtatcggggatatagcccccggtttccccagggccctcctcgccccaagctgcccttgagaggccggcaatgtaagaagattaagaaatcaaggagatgagaccccaggtcagcagccacctcaacgtcggtaccgccgcaacttccattaccgacgcagacgcccaggaacccttaacccccagatggccaagagacctaagcagccgatccccccagctgagaattcgtccgctcccgaggctgaaccaggcgcggggctgagtaaatgcccggcgttacccatctctacccatcatcccggtttagtcatcccaccagaagaaatatggaattccccgccattaagaaatggaccaaagattggagctgaagacctaaagtgcttgctttttgccccttgacccgattaataggactatctgccttatctatgcacgcatggggtttttattatttttacctataagaagtctctttcttggtaataacccaacgtgttttttaaaaaagcctggtttttctccatacgccttttaaggtttttaaattgtttcatatctggtccagttgagatttttaagaacttcatttttaatttgtaataaaagtttaccacttgattttttccaaaaagtcacccaactgccagcccctgttaataaaggtcttaaataata

SEQ ID NO: 640821 - DNA, 468 bp, Homo sapiens
atgtctgccggtttctccttgaagccaatgtgtgggatcatggcatttcacaaaaatatgcctccttccccctcggggtgacagtataagtcaggcctcccttttttcaaggtgggctttaaatcattaaagcttaaattgtcagatcgttcattccctttccagggttatttagtaaagtttgttgaaaacaaaaacccctttttttggtttttttttcagttattttgaaggtccagcatcctgattaaatgtttgccccattaaagaatgaccagcagcagctttcagtttttaaaaaaacacttaaattttgattttacaagggggttacctgttccattgttgtcaaaagccccctttccatcaaaagggttcccccatttttttatccccaaagaactcctcccttttcaatttgtcatgttaaaaaaaggggttacattaaagccctgtgttaagtgtcca

SEQ ID NO: 640822 - DNA, 493 bp, Homo sapiens
tggtatctgaagaatgactacttactttgccaaaggacagtgatgcagttctcctcacatgcacatcccagtgagagctacaaacagaaagatcagctcacacagttgggtgcagagtgctggagcctgtcctggaggcatgtgcaggtgtttgcaggcatggcgggagggcttccagcctaagaacaagggctgggatggttgcatatctgagtagataccctggacctgggtattaaaaagctctagaaaatccagccaggcagagaaggtaggggaagacatttccagtagtaggcacacgatggggcagagttctggacttaagaaagcattcggcatattcagggaccccccatgctaggagtctattggaggtgtcaccagatgtcaacttctgaaaggacgtgtgcttctttcctcctccctgtgcgctcgcatggcacgggtccttttcccactcctgggctcctgtcttgggagctctttcaaa

SEQ ID NO: 640823 - DNA, 235 bp, Homo sapiens
  misc_feature (205)..(205): n is a, c, g, or t
ccccagtcatcctgctctttgctcatgagaaagatccacatacgacctcaggtcctcagaccgaccagcccaagaacatctcaccaatttcaaattcggtaagtgggctcatcttactctcttctccaacctctctcactgtccctcaaccactttgtcctttccactcttcaatctctccacgttcttttaactttgaacttcnctttccattttctggcgagagacaagagga

SEQ ID NO: 640824 - DNA, 106 bp, Homo sapiens
tattggttgcaatagcagtaggctagcatggttatcgcataataaactagtatggggcatcaggggtgtaggtgtgccttgtggtaagcatgtgggctcagggcat

SEQ ID NO: 640825 - DNA, 179 bp, Homo sapiens
tcctcttcgttgaagatcgaggggcatcatatgccgaggccgatgccgaaattgatgaagcattttatgcccattgctgaggatgaaatcctagatgtcaacaggatatgactcatgtcccagccacttcgtgtcagggactttccctggctaacacattcatccgagaaacttaggat

SEQ ID NO: 640826 - DNA, 320 bp, Homo sapiens
  misc_feature (10)..(11): n is a, c, g, or t
  misc_feature (64)..(64): n is a, c, g, or t
  misc_feature (126)..(126): n is a, c, g, or t
  misc_feature (230)..(230): n is a, c, g, or t
  misc_feature (308)..(308): n is a, c, g, or t
gaccaagccnnttgagtgttttcctcccctttggctccaaggttacacattaacccctgtgganctcttaagtcaaccaaagcccagtcggtttctagatggaggctcactctatcgcccaggctngagtgcaatggcagaatctcggctcactgcaacctccgcctcccagattcaagcgattctcctggcctcagctactctggaggctaaggcaagagaatcccttnaacccgggaggtgtaagtttgcagtgagccgagattcgcaccactgcactccagcctgggatgacagagcaagtgctncctcttcaaaaa

SEQ ID NO: 640827 - DNA, 118 bp, Homo sapiens
agtattactgatctttggtgttgtgggtagcgcggggcgtatctccagagcgaactcagtgtgattgggggtcgtgtctaggccctgggggtgggaagctgagggtgaggctggggcc

SEQ ID NO: 640828 - DNA, 644 bp, Homo sapiens
  misc_feature (148)..(148): n is a, c, g, or t
  misc_feature (276)..(276): n is a, c, g, or t
  misc_feature (279)..(279): n is a, c, g, or t
  misc_feature (285)..(285): n is a, c, g, or t
  misc_feature (298)..(298): n is a, c, g, or t
  misc_feature (304)..(306): n is a, c, g, or t
  misc_feature (313)..(313): n is a, c, g, or t
  misc_feature (318)..(318): n is a, c, g, or t
  misc_feature (320)..(320): n is a, c, g, or t
  misc_feature (322)..(322): n is a, c, g, or t
  misc_feature (566)..(566): n is a, c, g, or t
  misc_feature (642)..(642): n is a, c, g, or t
gacacaggcagtaccagtggcaccagcagcccaccagccccctgccgccctgtaccttgtatctccctttccccagggcctgtgcttgaacctgaggcactgcacaccccacactcatgaccacaccctccctactccctttcacccncagcctggtcttcacctaccacagcactcctgagccttgtgcctcagctcatcgcaagagtagcagcagcagcggagacccatcctctgacccccttggctctccaaccctcctcgctttgtgaggcnccngagccntactccctgcagntgcccnnnaagcaangtctncncnccttcccccaccagtccagctggcctggacagtatcccatacccaactccagcagctgcttctccatccctctaatgagactaaccatattgtgcttcacagtagagccagcttggggccaccaaagctgcccattgtttctctaggagctgggcctctctaggcacaatttggcactaaatcaggaggacaaaatattttcccatttctggccggaggaattccgggggaggcccaggaggantttgttaggattccttaggagggtcctctggggaggccctaaaccctttccagattcattggccacatttttcccntc

SEQ ID NO: 640829 - DNA, 612 bp, Homo sapiens
caacgatggtcctcagcttccacgtagcaggattacaggtgcccgccactatgcccagctaattttttttggtattattagtagagacggtttcaccatgttggccaggctgggcatgatggcatgtgcctgtaatatcccagccacttgggaggctgaggcaggagaatcacttgaacccaggaggtggaggttgcagtgagccaaggttgtaccactgcactccaacctgggcaacagagggaaacttgtcttaaaaaaaaaaaaaaaaaaaaaagcttgctgagatgcttaagtgagggaatggtgccttccatttttcctgactcatttgcctgtagcatagggaggggtcaatgataccgaagggaattggttttcatttaagccccttttatgtaaggggcaagaggtgggctattggatatgttttctcccttttaagcctgggaataacccatccaagtgggaaatattatctccattttataaacaaagaaatggagattcagagtggtaaagtcacgtttccctgaatcgccttgcaaataggtgattaaaatctagtctgagcccacatcttcattctttcagatattatgtcataatagc

SEQ ID NO: 640830 - DNA, 160 bp, Homo sapiens
cggacgcattcagacggctctatcttcccaaggagcagtgcacacatgcttccggcaatgtggtctcaccaggcaccagatcaccatcactgacaactcgaaccaagaaccaactggaatcatgctccgggcacagacagaggtgagaattattgtgtga

SEQ ID NO: 640831 - DNA, 537 bp, Homo sapiens
  misc_feature (25)..(25): n is a, c, g, or t
  misc_feature (33)..(34): n is a, c, g, or t
  misc_feature (59)..(59): n is a, c, g, or t
  misc_feature (472)..(472): n is a, c, g, or t
gactgatcagagcataccctatccngatgtgtnnccctgtgatctacttctggcagatnctcagtctggacaggtcttccctatgagatagaacctgataaggagctagggcaattctgacaacattaccaaaggcccacataacttctaaattttggtctggtctgaaggaaaacctgttcttgccctagtgatggatgaactctcttatctctggcttctagagaaaaaaaaaagcatacctcttttactttttaagtacctccatcagagtcatgaaatcacctgtcaagactatctatcttttatgtttccattctggtaagaactctttaaatgaggacactgctgattgctggtgatgttttttgagcaaacactcgggggtatggatgaaagccaatcgcaggtcaaatgactccttggggaagctacttctcctctattcagatttcactaaaatcttccaagntgaaagcaaatctaggatttcggtcttcattggctgtccatttttgtaatgaacgagtgtttttc

SEQ ID NO: 640832 - DNA, 286 bp, Homo sapiens
tcacacgactccctgtgcgacgaccggtttctcacgtgggacgacacgacaaccacgctctggacgactggactgctggtgactggctgcccacaccacacgtgctgacattgtgcttgacacacctgacgctgtgcaccttaccacaccgtggttactgtgtgtgttggcctgaggctgcggatggctgcacacccttagcacacccccacgcaccattatgggacgtgccgacggatggagtggactcacccatgacgtgtcaccgtgactgttggacagaccc

SEQ ID NO: 640833 - DNA, 442 bp, Homo sapiens
  misc_feature (51)..(51): n is a, c, g, or t
  misc_feature (64)..(64): n is a, c, g, or t
  misc_feature (72)..(72): n is a, c, g, or t
  misc_feature (106)..(106): n is a, c, g, or t
  misc_feature (118)..(118): n is a, c, g, or t
  misc_feature (122)..(122): n is a, c, g, or t
  misc_feature (187)..(187): n is a, c, g, or t
aagttttttcaaccaaccacacttaagcccaaaattattattcagatttgntgtgaaaattaancagcaaantgcaaaaataagagtaccagaagtatgatcaaanccatgcattctnacanttttaaggtcagctcatcattttgggaagggcagggcttggttttaaaagtataacttaaccggntgtcacgcctgtaatcccagcactttgggaggctgaggcaggcagattgttgagtccaggagttcaggaccagcctggacaacaaaaaccccatctccactaaaaaaacaaaacattagccatgcacacctataatcccagctactcaggaggctgaggtaggagaatcacctgatcctgggacctgtggctgcagtgaccaagactgcatcactgcactccagcctgggcaaccaaagcgagaccccttctcaa

SEQ ID NO: 640834 - DNA, 155 bp, Homo sapiens
gatctgccgccgggttgctgtgcgactattctccgggagccgtccgtgtaaccgccggaacctggcggaggttaattatagaaatgccaagtagggaatttcccattggttaagtggtaagaggtcgattggccttggagttcactttattatga

SEQ ID NO: 640835 - DNA, 133 bp, Homo sapiens
ggggacttacctttagttttaggaggcttgagattggaggatctcattctgccttcctggttcctgctttggtgtagggttggaaaacagaaatcctctagctctcctcagattctacctccttaagctttta

SEQ ID NO: 640836 - DNA, 103 bp, Homo sapiens
cgtgttttggtaaggtccacagtgaaaagtcccaaactcagccacgatagaggcaaggccgccatatacaaagggtttccaatgcagaccagacatctcatga

SEQ ID NO: 640837 - DNA, 559 bp, Homo sapiens
  misc_feature (70)..(70): n is a, c, g, or t
caccatcggcggaaatccccgagggtcacgcacggcaatcaacgaatccagtgtcagaaacagcaatganacagcgccttcggtttctgccagaacacttgtaattgcttcgacgacattgttagccggcgttcgggcaatgctgtgaagaatcgtttccgtatcagatgtggaggaaaagattgcaccttcgcgttcgagttcccgacgccttacatccgcgaaaggcagatttccattatggcagattgccaattggccatgctggcagatgacggaaaatggctgtacctcttttattgtgttgcggcctgccgttgaatatcgcgtgtggccgatggcagaattcccgcttagctttctgagagtttcttcatcaaaaacatcggctaccagcccaatcgaacgaaactgatgcagttcatttccatcggaagaaacaatgccgcaagcctcctgcccgcggtgctgcagtgcaaaaagaccgagctgtgtaagtgtggaagcctccggatggccaaaaaccccgaaaatcccacactcttctttgaacttatcg

SEQ ID NO: 640838 - DNA, 151 bp, Homo sapiens
aattaaaaattgccaagaatggtggcatgtggaggcaaatggaggctgaggcagtaggatcacttgagcctggaaggccaaggctgcagtgagccctgattgtgccattgtcctccagccctgggtgacagagtgcatacttttctaaaaa

SEQ ID NO: 640839 - DNA, 278 bp, Homo sapiens
ggtttcactcagtaaacaggatttactactttaaggaaattttaattggaaaaaattgcccgtggaaatttctgtatcagattgtggtttactgagttatcaccttaacctggacactattcctaaactgcaccacagccggttgtttcaagaaacaaaaacaggccgggcgtgatgctcaccacctataatcccagcactctgggaggccgaggtgggaggatcacctgaagccaggagttcgagaccagcccggccaacatggcaaaaccccatct

SEQ ID NO: 640840 - DNA, 719 bp, Homo sapiens
tttttttttttgtggaaatggagtcgggctctgtcgcccaggcgggagtgcaggggcggcatctcagctcacgggaagctcggcctcccgggttcacgccatggccattctcccggcctcgcctcccaagtagcgtggggctacaggcgcccgccaccacgcccagcgtaattttcgtggtattttttatagtagagaacggggtttcaccaggttgggccaggcgtggtctcgaactccgtgacctcaaggtgatccgcccacctaggcctcccaaaggggcgtgggattacggggcgtgagatcacgggcgccgcggccccaggtgacatatttagtgagaaacaaagagacaaggcagtggcgtgacctctccgagggttacagccgtggagaagagggtgaaagggtgttgggtggttccaagcagcctcagggcagctggtgctgcggcgtgcatgttcgggcccgaaagcggggctatggggtctaccagatgccttcagggaaaagggccagaacctgcactggcacggcacagtcactgtgtgtggtgtgggacccagtgtcggctgagaggcctggaggggtcttgcctcccttgtagtccttggtgtcctaaccaggagggcctcatttggcctgggcggccctgtgcccactattcacaggccaggccggcacatgaccttgcctaggggggaagtccccagtgtttc

SEQ ID NO: 640841 - DNA, 1033 bp, Homo sapiens
agcggggtgaggctatggctgcgataaaggccgtcaactccaaggctgagtgtggcgcgggcccaggcagcctttgccctgtcaactatatgcgccgcccgagggctgcaggactgtgcttgcggaccaacttgggtcctaacatggcaccagtgaagaagtgcttgtttcgtggtgcagcatgacatccaagactcacccaaagatggcaactgtgctgctcgaatgagatgcaagacttcaacagtccaacagcgttccttgcatagcaagaagtacgcaacagcgtcaggatgacgtcacaggacgatcgtacgtacttcaaatgttcgtaaattcattggagagttcattaaagactaagctgacctgtacatttctgtagggcctgcagccctagaataatagctgaaggatttgaatgctgcaaagataagcatgcacttgaagttctcggacggaagttagaagtgacaacaggatgatgaccatgcaaaaatcctcttagatgtagctagaacatcattacgaaactaaagttcatgctgaagctggctgatgtcttaaccgcaggttgtggctggattctgtatcggctgttagcacatgaccagggttaccctattgatctcttcatggtagaaatcctggagatgaacgcataaccttaggaaccagtaatacgaaagttgatccaaggattagcttggactcatggggtgtgccgtcatcccagatcttgaactaatgcggaggttgaacgattggcgcttttatcccttactttgcaaacggcttcacctggtaacttgttggcacacaacgggaagtgtgaagctcctgcgccctcgttggtaatagaggaactggccgtattaacacacaggccccaaatttggggtgaacaaggtcggagaggaccaacttatttgctcgcatagcagttctccgaaaacatatagtgaaccctcaaagggacaaagtctctgtggacacggcaactcaaaaaggagatgttcggcgctattaccaa

SEQ ID NO: 640842 - DNA, 118 bp, Homo sapiens
  misc_feature (27)..(27): n is a, c, g, or t
  misc_feature (60)..(60): n is a, c, g, or t
tgtgttcttttccgatcttttgtagtnatacacatgacaattgggtttcacgcacgtcantgagatgttctccttcaaaccttgttactatgtcagcacattaactgcctggcatgga

SEQ ID NO: 640843 - DNA, 736 bp, Homo sapiens
  misc_feature (1)..(1): n is a, c, g, or t
  misc_feature (26)..(26): n is a, c, g, or t
  misc_feature (42)..(42): n is a, c, g, or t
  misc_feature (348)..(348): n is a, c, g, or t
  misc_feature (358)..(359): n is a, c, g, or t
  misc_feature (361)..(361): n is a, c, g, or t
  misc_feature (384)..(384): n is a, c, g, or t
  misc_feature (393)..(393): n is a, c, g, or t
  misc_feature (405)..(405): n is a, c, g, or t
  misc_feature (413)..(413): n is a, c, g, or t
  misc_feature (415)..(415): n is a, c, g, or t
ntagttgctcgtgtggctggcttagnaattgaccctaccagntgcctcctcctggtgactaccagctatggaaccgttggatacaacctacctgactcaccccacagacctcacagcgcacatggacagcccccacacgccagagtgacctgctcggttgcagcgggagtcaagaaatgtgcctgctgacactcaccccacagactagtgccccgtggaaaacttatttgggtaatgttctgggccgaataaaggctggagtcccacagacccctttcctctctcctgctccccactcatcttccccattttgttcagccctatgaggtgtgctactgtattagtccnttttcacacnncnggtaaagacatgcccaagactgngtaatttcnagaagaaagagntttaatanangcacagttccacatggctgggtaggcctcacaatcatggcgcaaggtgaaaggcacgtctcacatggcagcagacaagacaagagagcttgtgcagggaaactcctctttataaaaccatcagatcttgtgagacttattcactatcagaagaacagcatgggaaatacctgcccccatgattcaattacctcccacctgttccctcccacaacatgtggggaattcaagatgagatttggctgggggacacagctaaaccctttttttagttcccttttttctctggatctgggaggataaacctaacttggggattgtc

SEQ ID NO: 640844 - DNA, 178 bp, Homo sapiens
ctggtcatgtctacgagttcccctcacgcccattccacaacagtcaaccatcgtaaagcacaaaccctgctcagcccgtgttgtacaaaatgaaggggtgcagccctcgcccggggcacagggtccggacagctcgcggggccaccctgtccacggctgtgcatgctctacgctggtg

SEQ ID NO: 640845 - DNA, 479 bp, Homo sapiens
cctcatctaatctgccttcccctcatccacagacaatatggagaaagaaaatgggaggatgtatgttatccactttatctatgctttgtccccgttgttagactgacagcgtcagtaaatcggtgggacatagatagaaccgtgaacagaaaacagaaaaaacccggagacagggagaggctgagagggaagtggtggcatttactgctctgacacttccactgtccctgctggggatgctggggccaaggcctgtggggcctgtgaactgcacagccaggagcaaggaacccactaaatactccgtcacctccatgtcccctctacagtgttaaattattacataagcaggtgaaaggtagaaggcgaattatgtgagtaaatatggtctgttttctcttcagcaaaaatgactatttttgtgtgtgactaatttatttttattattgtaaagatacaataaaccggttgaaatatct

SEQ ID NO: 640846 - DNA, 129 bp, Homo sapiens
ccgatccttctccactggttgcgggctacaagttcacacagcagcctgataattttggtatttttagtagagacggggtttcaccatatgggccaggctggctcgaatcctgactcgatgatccaccca

SEQ ID NO: 640847 - DNA, 376 bp, Homo sapiens
  misc_feature (7)..(8): n is a, c, g, or t
  misc_feature (33)..(33): n is a, c, g, or t
gttttgnnctttcctgtaaccttttcagggctngcgtcccctgtaggtggggggtatagtggaaccgggcctgggttttggggactggagggcaggggtccttttgccctggggtcccagggtgctttgcctgctcaggcaggccttttctgggagcccctcgccccgagactcagcttggccaacttggggggctgtgtccccccagcccgcccgtcctgtgggctgccccgctccccttgttccctcctgccccggttcgagggccgagtctgtgggccctttctgccttcctgcccctgtccttttttacccgtcgccttcccctgttatccccgcctcctggctccgtccttttataaagaggggccctcca

SEQ ID NO: 640848 - DNA, 788 bp, Homo sapiens
gaggacaggggacagtggcgggcgtgtgaataagcttccagagaatgatgcccacatcctagtgtatcctattgaatagaggggactgatagactcccaaggcatcccccaggcttgtgagtaacatcagggcctgcgcgaggatgattgctggacggtctgtaagaactatcccttgggtccccgtggcgtggacaagcttatggtagagtggcagaggcaaagcaagaattgctaatgatgggggcacaattctgacactgtctggatgttgtccatcctgcgagcaaagacgttgggtagacattgccaaatcccaagatgctgaggtgggtgatggcaccagctcagtgaccttgctggtctgcagagtttctgaagcaggtgaaaccctagtgtggacggaaggttgtacagcccgcagatcatcatacgagcgtttccgcacagccacccagctggcgagttaacaagatcaacagagatagctgtgaccgcgaagcaaggcaggagtaaagtggagcagacggaagctgctggaaaagtgtgccaggaccgctctgagctccagaagctgatctcccagcagaagagctttctttgctaacgatggtggtggatgcagtggatgatgctcgatgacttagctggagctttagaatgataggcatcaagaaggtacaggggggaagcccgtcgaggattctcagctggtagctggtgttgcattcaagaagactttctcttagcgccgggttgaaatgcaatccaaaaagtaccacatgccc

SEQ ID NO: 640849 - DNA, 633 bp, Homo sapiens
  misc_feature (24)..(24): n is a, c, g, or t
  misc_feature (168)..(168): n is a, c, g, or t
taaagagactcgtgtccgattggnggtctttctcccaaaggaggcagttatttgataaacacgaatatccacggttcccccctgttgttagtaatgagctgcttcacacaatcttagccttttttacaacaagacatcacgcctgcggtgggcctgtcccattcacgnctctgcgactgctcgttaggccaatcggaactgacctctcgggtgtcacgccacctcgcgtccgcgctctgtgcggcaaggtgtttaggctgggtctccacacgttattcgctgtcaatatgttcaacacgtcgctcagtgacttgtaattcccatctttatagggagcattgggcggccggctccgctaccagctctcggttcttgataagagtgacatgggatacgcccaaccagccagtccctagggagtgcagttccccttcccaccgtgatgaaacgttctgtcttgattattagatcctccgtaggtgggccaaggccattctcatgtcagcatccgcccgaataacaatcgttctttctctcggtcccaaatatcaggcagttgcaggttgtggcaggtcactctcaagaaaaacctcccctcggtcagtgcagcgccccatgtcaacttacaccctg

SEQ ID NO: 640850 - DNA, 444 bp, Homo sapiens
  misc_feature (75)..(75): n is a, c, g, or t
  misc_feature (87)..(88): n is a, c, g, or t
  misc_feature (417)..(418): n is a, c, g, or t
  misc_feature (426)..(426): n is a, c, g, or t
aaaatggtgtaaactcttttgaagccaaaagggagggtttgtttagcccaaaagttcaaaacaagctggggaaanaccaaaaccccnntttttttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttnnaaaaaatnataaaataaataaatgcg

SEQ ID NO: 640851 - DNA, 376 bp, Homo sapiens
agcgtaaaccgccggccagtgattccgtattcttggccatagttgtttcttggggtcaaacctccgccctgagattccaaatcctggccctaagttcttcctgggggcaaaacctcctccctgagttccaccccctgcccttaattttttcccaggggcaaaacctcttcccggggttcaaaaaccttcccttaaattcttaacctgggccaaagcttttccctggggttaaaaaacctgccctaaatttcttactttgggccaaagctttttccgggggaaaaaaacccccccttaaattctattttctgggcaaaagcttttcctgggggaaaaaacctcccccgagatgtccaaacctgggcaaaagattttt

SEQ ID NO: 640852 - DNA, 840 bp, Homo sapiens
  misc_feature (38)..(38): n is a, c, g, or t
  misc_feature (61)..(61): n is a, c, g, or t
  misc_feature (74)..(78): n is a, c, g, or t
  misc_feature (80)..(81): n is a, c, g, or t
  misc_feature (96)..(98): n is a, c, g, or t
  misc_feature (114)..(116): n is a, c, g, or t
  misc_feature (118)..(118): n is a, c, g, or t
  misc_feature (124)..(124): n is a, c, g, or t
  misc_feature (129)..(129): n is a, c, g, or t
  misc_feature (136)..(136): n is a, c, g, or t
  misc_feature (153)..(153): n is a, c, g, or t
  misc_feature (157)..(157): n is a, c, g, or t
  misc_feature (187)..(187): n is a, c, g, or t
  misc_feature (281)..(281): n is a, c, g, or t
  misc_feature (288)..(289): n is a, c, g, or t
  misc_feature (291)..(291): n is a, c, g, or t
  misc_feature (298)..(300): n is a, c, g, or t
  misc_feature (312)..(313): n is a, c, g, or t
  misc_feature (319)..(319): n is a, c, g, or t
  misc_feature (341)..(341): n is a, c, g, or t
  misc_feature (357)..(357): n is a, c, g, or t
  misc_feature (359)..(359): n is a, c, g, or t
  misc_feature (369)..(369): n is a, c, g, or t
  misc_feature (371)..(371): n is a, c, g, or t
  misc_feature (382)..(382): n is a, c, g, or t
  misc_feature (468)..(468): n is a, c, g, or t
  misc_feature (476)..(476): n is a, c, g, or t
  misc_feature (478)..(478): n is a, c, g, or t
  misc_feature (482)..(482): n is a, c, g, or t
  misc_feature (485)..(485): n is a, c, g, or t
  misc_feature (491)..(491): n is a, c, g, or t
  misc_feature (813)..(814): n is a, c, g, or t
  misc_feature (822)..(822): n is a, c, g, or t
cgcctgaaaccctcgcgccccccgcgccccccgcgccnctctttttccccttgatggaaantgaccatacaatnnnnncnnccttcaggggatcannnggacggagtggggggnnngngggggngaggnggggggngtggtttccaatgtgtncaangagatattaggagcagaaatgcaaggggcngcaagacctaccaggacagaactttccccaattacagggtgactcacagccgcaagggtgactcacttcaatgtgacacttccggctgcggtgngtgcgcnncngacacgnnnggggggggtggnngagagngacaggcagctcggactcaacnaccatagataatatcncngaaaacctancngccagaggggngggcacaaagagggatgtaatgcactttgggaggccaaggcgggaggatcgcttgagcccaggagctcaagaccagcctgggcaanaaaccaanancccnaanacaaanaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttnnaaaaaatnataaaataaataaatgcg

SEQ ID NO: 640853 - DNA, 225 bp, Homo sapiens
ctggattggagtggttattgatcctgagaactcatgggaatgttgtgtgtacagcagtggtgtctggaggaagtcgctggaggaagaatctataggatcatcagatctcgcgcagaattgagtgcaaacagatctcccttttcatcctctcactcagatgatgtatagccctcagacttctgattatcttttagctctcagcactgaaaatggcgcacgtaggag

SEQ ID NO: 640854 - DNA, 942 bp, Homo sapiens
ggcctccaagcgcgccccgagcagccccgtggctaagccgggtcctgtcaagacgctcactcgtgaagaaaaacaagaagaaaaaacaggtttttggaaaagctaaggctgcgggaagtaagcaatgaagccagccaagctggcccctggtgctgtgtgtgctgacctccaacaggcaccagcaagacttttctcaaacactggaacggctgctgcaacgagtggctgctgaaacaacaaactctcatggccccagaaaagcctcttgtcatctctcagactgggttccaacaaagaagcccaaaattatccagcacaaacaaaaacacgagacctcgcctcacgctgaagggacgaggagatgccggcaggaaaagaccaggaggccagcacgggcgctctgttccttcaggcttccaagatggacaggagggcgccagtacctcgcaccaaggccagtggacacacgcgcacaataagaaaggaaccaaggacaggacaaatgcgtgatatcgatccagaacgcacgggacatcgcagcatcacgcaagcggcaaagctcaaggacgcgccacccccagcccccacccaccgcgccacacgacatctgcgctccgaccgacccctgcgcacccacccgcgcatactcccaacgactgccactacgcgtcccacgcacgcgcgccaacaatagccgcgccaacacacccggcccccccgcgacgcgcaccccctacacccctcaccctcgcgaccagacacccccctccgccggcccctacaccagccctaccccttgccccgtctccctgctggccggtcccccacacgagcccccccccccgccccccctcagcccccgcgtcccccccccccacctcgccctcccgctctccgccccccccccccccccctctccccccccccgcccctcctcccccc

SEQ ID NO: 640855 - DNA, 631 bp, Homo sapiens
cctacccccaattaggagggctcggcctgatccaggactgcaccccacccccacgtccagccatccaacctcacttcgccttacaggtctccattttgtggtaaaaaaaggttttaggccaggcgccgtgctcacgcctgtaatccaacactttgagaggctgaggcgggcggatcacctgagtcaggagttcgagaccagcctggccaacatggtgaaacctccatctcccagctgggtttcaccaccaagctcagtgcctaccatgagctgtgcaggagacctggctggccgccctgatcgtgttggcggtgcttgaagccatcctgctgctggtgctcatcttcctgcggcacgggattcgtatggccatcgccctcctgaaggaggccagcaagcctgtgggacagcatgatgtctaccatgttcatacccacgtggtcccttttgtcctcctcctcatctgcattgctacgtgggccatgactgctctgacctggctaattcggggcaaccccagtatgtctctgggcatccacatcagctccccggctggagaaagtgccataactcctcatgcaccccaaggccaccttgtgaaccctcgtgccagtgttgtgtgcgttccagg

SEQ ID NO: 640856 - DNA, 313 bp, Homo sapiens
tggccaggactagcttaatagacattattaccccatggatttatgggataataaaggttatttcatgtctgcttatgaagatactatgtatgaaattacttcagagagctatatgtgatgtgaaaataaattagctagggttaaggttatattctatttccagcatagaaggtggataatctaatggtgtagaaagaatcactaggttgtcatttaaccagttattttcatatatagtatcttataagagaacatgaaaaacatttattatcccataaaatccatggggtaataatgtcaatttaagactggt

SEQ ID NO: 640857 - DNA, 275 bp, Homo sapiens
agtagcccatcagaagaatcgtcgttccaggtacatttaaaagtaacaagctgtcctgatcttgagtctcagaggtacagtccaaaacagtcccagatctatgaacattcactttagggacagtgaccaatatcgctattttcaggggccttccctatacatccactcggactaatggcaaacaggcttacctccagttgcaaaggataatattaaactgtagtgacttaactaaggttggatttattctctgacctattccagaattgccccga

SEQ ID NO: 640858 - DNA, 498 bp, Homo sapiens
ttggacaaaattccccagtactgctttaatagtgaaaaaaacacacccccatccaaaagaagtttcaacacggcttgtcgttagaattcaaagttttttcctgccatggggagagcccaggcgaacctttcccgctgggttttgctggagatcttttccactggcaccctgaaccgcttgcaccaggcaatgctgatcctggggtccaggtagttgagcttggacgtgcccagggccacctggttgttctcctccttggccggggcctgcacactcagctgcgccagctgctcctgcagcttttccaggagccgcctttttttctccaggacactcctggacttgccatccccttgggctttgggctaagccctcgccctcctaagttttgccctggccttagccacctgctccttttttgcctggatctttgtttggagattttgcatcgactttttgaacgtactgggggttgctcgctgatggttgcagaaaatg

SEQ ID NO: 640859 - DNA, 173 bp, Homo sapiens
gatcccccgccataccggatttcactggtgctttttctacagtctccctcatcatcattaatcatcatcatcatcatcttcatcatcatcctcttcatcatcatcgtcatcatcttcatcagcagcaagttttacttttttctgtggaacctagctaccacctccagtgaaat

SEQ ID NO: 640860 - DNA, 113 bp, Homo sapiens
tcgaatcgagctcggtaccgaattcgacacgtgtgcattatgacatgcgccctcaggcctgcacggtacttccgcagcgggtacagccgctccttccgctgctgcttcttggt

SEQ ID NO: 640861 - DNA, 101 bp, Homo sapiens
agacagtagcaggttcaaggcagggtgcatggtggctcatgcagggtggggcatgcatgcaggctcattgtttttttgtgcaattcattcgcatccatggc

SEQ ID NO: 640862 - DNA, 141 bp, Homo sapiens
  misc_feature (140)..(140): n is a, c, g, or t
ggaaaaacgtcagaaaagggaagtggggttaagatggtgcagacgagttagtgggtgcagcgcaccagcatggcacatgtatacatatgtaactaacctgcacaatgtgcacatgtaccctaaaacctaaagtttttttna

SEQ ID NO: 640863 - DNA, 284 bp, Homo sapiens
  misc_feature (56)..(56): n is a, c, g, or t
  misc_feature (126)..(126): n is a, c, g, or t
  misc_feature (188)..(188): n is a, c, g, or t
  misc_feature (216)..(216): n is a, c, g, or t
  misc_feature (236)..(236): n is a, c, g, or t
  misc_feature (244)..(244): n is a, c, g, or t
gagatactttttactgtgatatgtaatttactggagacaggaactgctcgtttggngatggttagcatcacagggtgttttaagtcgatacttgcaacccttgagctcaccacagtagcaacaggnggtggctaggaaattattcacagcaggacagtacgcactgcaattaattgtatgcagttatnatttaataccacatctttatgctcacgnttctctcaactgtgaatggngccatgtnacagttggtatgtgtgtgctttaagcttcttgataaattt

SEQ ID NO: 640864 - DNA, 289 bp, Homo sapiens
ctatagaatctctgcagctctcttgccttctccctaagctggtacctgccctccatataaatgggcttctgatagtatacacacttctaataaaatccacaataaaccatgttctcactttcacatgtatcatagcaactgctttatatgactgatgatggcttccttgcacaccacatatacagtgcgcatgatatagccgggcttctggagcaccagctgcagcctggctactgctttttactgcagaatgaactgcagtacagcatagcggagtggaggcttgctg

SEQ ID NO: 640865 - DNA, 251 bp, Homo sapiens
aagcgggagtgcggtgtcatgggttgtggctgactgcagcgcgtcaaactccctggactcaagcaatcctccccctcgaggtccctgagtagctggtactacaggggtgcaccagcatgcctggctaatttttaattttttttgtggaaacggggtctcactatgttgcccaggctggtctccaactactggcctcaagcaatcttccagccttggccttccagagtgctgggattacaggcatgaaccac

SEQ ID NO: 640866 - DNA, 791 bp, Homo sapiens
atgagtacatattggccagcgtgctccgagtatgatgaactccgtgggtctgagagtgggcaaacagtggaagaaggttggtgacctggtgcctgtgcctgacactggactagaccttgcatagggacccattactggaactagtagacgcatgagactatgagagaccccattgagaagtaattggcatttatcacactgtggacattctaatacctgctatcactactgtgaaactactgaatgcttacaccactaggagcgccttgtgtgcttcaatcgtcatgtgacctagtgtgagaggcatcgcgggactccgttcgcacagactgtcgaaagagacacaggcgagcctattggtgcgaacactttggtgcaacagaggacatacatgtggaggcacgtcgcgctatcgcgtctagcactggtgacacataattgcggagccgggacacaacattgagagggtggaccagaagcacacaccaccgaagcagaactccgcagcagaacagaaaaaagaagaaagagaagaagaacaggaaggaacacccacgacagcgacaaagcaacaaacaaaacgaacagaaacaaaacgataatcgaaaccacgggagagagaaccaacaaaacacacgtaaccacaatatgccgccaaaaccaagctaggagatcacgacacacaaaccaaccagatacacgcgccacattaggagcaccacagccgcgcacgctgcagaccacacaaaaaaaatgcagagaaaacaggagggacaaagaagcggacaccc

SEQ ID NO: 640867 - DNA, 189 bp, Homo sapiens
agcttttaaaatgcttttgtatttgggcctttcatacaaaaaagccaaaataccattttcatgtaatgctatacttctatactattttcatggaaaaactacttctatactatttccaggaaaaacatacctctatacctttttccaggttaatactatacttctatattaaagttttacccactcaaa

SEQ ID NO: 640868 - DNA, 337 bp, Homo sapiens
tgtcttacgctgaatacaaaaatattaagttaggccaattaacaaccctacagtggcctctacatattcaaatgaatgatagtcgcacatctcacacttaaaatcaaaagttagaaatgagctcagtgaagaaggcatatcaagagccaagatacgacaaaaactaagcctcttgtgccaaacagccaagttgtagatgcaaaggaaaagttctggaaggagattaaaagtgctaacccagcaaacacatgaataataagaaagctaaacagtcttattgctgatatggagaaatcttaatggtgtcaaaagaagaccaaactagtcacaacatttc

SEQ ID NO: 640869 - DNA, 370 bp, Homo sapiens
aaaaaaatcactgaggctaatccaaatgtctgcttgacgaggcttttgtggagcaaggaggagaggcttggtgaccagacacctggcgaaatggcactgatcctgatatgatccagtggtgctactcggtgtggccaggtgatttatggagggaacttcagacctgtttctatggttgccccacctcccactccgactttcttacatacttcatgttcgtgcgtttcaagactttgccgattatccacattccatctctatttattatttacttaatattgttctctaaacgtactcgtgtttgaagttaaatgtgctcattatgtttcttctaataatcattaaagcaaatatataatcattcgaaaaa

SEQ ID NO: 640870 - DNA, 269 bp, Homo sapiens
tcccccataggggtttcgcccccgatggtgggtccgggcctccccatggggcccccccttttaaagggtggtttgttccccgattaaagtcccccggggtttggggtccggccgggggaatcccgggggggtttttttttcttccaattcccccccgggcgaaggggccagggaaataggggctccttccccaggggccctcccccgggaatggtttcttttccccttgggttttttcccccccccccccccggccgggggttgtttta

SEQ ID NO: 640871 - DNA, 709 bp, Homo sapiens
gggggtaaaacttagtacatgtccctaaatatttaaaaccaaacaaccattaagaaaaaaaaataaaacccaaaaaaagaataaacaaaaaaaaaaagaaacctgaaacaaaaaaaaataaaacccttggggcccgtttggccccttatgccttttggttcctataatttttactaatccgtctgcattttgggtcatttggccacttgccccttttggggattcgttttaaaataacttggccggcgtttaacacggtggggtttggaaaacccctggcttacccaaccttacgggttttgagttaaatcccctttttcccctttgcctttttcccaaaggggcccaatgggaggggttttcaaaccgttggcctttcctaaaggtgaatggcaatttgtaggcgttattatttggataaattttgggttaattgttgtaaaattcaatttttttttaacccattggctttaaaacggaaaagccctttttatgtaaaactgttaacccgagaagggatagcccgttgtaccatttgggaccgggttccctttttagactttgtatttaatggtactgggtttcctttttttctggcaatgggcctttacggggaacggtccctttatgaacttttttgggataagggtctctaaggcctaagtcggaaccctatagggagccccctttgggttctccgggtgccctc

SEQ ID NO: 640872 - DNA, 319 bp, Homo sapiens
tcatatgacgtagtcataacttcacataaacttccgtgtctcgaaagcgtcaagagatagagttatgagtcgttgtttctttttaaatgggggtagttttctatctgtcatgggctctagcatctactccgctacccaattctgtcatctccaagctgagtttcctcttctgaggcagaggcgggagcagttctttttcagttctcatcctctccatcccaatccagtatatcaatcaactctaactcggagacgtctagctggccatgtttctacaactttcactggatttctttaggcattgaagcaaacatttttt

SEQ ID NO: 640873 - DNA, 195 bp, Homo sapiens
gtcatagtttgatcagtgtatgccgtcggtcgtgtgtgacctcgtccgttctaggtgaggacactggccatgcctttcaagtgcatgcagctcactgatttcatcctcaagttacccgcacggtgcccaccataagtatgtgctccatgcctggcagccggcagccatccatactccttttccgcccggggtacc

SEQ ID NO: 640874 - DNA, 659 bp, Homo sapiens
ggcgaggaagaagtcgacgtggcaggcggaaagcgtggcggctgcgtgctagagcctttccctttaccgcacccaagggagctggagcgacaacggaacgacgtcgtttccgtttccacgcacctcttcctgttcccgtccttgaggacgccgtgccgggtcagtgttagcctccaggcccgtggttgtggaaggcgacagagagtcatggcgatgtttgagcagatgagagccaacgtgggcaagttgctcaaggggtatcagacaggtacaagtccgtgagaacctggcgcacgcctggagcgctatgtaggagacgcaggccatgggaaaatgcctatgatctggaagccaacctggctgtcctgaagctgtaccagttcaacccaggcttctttcagaccacggtcaccggccagatcctgcttgaaggcccctcaccaacttgccgcacacgagacttctaccctgtgcaagtgcatgatcgaccaggcacatcaagaagaacggcaatccgacagattttgtacctcggggacctgctggagacctgtcatttccaggcgcttctggcaaagccctggatgaaaacatggacctcttggaaggtataactggctttgaagactctgtccgaaagtatatctgccatgtgtggg

SEQ ID NO: 640875 - DNA, 358 bp, Homo sapiens
gagatggggtttcaccatgttggccaggctggttttgaactcctgacctcaagtgatccgcccgcctcagcctcccaaagtgccaggatcacaggcatgagccaccacacccagcccatcaaagctttttgaaatgatctgtaggccaggagtggtggctgcggctgtaatcctaggatcatgaggccacaaggtgagttcaagactagcctggccaacatggcagaaccctgtctctacaaaactacaaaaagttagcttggcatgtggcacgcttctatgagtccaagctactctggaggctgaggtgggaggattgcctcagcctggaaggttgaggctgcagtaagccgtaatt

SEQ ID NO: 640876 - DNA, 91 bp, Homo sapiens
attgtttcaggtggaaagtattatacgagattctattaggatagatagtgctgtgactacattacagaatataactactgatgtctgcaag

SEQ ID NO: 640877 - DNA, 590 bp, Homo sapiens
gcccaccttctcccgctcacctcaccacctactaacgatctggtgatttgtctacagcaaccgaatatgctaataactacatgtgaacgtacatcaagccacatctccaagtacagtcgcatctacttctgtcagacctccttactaatgctgcggagtcgtgagatactggagcgcgtaccagtggtgctcccccaagagtggccgcgcagccaaagttctcgtctgaggagaggagatgatcgagcgcgcatgcacagctccatgtggatgccgctgatctgacagagactgcaggccggtcgactctatcagatcctggaccctccccggagctccatcagtcagctcggaagtccctgcacacagttggctatgaatgtcctcaatggatcccctcggtcgcactacctggctgacagtatcctctcatctcaaatctgcctccctgactcctaccgaaaagtgggctgacaggacacccagtgcagacctcttccactacgacagcatgaacgcagtcaactggggcatgcgagagtacaagatctacccttatgaactgctgctggtgactacaagaggaagaa

SEQ ID NO: 640878 - DNA, 387 bp, Homo sapiens
gcagccaccttccttcaccctcatttaatacatttcacatcctgacttgcctctgagaggaccactgtggtgtgactctgggttgggggagatggacacataagtaatcatgacacagaggctgggtgtggtggctcatgcctgcggttccagcacttcgggaggccaaggtggaggaatcgcttgaggccaggagttcgggaccggcctggccaacttggcgaagccctgtctctgctgaaaacacaagaattggctgggtgtggtggttcatgcttgtaatcccagctactcgggaggctggggcgggtgaatcgcttggacctgggaggcggaggttgcggtgagtcaggatcctgccactgtactccagcctgtacaatagtg

SEQ ID NO: 640879 - DNA, 188 bp, Homo sapiens
  misc_feature (122)..(122): n is a, c, g, or t
  misc_feature (152)..(153): n is a, c, g, or t
ctggagccaggtagttcgagaccagcctgggcaacgtggcatgactctttctgctaaaaaacaaaaaaagttaactgggtttggtgacatgtgcttgtggtcctagcagctcgggaggactnatgggacgaatccttgagcccagaaatttnnggttacagtgagctatgatcacaacactcagggct

SEQ ID NO: 640880 - DNA, 301 bp, Homo sapiens
aaaaaaaaaaaaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcccccttttaaaatttccctttgggggcccaatttttccctcccccatttttttttaaaaaaggggcccttttttgggcccttttttaaaacttggccttggccccctttttaaaaactttaacttggaaaaactttttccttggaatttttggaaaagacccttttttttggggg

SEQ ID NO: 640881 - DNA, 277 bp, Homo sapiens
gattgtcctatgcgacagaaggaagtaggcattgacaatttagcaaaatccaggaccagaccgtctcagatcttctaaaacatatgccatagattctgtggcagatttcaaggtctcaggccatgggctggagtccaagagttaagcaaatcttagcaatggggagagataggcattagcattggaaagagggacaatacgcagcccttagtacgaaagcagacaccgacaataaggagaccgcgcctgactctaatctagacatagaagatatctg

SEQ ID NO: 640882 - DNA, 102 bp, Homo sapiens
atgctcagtgctctagctggcagcgggaacccaggctacaacccatatcgtcgagtgccaggacatgcagtgcgcaccgtcaagtgtcgatggcaccaagct

SEQ ID NO: 640883 - DNA, 250 bp, Homo sapiens
  misc_feature (80)..(80): n is a, c, g, or t
ggggtttcaccgagttagccaggatggtctcgatctcctgacctcgtgatccacccgtctcggcctctcaaagggctggnattacaggcgtagccgctgcgcttagccagaaataggtttttactctgtggctcaggctggtctcaaacttgtgggctcaagtgatccacccactttggcctcccaaagtgttaggattacagtgtgagccaccgtgcctggcggattcattttttttttttttttttaa

SEQ ID NO: 640884 - DNA, 364 bp, Homo sapiens
gaagagaaaaagtccccttgaaatcagggctactaatatgatgagtaaactaatttaaaatatcttcgttaaaaatttatatttttaaaatattctatttaaccaccacattcagcattgcacatagaaattatatttgcacctgggatttttgtggactgaaatttatgtcttcatacatttcatatgttgaaatctaatcccaatagatggtatttggaggtgaggcctttgagaggtaattaggtaatgagggtggagtccttatggatgggattactttctctttaaaaaggagggaggaagatcacttgagtccaggagtttgagaccagcctagccaacactgggagactctatctgt

SEQ ID NO: 640885 - DNA, 117 bp, Homo sapiens
tcccctcagttaagcgagcataacggagctcagtaagcggagcatcagtaagcgagcatcagtaagggagcaacacaactatacccccagcaggcgtgaccgctccgcttactgatg

SEQ ID NO: 640886 - DNA, 169 bp, Homo sapiens
cataatcacttttcctttactctgcatccgtattctgtatgccctttctcctaacacctcacaacaaaactaactaatactaacatctcagacgctcaggacataaaaaccgtctgaactatcctgcccgccatcatcctagtcctcatcgcccttaccaaagctagat

SEQ ID NO: 640887 - DNA, 119 bp, Homo sapiens
tcggattagggccaatagggatcatttgcttgtctaatagggttgctgggaaagcttcattcaggtcctcaagtggtcatctgatcgagatggaattaacgttcgttcatctctctcca

SEQ ID NO: 640888 - DNA, 586 bp, Homo sapiens
tggataatagtccattttattaaataatttataaagtcagaccaggtgcttggggctgtgtaaggggaaaccatttcctttcctacgtggtcacatatagccgtggcagaatttatactcagggtgccaaaaaattctccctttaattctcaatttatataagtgaaagtgtggtggaattaaagatagactccgtgtgcgtgtgttcagaggaaaagcctgtgcgaaccacatatctgtggtttatagaggtgtggagagccacaaagagggtaaagttatatctcccacaattctccaccaaacttctccccgcacgtgtgagacctctccgccacacgagcgtctcccgcgtgtgtcgtgcgcggtattctctcccatactccaaaatcaacacctctctaagagaatagtgtccccctttaacacaccccccaaaaaaacagagtatctcgcccaaaatctcaaaacactgtggggtgccacacaaaaagaagaggcgtttaattaagaatatttgttgggaaaaagaagaacataattctctccacaccccccccaaaaaacttttctctccacaacacta

SEQ ID NO: 640889 - DNA, 214 bp, Homo sapiens
cagagatctcgccactgcactccagcctgggtgacagagcaagactctgtctcaaaaaaaaaaaaaaaaaagttcccaattaagttctgttggtgtgggagccccatatatcacaccaggttaagaggaaactatggacctaaggtgaattaaaagaggatgaaatgatttggctctacaggctctcccaagatgagcgggaattgactccagc

SEQ ID NO: 640890 - DNA, 109 bp, Homo sapiens
catctctcctctcgacatctctccttctcgcacacagccgcggcgaagaatgtcggagagagagtggatgtcggagagggagaggatgtcgggaagggacgcatgtcgg

SEQ ID NO: 640891 - DNA, 1257 bp, Homo sapiens
ggttttcctgcgcagtgagcctgcagggggcgtaggcagccatggctgcccagccggaatggcatggtcttgaatgccccacttccacaatggacttggcatgctggctgctgtggccactgtgtgttcaaccatgcctggccctgtgaagatccgcatgactgtaatgtgccctggcaatgccaatggctgctgcctgcatctgctccgctgcccctgcgtcggtgtcccatcctggcccatcgtgctgctgccccacggttcgggtaccacactgaaggtgcggctgcctggcctgcggctttcagcctggaggagctcagtggtggcctggcattcacaagaaaggttgggccctggaccatcggcatttctgtggatcctgaggatggcggaacaatgtccactggatgtccctgcaggccaaccgtgcagcggctgacaggagtacctgctccaaaactcatcctcttcccccaggaagccctcgtgccccaagaagggagacagtttctgctgaagaactgaaactgtgcaccagctgaccggaccggtcatgcccgtccggaacgtctataagaagggagaaagctcgagtcatcacttgaggaaagagaagactttcaaagccttcgctagtctccgtatggcccggtgccaacgcccgggtcttcggcatacgggcaaaaagagccaaggaagccgcagaaccgggatgttgaccagacaaaataaggccctcctggggacttggacatcagtcggcagtcaatgctgggatctcccacgttggtgtgttccgtggcaccactggggactgggatggggctccatgctgtgattcctcatgcagagacattggagcttcttgaaagacagtcagcctgaaaatgtacttctgggtttgatagcctgtagtgtgagggaagagcgtgagtaaaccggggactacttggttgggaagggataaaagggcgttgattaaaagagatgacaactagtaaaaagtagcgtcctagatttattgggggcagatagatagaacggaacggtactaaggcgtcgaccgcttcgaaaagggggatagggcctaatagtgatttagggtagtaggcaagaagtagaaaaggtaggaagagtagtacggatagagtagtgagggtagacggcactagtctctctcttgttcgctacactactttcgagtagagtcgataacggaagaaggaagaacgcagagagagaggagagaagtaa

SEQ ID NO: 640892 - DNA, 944 bp, Homo sapiens
  misc_feature (13)..(13): n is a, c, g, or t
  misc_feature (81)..(81): n is a, c, g, or t
  misc_feature (84)..(84): n is a, c, g, or t
  misc_feature (102)..(102): n is a, c, g, or t
  misc_feature (117)..(117): n is a, c, g, or t
  misc_feature (181)..(181): n is a, c, g, or t
  misc_feature (261)..(262): n is a, c, g, or t
  misc_feature (264)..(264): n is a, c, g, or t
  misc_feature (270)..(270): n is a, c, g, or t
  misc_feature (273)..(273): n is a, c, g, or t
  misc_feature (290)..(290): n is a, c, g, or t
  misc_feature (300)..(300): n is a, c, g, or t
  misc_feature (302)..(303): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (328)..(328): n is a, c, g, or t
  misc_feature (335)..(335): n is a, c, g, or t
  misc_feature (400)..(400): n is a, c, g, or t
  misc_feature (515)..(515): n is a, c, g, or t
  misc_feature (520)..(520): n is a, c, g, or t
  misc_feature (528)..(528): n is a, c, g, or t
  misc_feature (595)..(595): n is a, c, g, or t
  misc_feature (884)..(884): n is a, c, g, or t
  misc_feature (904)..(904): n is a, c, g, or t
  misc_feature (906)..(907): n is a, c, g, or t
  misc_feature (910)..(910): n is a, c, g, or t
  misc_feature (914)..(914): n is a, c, g, or t
  misc_feature (943)..(943): n is a, c, g, or t
tgggggggtggtntgggggagaagtggggattgggggagggagggtgggggtgggatgggtggggggggggaggttggagnatntggggtgtgggtttgaanagaaggggattgagnaaggtggatgaggtggtggagagttagatgggtatgagggagagggaggtgggggggaggatgntggaggtgggaaaggagaaaaggaagggggatgaggtgggggagggggtggaggaaggggtgggtgagtttgggtccccnnangagttngtntttgaggtgtggggcgncattggggangnnaaggtnggnggntantaggagtggnggggganggtgcgatgatgacccgggcgcaacctggctgggggcccccaggagggagactgaggtcaggagnggagcctccagcttgagcctagctcagcagcccaaggacgatggtgaggggaggtggggccaggccccctgccccgctccaatcggtaccatccccgccctggttcccactctgnccggngtccccgncccccctgtgccctgttccccacctacctcagctgggtcaggcacagggaggggagggatcagccanattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatncctggcccagagcaggaggnannganggangatggcggtgggtattgtatctgaatttna

SEQ ID NO: 640893 - DNA, 211 bp, Homo sapiens
cagcctatacacataaatacaactgtatatgcatcatactccactagatctatattacaattatatatcacttacatatttcattatctatcaatgtatatatatgctaaaatctctaaatatgtatatcattatagaattccagtcttttaattagtgagctgaatccatttagaacatttaaaaactacattaccatagacaatatctg

SEQ ID NO: 640894 - DNA, 822 bp, Homo sapiens
  misc_feature (8)..(8): n is a, c, g, or t
ggctgacnggttttgcagactaccatcttccctgcaactctgaaggatggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatctgaaacatggagccaaagacaaagatgactgaataacttcaaattccagccaaacgttccttgtgccacttgggtatctgggatactctgatggcgttagttaaggtcgatagcgggtgattatctgagcattggaattgttttatatcgatgaagggctttcataattttagataaatgtattatacagcttccatagggataaggatttagagagatgggaggatatattgaaattggctttaaagctggggggccagaggaaatgggtcaaa

SEQ ID NO: 640895 - DNA, 178 bp, Homo sapiens
gatctcagcaggtcccgcagctctctctgttgggggctggcggggggcagtctggggggcaggcaagtggtcccgggcagcattttgggcatggcaaaagtccaggcaggcatggcacagccagcctggccagcaattcacatcagcagcaaattcaggcacaccccccaacatttcc

SEQ ID NO: 640896 - DNA, 631 bp, Homo sapiens
  misc_feature (77)..(82): n is a, c, g, or t
  misc_feature (84)..(86): n is a, c, g, or t
agcggggacgcaaccatctgcggaaaggataggggggaggaagacttaacactgcaacaacaggtacaaaaaagaannnnnntnnntaacaggacccagaggaccattatatattgctctatattctaggtcgcccactttacacttccttctcatgcacttggtcaataccacgcccgctgaccacactggcgacttccctctctgtcgcccctccgtgaagtcagacccactctgcgggccaagaaaggtgaccgggcttccttccggcttgctaagcagaggccggaagcggtggtttttagcggctctctgggtagcagggtggtgtgatagcggcagcgaggggctcggagaggtgctcggattctcgtagctgtgccgggtgagtggcgctcgcgttcgggcgcgtgagacccatcccggggacccgtctccgcgggggcagctggagggcggcggggctcctggcgccggtagcgcacctgggcaggtgtgccagccaggtccccggttctgggatccgaggccatggcttggagtggcccagacccgaacttcgctcctgtgcccaaacttggaactctggaaatgtggcttcgctcactggcgccttgagcttgggcgactg

SEQ ID NO: 640897 - DNA, 858 bp, Homo sapiens
  misc_feature (669)..(669): n is a, c, g, or t
  misc_feature (700)..(701): n is a, c, g, or t
  misc_feature (706)..(706): n is a, c, g, or t
  misc_feature (720)..(720): n is a, c, g, or t
  misc_feature (727)..(727): n is a, c, g, or t
  misc_feature (730)..(730): n is a, c, g, or t
  misc_feature (814)..(814): n is a, c, g, or t
gtgtgatagcgtatgctaggggcttggagaggtgctaggattctggactctgagccggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaagacaaagatgactgaataacttcaaattccagccaaacgttccttgttgccactttggggattctgagatatttctcttgcatgcccttagctttacagcttttggcatttcctggtggatttattcttagccattttgggcaatggaanctttataatcagactgggaacgggactttcnnttaanatcattttcgaatnaaaaatnggntaatttaaccttccaggcctttttccccaaaaactggtgggtctatacagagtcaatatattttttcagagaaagttattcgcncgattttttccggaatcataattaaactttatggttaaattaaa

SEQ ID NO: 640898 - DNA, 573 bp, Homo sapiens
  misc_feature (77)..(82): n is a, c, g, or t
  misc_feature (84)..(86): n is a, c, g, or t
agcggggacgcaaccatctgcggaaaggataggggggaggaagacttaacactgcaacaacaggtacaaaaaagaannnnnntnnntaacaggacccagaggaccattatatattgctctatattctaggtcgcccactttacacttccttctcatgcacttggtcaataccacgcccgctgaccacactggcgacttccctctctgtcgcccctccgtgaagtcagacccactctgcgggccaagaaaggtgaccgggcttccttccggcttgctaagcagaggccggaagcggtggtttttagcggattctcgtagctgtgccgggtgagtggcgctcgcgttcgggcgcgtgagacccatcccggggacccgtctccgcgggggcagctggagggcggcggggctcctggcgccggtagcgcacctgggcaggtgtgccagccaggtccccggttctgggatccgaggccatggcttggagtggcccagacccgaacttcgctcctgtgcccaaacttggaactctggaaatgtggcttcgctcactggcgccttgagcttgggcgactg

SEQ ID NO: 640899 - DNA, 168 bp, Homo sapiens
agagaaaacagccccattattattattattatttttattgtagagacaaggtttcactatattgcccaggctgttcttgaactcctgggctcaagcaatcctcctgctttggcatcccaaagttttgggattacagcatgtgccgccacacctggccaattactcccc

SEQ ID NO: 640900 - DNA, 1239 bp, Homo sapiens
  misc_feature (77)..(82): n is a, c, g, or t
  misc_feature (84)..(86): n is a, c, g, or t
  misc_feature (1050)..(1050): n is a, c, g, or t
  misc_feature (1081)..(1082): n is a, c, g, or t
  misc_feature (1087)..(1087): n is a, c, g, or t
  misc_feature (1101)..(1101): n is a, c, g, or t
  misc_feature (1108)..(1108): n is a, c, g, or t
  misc_feature (1111)..(1111): n is a, c, g, or t
  misc_feature (1195)..(1195): n is a, c, g, or t
agcggggacgcaaccatctgcggaaaggataggggggaggaagacttaacactgcaacaacaggtacaaaaaagaannnnnntnnntaacaggacccagaggaccattatatattgctctatattctaggtcgcccactttacacttccttctcatgcacttggtcaataccacgcccgctgaccacactggcgacttccctctctgtcgcccctccgtgaagtcagacccactctgcgggccaagaaaggtgaccgggcttccttccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatctgaaacatggagccaaagacaaagatgactgaataacttcaaattccagccaaacgttccttgttgccactttggggattctgagatatttctcttgcatgcccttagctttacagcttttggcatttcctggtggatttattcttagccattttgggcaatggaanctttataatcagactgggaacgggactttcnnttaanatcattttcgaatnaaaaatnggntaatttaaccttccaggcctttttccccaaaaactggtgggtctatacagagtcaatatattttttcagagaaagttattcgcncgattttttccggaatcataattaaactttatggttaaattaaa

SEQ ID NO: 640901 - DNA, 242 bp, Homo sapiens
  misc_feature (11)..(11): n is a, c, g, or t
  misc_feature (33)..(33): n is a, c, g, or t
  misc_feature (101)..(101): n is a, c, g, or t
  misc_feature (134)..(134): n is a, c, g, or t
ggctggcggcnggggagctgcgtctcccgcccngcggcactgcccaagcggactgcacccttcgcggacgtggccccgctacagctcaaggtccgcgtgancagagggagttgagccgcgggtcgtgccaggcntaacatcgcaggaggtcttcgagaagaccaagcgactcctgttcctcggggcccaggctacctggaccacgtgtgggatgaaggctgtgctgtcgttcacctgccaga

SEQ ID NO: 640902 - DNA, 1484 bp, Homo sapiens
  misc_feature (77)..(82): n is a, c, g, or t
  misc_feature (84)..(86): n is a, c, g, or t
  misc_feature (1295)..(1295): n is a, c, g, or t
  misc_feature (1326)..(1327): n is a, c, g, or t
  misc_feature (1332)..(1332): n is a, c, g, or t
  misc_feature (1346)..(1346): n is a, c, g, or t
  misc_feature (1353)..(1353): n is a, c, g, or t
  misc_feature (1356)..(1356): n is a, c, g, or t
  misc_feature (1440)..(1440): n is a, c, g, or t
agcggggacgcaaccatctgcggaaaggataggggggaggaagacttaacactgcaacaacaggtacaaaaaagaannnnnntnnntaacaggacccagaggaccattatatattgctctatattctaggtcgcccactttacacttccttctcatgcacttggtcaataccacgcccgctgaccacactggcgacttccctctctgtcgcccctccgtgaagtcagacccactctgcgggccaagaaaggtgaccgggcttccttccggcttgctaagcagaggccggaagcggtggtttttagcggctctctgggtagcagggtggtgtgatagcggcagcgaggggctcggagaggtgctcggattctcgtagctgtgccggcccacaatgattctgagctaaaacacaaaataaaaaccagattcattgccaccagcgctcacctcgcctgacttaaaaaaaagtttcgtacaacagacactccttgacaccaaggatctttcacttaatccctcaaaaataaagactcgagctgggtgcggtggctcacgcctgtaattccagcactttgggaggccgaggcaggtggatcacgaagtcaggagttcaagaccagcctgcacaaggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatctgaaacatggagccaaagacaaagatgactgaataacttcaaattccagccaaacgttccttgttgccactttggggattctgagatatttctcttgcatgcccttagctttacagcttttggcatttcctggtggatttattcttagccattttgggcaatggaanctttataatcagactgggaacgggactttcnnttaanatcattttcgaatnaaaaatnggntaatttaaccttccaggcctttttccccaaaaactggtgggtctatacagagtcaatatattttttcagagaaagttattcgcncgattttttccggaatcataattaaactttatggttaaattaaa

SEQ ID NO: 640903 - DNA, 142 bp, Homo sapiens
cccttcccgccaagtgagttaccttcatcaccatctcaaagcactgtcatcaactcctgaccttaatgaagacattatcatctcaggataacccccactaccatgatggcttattctctctgaacttacatacaatgagagg

SEQ ID NO: 640904 - DNA, 954 bp, Homo sapiens
ccccgtatcctcggtcgtcagggtgtctcccgggcctccaaagggtccttcctcgccgcgatgtctttcacccaagtgtgaccttcgggacattggtttatatcaatcctcttagggtcttcgcgccacctctggggccgcgaaggcgccccgggtgcccggccctccgcccagggtgtaccgtgccctccccgccatttccccgcgttaccccgctgttggggccgccaacgcgcgtcaaaacacatgaactgcccgttagggtgaaagcagaggatgcggccccgctttcgtgcgacacgtgggtaggcggcccaccacatgttttggaagtgcccggaggacaccacatcgggtagggggctttccgcgaagaccaccagcgtgcgaaggcctctaccaggcagcacccacctaggcaagcacagcaccagtcagcgaaaaaaaggaaccccacgcacatcacggtggggtggatcaaaccaacacgcacggggcgcaaagaacatgcactgagtgagtccagcacaagggagcccacacagttcgcccaagaagaccctccaacagaaggcttatacactaggatgataatccccgaatggcaccggcgccaccccccaggcgttaaacccaggagcggcagagcatagcctttgtacgaactccttgtggcatacaaacaggccgacctcaaagtgctcaaatgttaacaaaggggtgctttatatgatagacacaccgccgccgggtttatacgcactcacgaaggaccagtagtgatgtatcttgggccgccactctagcgtgtttctatgtatcgagcgagtgccgatattgagtcttattagcgggtcccacaaacccgcctaattattggggtaggagaacccaacgacaccccaaatttggcgccaaattgtggcgccccataaaaacaaacaaacaataaca

SEQ ID NO: 640905 - DNA, 1653 bp, Homo sapiens
gccactgtatcataacctctcagctgacgaatgcaaggcaccaatcggagaggcagcttcgatataaggaaacacgtggctgaactcacggaagacaaacgaaattctggacgtgagcaacagaacagaaacgagaacatactactggagaccacagaccagaccctactgggaagcacacgggacacctctattagaaaagcctgaccaagcgacgtatgacttggactcttttcctgacacgcagcacaagcccgggcttccagcaggcattgggagcaagttcccaggctgcaatggccaaatatcgacagagggaagctagacgatgcatgtaaacaccaatatgcttttggcccggcctattgcagacttgcatcaccgtggtaatcgatatcgtcccattatccgtgcaatgactcatgcacggcagtgggcactgtcgtcgtcatcaatgtgtagaaattctagtgtcaacacatcatcatgcacgcagcgcgcaaaacgcataattccgacgaggaacacatgggctaaatagtgtgtcggaaatcaccaactggtgcatgcagcatcatcatcgcgacaggtgccaacttctggtgtttgaaggctgggcttggcacgaaacatacacaagactctagttgcaaaataccatgtgcacgttggacatagcgtataggatggaacacaaacaaactaagtatactacagctggagcccattactgggccaaagatacatgaaagaggagagaaacaaaagggatagaaacatgaactggacacaaatcctaaagaacaagaaatcagtcatcaatacgacggtaacgttaacgaaaatagcaccagacatgaggcaggccccggaagatccctgactaaattgagccaccgcagaaacagactcaatcaaaaacacatggcaatacaacagtggaaaaacccacgctcagacacacaaacacgaagagctacatcacgacgacaccagcacgaacaccactctcttctgttgtctgcgccgacggacgcaaaagaaaaaccggacaacaccaaagacaacgaacgacggaaagagagcaagaagagaaaagccagaaaaaggacaacacacacgaagcgcagacagaaacaacacgaaaacgagcaacacacaggaacgagaaccaagcgcaaaaaaccaaccacacaaaacacaaacggaaacagaaccggaagacaagcaacaaagaagagagagcaagcagagcgccaggagaaggagaggagaaagaagaagagggagagcacgaaagaggacgaagacgcaacgcacagacaaagaacgacaaccagcaagaggaagacgacgaaagaagagaaagaaaaagaagcagaagaaaaagaaaagcgagagaggaacgcagagcaagaaagagggaaaagcggagaggccgcaggaagacggcagagaagggacaaggcaaaagagaagaggacagagaagcgaacacgcaggcgacgcgcaggaggcgcacgcggagcaagggaggaggcgaccgcgcacagcgggaccgggaagatgcaagagacaggactaagggggagcgggacggacggcgagaagggcgcgggagcacgcaagagcacagcacgacaacgggaccga

SEQ ID NO: 640906 - DNA, 1602 bp, Homo sapiens
  misc_feature (77)..(82): n is a, c, g, or t
  misc_feature (84)..(86): n is a, c, g, or t
  misc_feature (1413)..(1413): n is a, c, g, or t
  misc_feature (1444)..(1445): n is a, c, g, or t
  misc_feature (1450)..(1450): n is a, c, g, or t
  misc_feature (1464)..(1464): n is a, c, g, or t
  misc_feature (1471)..(1471): n is a, c, g, or t
  misc_feature (1474)..(1474): n is a, c, g, or t
  misc_feature (1558)..(1558): n is a, c, g, or t
agcggggacgcaaccatctgcggaaaggataggggggaggaagacttaacactgcaacaacaggtacaaaaaagaannnnnntnnntaacaggacccagaggaccattatatattgctctatattctaggtcgcccactttacacttccttctcatgcacttggtcaataccacgcccgctgaccacactggcgacttccctctctgtcgcccctccgtgaagtcagacccactctgcgggccaagaaaggtgaccgggcttccttccggcttgctaagcagaggccggaagcggtggtttttagcggctctctgggtagcagggtggtgtgatagcggcagcgaggggctcggagaggtgctcggattctcgtagctgtgccggcccacaatgattctgagctaaaacacaaaataaaaaccagattcattgccaccagcgctcacctcgcctgacttaaaaaaaaggttatgctcctttagatctgtaaactcagtctcctaactgcccttcatccactttctcatgcatctgaaatcctcatattttgtagaagcctgttctgtaagtctctctactttccagtttcgtacaacagacactccttgacaccaaggatctttcacttaatccctcaaaaataaagactcgagctgggtgcggtggctcacgcctgtaattccagcactttgggaggccgaggcaggtggatcacgaagtcaggagttcaagaccagcctgcacaaggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatctgaaacatggagccaaagacaaagatgactgaataacttcaaattccagccaaacgttccttgttgccactttggggattctgagatatttctcttgcatgcccttagctttacagcttttggcatttcctggtggatttattcttagccattttgggcaatggaanctttataatcagactgggaacgggactttcnnttaanatcattttcgaatnaaaaatnggntaatttaaccttccaggcctttttccccaaaaactggtgggtctatacagagtcaatatattttttcagagaaagttattcgcncgattttttccggaatcataattaaactttatggttaaattaaa

SEQ ID NO: 640907 - DNA, 1322 bp, Homo sapiens
  misc_feature (77)..(82): n is a, c, g, or t
  misc_feature (84)..(86): n is a, c, g, or t
  misc_feature (1133)..(1133): n is a, c, g, or t
  misc_feature (1164)..(1165): n is a, c, g, or t
  misc_feature (1170)..(1170): n is a, c, g, or t
  misc_feature (1184)..(1184): n is a, c, g, or t
  misc_feature (1191)..(1191): n is a, c, g, or t
  misc_feature (1194)..(1194): n is a, c, g, or t
  misc_feature (1278)..(1278): n is a, c, g, or t
agcggggacgcaaccatctgcggaaaggataggggggaggaagacttaacactgcaacaacaggtacaaaaaagaannnnnntnnntaacaggacccagaggaccattatatattgctctatattctaggtcgcccactttacacttccttctcatgcacttggtcaataccacgcccgctgaccacactggcgacttccctctctgtcgcccctccgtgaagtcagacccactctgcgggccaagaaaggtgaccgggcttccttccggcttgctaagcagaggccggaagcggtggtttttagcggctctctgggtagcagggtggtgtgatagcggcagcgaggggctcggagaggtgctcggattctcgtagctgtgccggcccacaatgattctgagctaaaacacaaaataaaaaccagattcattgccaccagcgctcacctcgcctgacttaaaaaaaaggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatctgaaacatggagccaaagacaaagatgactgaataacttcaaattccagccaaacgttccttgttgccactttggggattctgagatatttctcttgcatgcccttagctttacagcttttggcatttcctggtggatttattcttagccattttgggcaatggaanctttataatcagactgggaacgggactttcnnttaanatcattttcgaatnaaaaatnggntaatttaaccttccaggcctttttccccaaaaactggtgggtctatacagagtcaatatattttttcagagaaagttattcgcncgattttttccggaatcataattaaactttatggttaaattaaa

SEQ ID NO: 640908 - DNA, 962 bp, Homo sapiens
  misc_feature (77)..(82): n is a, c, g, or t
  misc_feature (84)..(86): n is a, c, g, or t
agcggggacgcaaccatctgcggaaaggataggggggaggaagacttaacactgcaacaacaggtacaaaaaagaannnnnntnnntaacaggacccagaggaccattatatattgctctatattctaggtcgcccactttacacttccttctcatgcacttggtcaataccacgcccgctgaccacactggcgacttccctctctgtcgcccctccgtgaagtcagacccactctgcgggccaagaaaggtgaccgggcttccttccggcttgctaagcagaggccggaagcggtggtttttagcggctctctgggtagcagggtggtgtgatagcggcagcgaggggctcggagaggtgctcggattctcgtagctgtgccggcccacaatgattctgagctaaaacacaaaataaaaaccagattcattgccaccagcgctcacctcgcctgacttaaaaaaaaggttatgctcctttagatctgtaaactcagtctcctaactgcccttcatccactttctcatgcatctgaaatcctcatattttgtagaagcctgttctgtaagtctctctactttccagtttcgtacaacagacactccttgacaccaaggatctttcacttaatccctcaaaaataaagactcgagctgggtgcggtggctcacgcctgtaattccagcactttgggaggccgaggcaggtggatcacgaagtcaggagttcaagaccagcctgcacaaggtggtgaaaccccgtctctactaaaaatacaaaaattagctgggcatggtggtgggtgcctgtaatcccagctactccagaggctgaggcagagaattgcttgaaccctggaggtggaggttgagatcgcgccactgcactccaccctgggcgacagagcaagactccgtctcaaaaataaataaataaaaataaataagtaaataaaaaaaaa

SEQ ID NO: 640909 - DNA, 184 bp, Homo sapiens
gtcagcactgtagtaatattactgtgggagggatggcggcggtataccagaaggaagaataatcttcatggtctctggcctctatcttcagtaaatttgcagtctaggtcagatagagaaaactggccgcccactgcaaatgttggcctggttctcatagtgatgttaaagattaaaacaggag

SEQ ID NO: 640910 - DNA, 105 bp, Homo sapiens
accactccaccttactaccagacaaccttagctaaccattaccaatatagtatagccgatagacattgaaacctcgcgcaatagatatagtaccgcacgcgaaag

SEQ ID NO: 640911 - DNA, 949 bp, Homo sapiens
  misc_feature (77)..(82): n is a, c, g, or t
  misc_feature (84)..(86): n is a, c, g, or t
  misc_feature (903)..(903): n is a, c, g, or t
agcggggacgcaaccatctgcggaaaggataggggggaggaagacttaacactgcaacaacaggtacaaaaaagaannnnnntnnntaacaggacccagaggaccattatatattgctctatattctaggtcgcccactttacacttccttctcatgcacttggtcaataccacgcccgctgaccacactggcgacttccctctctgtcgcccctccgtgaagtcagacccactctgcgggccaagaaaggtgaccgggcttccttccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagctttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatctgaaacatggagccaaagacaaagatgactgaataacttcaaattccagccaaacgttccttgttgcactcttntagtctgagattttctcttgctgccctaagcttacagctttgcatt

SEQ ID NO: 640912 - DNA, 1251 bp, Homo sapiens
  misc_feature (525)..(525): n is a, c, g, or t
ggagagaggagaactagtctcgagtatttttatttttttttggtccatgaggcatttaattggtaaatttttgttttacttccctaaaaaaaaaatcccaggatttcccctccggtggtgtttccgtctggctccttcatgggtccatgatgccagctggaggttgtcagtacaatgaaaccaaatcgggcgggatggaagcagataattctggccattttcccaggtcttggagttggcactgtcaagatctgggggctggatcaccccagcatcttggttaaagcctggcctggtagggtgttcaacaaacaattttccccagttcctggtgggtcatcaatggatttacaaattcgccattggtaacccatggcttacatcatccacaggtggaagaaaccgggacagatggatctttgggacgcacgggcctaatataaacgcacctggggctgtattggcctatctctttgtcgcgggcatattggtggagataacttcttggaaaacgctattctggcncaggggactattcatggcgcgccacctattgtgtggcgcgagcgccgcgggagaaaagagacccgcgggttgggtgcctccgcctctccccctgtggagaccatagcgggttcacagagcggcggccggttagcaagattagacccacaagatataaagaggcgcagagactcccgagagggtggcccccagaggtgcctcaaagcgcgagagggcgaagtatgtccccgggggggaagccgacacactctacccaaggaggaaggctgtgctgtggggctccaacccaagagaaagccccacaaattcggggacagccccccggtgtgttttcctcggccggacccttacagacgccggagaaaaacacctcatacacaagaagtgtcgcctctccagaaaaaaaagagggcggtgtagaaaaacgaccaagaaatgacaaaggaattttcggggacggcggggcggtgttagacacaacgaagctgttcccaaagaaaaatattttgtggtcccaacaccaaaaaggcggcaagacacacaagtgggcggcactcccattggtggtttttcgtgcgcaaggaaggaagcaccaccatcttgtggcccccatttgggaagggtgtaattctctgtcggccaatttcttcccccaatgtcccttctgtttttcgatcggcaccccggaaaaatttggggccccttaatggtattattaattcccca

SEQ ID NO: 640913 - DNA, 385 bp, Homo sapiens
  misc_feature (237)..(237): n is a, c, g, or t
gatccacagtaagtggcggacctgggagtgatagcaaggacagtggtgagctcagttcactcccaatgagcccaacaacactggacacccggccacttagagtcttcttgcctgctagacagcagcagcagcggcagaagcagcaagagcagaagcagcaacagtaacagcagcaagttccgtccgggaaccaaccttctacctcctttgagcatcaaggcagaccccacaggtgtnttggaactccccaaagagctgtcagaaatctttgatcccacacgagagtgcatgagctcggagctgctggaggagttgatgtcctcagaagtagttgcccctctgcttcgtctttctccacccccgggagaacaccctcctctttcga

SEQ ID NO: 640914 - DNA, 228 bp, Homo sapiens
gtttagagtgttaagttaaagaagccaattacaaaaggtttcacgttgtatgatttcgtttatagtgaaatgtccagaataggcaaatctgtttgagagagagaaagtagatgagtacttgcctaggactgggaggaggattgcgaggaaatggagattcactgctaatgagtacagggtttcttttgggggcgcttatgaagatgctctgaaattgattgtgatggt

SEQ ID NO: 640915 - DNA, 214 bp, Homo sapiens
cgctttctgactctcttcacggacagtggataaacagtgtgaaggtatatactggcgacgcagagagtccatgtggcaagtgccttgcttggttgtccgcgctagaactcgaggtgcgttgcaggcgatttctcgtcgaccatgttcgggcttcatgagagcggtggatcgtccgaggtgctttcttgcccttgctccgctgtgcgcgtcatac

SEQ ID NO: 640916 - DNA, 122 bp, Homo sapiens
ttttttgccccccccccccccccccccccccaaaggggggggggaaaaggggttttggaaaggggggggtttattttttttttttggggagggaaaaaaaaaaaatttttgggggcccccca

SEQ ID NO: 640917 - DNA, 118 bp, Homo sapiens
aggggagggctcctaggggcagagaatgttccttaggttttctttgtgaatgaaattcctccttccccccatctctgagtatgaggacagcccaccacatctgccctttcgcagtgtg

SEQ ID NO: 640918 - DNA, 120 bp, Homo sapiens
tggacagcacagaggaggtggacagcacgaggaggtggacagcacagtaggaggcaaccagccagaacgcctgaacgcaggcacatacttcctattctacacccccctcctctgtgctgt

SEQ ID NO: 640919 - DNA, 223 bp, Homo sapiens
gtcactgacttagctattttgctgctgtactaattccaggtattgatgatgctaaagcacctagctatggtccttggcagtcagaaattatgaaacataggcgagtaacttaatgtgacaggcaacaagttggtaacatattataatactgggcgtgggatgagagagaaaaatcaaatatgaaacccgaactgcaagcctgacaggatggcctactaagctt

SEQ ID NO: 640920 - DNA, 965 bp, Homo sapiens
gtgttatgcggcatttgctcttattgtcattatttctcttattatacttaaaagttctgggattgctcttattatttccctaaacgaataatgtcctggatgatgtacaatacatccagtactctttctgtgttatctgtaggctgggcaagtttccacatactgcatataatagctagatggtatcgagcattattttgtgccgggcactgagttctaagtgcttcacatatattaacttaatttgaaattcatacatcagctcgttcacaaggacaaattaggttcattgatcccaattactatagtatgaactaacgtgacgacagtaagcatgtacattggtgcaaggtctcgtgcgtgttaaagaggccctaggatttcatttctcccccactagcctcaactattctctgcctaatagtgatctgtatcagtcggcacgggactccctttggtcctgctggagaacgaggaatgatatatcccataactataggaggaaattctgatcttaatgagtatgacaggcgtaggagggagtgatgttaagcagtgatgttcagaggcccttggttgatacgatactgtgttcggacttggggttgaattgcataggtctatcaagcaaggaaccatgcgtcctgaggctacggaaaccaggtcgtgcaagaacgtgggagaaagcaaaaatcgagcattccattgaggtctcggcacgggtaccctggtctgagcctatgcagacggtaattctcaagaaagcatcacagcgatacaaaactctctaagaaattcggtgcggcccgccaggaaggtgacacaggggggcggccataacaccaaatgcaggggacccggtcggacagttgtgtcaccacacagcggggcagggtgccatacgttgtgacgtggggccgtatgaccgggcgggaccctcccggtgaacaaccccacggacgcac

SEQ ID NO: 640921 - DNA, 822 bp, Homo sapiens
gcgccttatctactgagggctcattgattgagatgggtctagttaagcgaccgtaccgaaagtgaggttgggactaccagaccacacactgggatcgagagacttgacgtgcctctagtccaccatgaacgatcttaagcatagtgctgaccagtcccaactatgccatctcatagcagacacatgcgagcagagatgtgaggttactaacgtacaaaaatgtgccaccgtgaatgcgcaagttgcatacgtatgattgtgctcccctctcaatgtatcaggaactaggtatatctcctggaacagtctcatgtggtgtcatgggaccaaaaccaatagacaacgccgcgtcagcgcacttggtcaaccaattcgacttgcatgcatcgcaggacaagcctggcatcaatttcgtcatccacgcttcccccttcctaattgaacgatctcggaaaggcacagaatctggcataccaggtaatgtcgtccccaaaggtgtttttcgggggggtccccttcttcacaagccgtggcgagttggacaggggtgccaaacgaaccaacgcgaaagttgtgggggggcaactctgacttaaggcccatattgagagaggccccatagctgcttaagagcgagcgctcgaataggagccatctattggtccgcgaagccaaagtatgttaacggcttcccaaaggcaaaaatgcccttggatttccttcccaaaggcgaggccaaccatttgtctttcccatccaatttggaagaaccctttccgctttattcggggcgggaaacgacacggttgggaacggtggtgg

SEQ ID NO: 640922 - DNA, 712 bp, Homo sapiens
agaggaaaaaaaaaaaattaaaaattttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaatttttgcccctttttgccccatgtattttaaactttcaaattttttttgcttgggcccaaatttgggctttttttgccaaaagctcctttagggggggttatttaaattaaagggggcctgttttaaaacatttgtattgggaaaaaccttggttatccccaattaaactcttttgaaaaaaaccccttttttcccagggggtataatactcaaaggccccccccttggtccttttaaaaaaattgcccacccctcaggggctatggaatttttgagcgctaaattttttgtaaaaatccgggaaaattttttgaaaaacgcttttttttttaacacaatgggtccatattggtaaaaccctttttatcaaaaaatatttccccgctatggcttctatgtttgtcccatttgtcaaaagggtcccctttttaaaagcggtgttctccaccctaaaggggggaaaacccttttattgggggagggccccttctcggaccctttcccttaaatcttttgggtttcggcgctctgt

SEQ ID NO: 640923 - DNA, 308 bp, Homo sapiens
  misc_feature (47)..(47): n is a, c, g, or t
  misc_feature (81)..(81): n is a, c, g, or t
  misc_feature (83)..(83): n is a, c, g, or t
  misc_feature (105)..(105): n is a, c, g, or t
ctgcagtggatgatgatgatgatgatgcagcttaagatgatttactngttttgtttttgtgtttgttttgcttttttgagntngagtttcactcttgtcacctanactggagtgcaatggcgtgatctcggctcaccgcaacctccgcctcccaggttcaagcaattctcctgcctcagcctcccaagtaggtgggactacaggtgcccgccaccacacccggctaatttttgcatttttagtaatgacagggtttcaccatgttggccaggctggtctccaactcctgacctcaggcgatccactgt

SEQ ID NO: 640924 - DNA, 578 bp, Homo sapiens
tcgttcaagtcctttaacacgcgtcagatgacttacttcatgcaagttaatgtagcacactcaattcttggtgtcatagctattgcctgcaagtcatctgcagcaaaagtggattccatctttagacatcactttctcaggtcatcggtaagaagcaactcctcatctgtttaagttttattatgagatcgcagcaatttagccacatcttcaggctccatttctaattctagttctctcgctatttctaccacatgtgcaattacttcttacaatgaagtcttgaactcctcaaagccatccttgagggctggaatcagcttcttccacactcctgttaatgtagatattctggcctcctcccatgaatcacaaatgttcttaatggcatctagtatagtgaatcttttccagaaggttctcaaattgactgtgcctcaagatccaactaaggaatctatggcagcaatagccttataaaaagtatgtcttaagtgataagactcgccaggcacagtggctcactcctgtaatcacagcactctggaacgctgagaggggaggtcacttgagcctag

SEQ ID NO: 640925 - DNA, 360 bp, Homo sapiens
acgacgttgagtactatgttgactcatcccaggaccccgacttcgaggagaacgagtttctctacgatgacctggacctcgaggacattccacaggcgctggtcgcacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagccaaaaacggctccaagcctgtccacagcaaccagcaccctcagtccccagctgtgccgcccacctacccctc

SEQ ID NO: 640926 - DNA, 1175 bp, Homo sapiens
ggagctggaggctcctcccggaggtaccaagtgatccggggtagcgagcacgtcgctccgaaccgttctggcctcgcagtccgatgacgcacgttcctcttctcgaccaatggtcgcctagaggctagagcacacgagactcgaaggccaccagacgcgctgtgacgacgactgagagtacagctggtgagcttcatgtctaggggatacgatggataagagctaaagcgcatgggaatgcagcgattcaggtatgacacgaatacggcttgaagaccaagaacatcccgagtctctgaatgtgacataggatactcgatgtgcatagatacacgtgcccatcatttcactcttcagagtaaccgttggtgacataacctgcacaggctgcaaggtacaagtaagaagctggcgaacacatagagctgcgagaggctgcatacacacatttggaaagccaatgcaagtatgggcttggcagttcctgaccccttaatgcctgagccttccaagcaaccaaagaaccagcttaatcctattggttcattgacaggaatcggctatgcatcatggctggagacttcctgaatatacccttgcccaggagggaggacctgcgtcataaagagagaatatactacaagtttgcaggctagagtcatatatggaagacctggaaaggggggcatcaaagaaaagcaagtcaacagggaatgtggttgagaaaatttcttgccacattagtactatttctccagaagaacacagttcctttaaccaaatggtagtaaggacatacttcaggatgttctgggcattcctcgcaggaacttctctggtgaaaagatcaactcaccggacaacgaagcctcgtaaaatccacaaaccagatcacctcagcgctagcgcaatgccacggaacaaagcggtaacacatgacacattcggagcattacgcaacagaccgctggacacacacacagcccgcactcgcaccaagccccaaaaggagaggaccgggccctgcggacgcacaaggacgcgccaagcgtcgggcgtagccacagaaagaagtcggacaaaggccagcaaacaccacgcaagatacaggggtagaccaacgcaagaatatatgcgtagcgacgaacgacataacatctgaccgaccacaaaga

SEQ ID NO: 640927 - DNA, 849 bp, Homo sapiens
  misc_feature (434)..(434): n is a, c, g, or t
tggactttaaccaagcttacggcctgcaaaccctttgttaccaaagcacaatcctgcagggccctaaatgctttaatcttggattcaatacagcactaggtttctggtgacgcacagagtgggggctaaagttacgggttaatagctatctcaaagcagaaacaattttccttagtcacagatcaaaagggagttccttatgtcttccttttctactatagacggtaacaatctgtatctcttcttttccccacaaaattgttgtgcccccagaaaacccccagaagcgggaaagagggagatctggtcacggccggtgcaggtctcaccctggagctgagtgagggtcttcagctccggggtctgctctctttccacatttgtgttctctcacgtgggccctccctcgagtggctgtgcctctttaggccccnccaggggcacccgtgtgtgttaccctcaagagccctcccgtgggcctcagcttgtgcttcaagagccgccactctcagatttgctccccaagaactcttcagccccattatatgtgattgaaaaacgccaggagattctcctcaggtgcctgtgggacaacccctgtggaatttgtgcagggggcctctcctgtgcctctaactctctgtgccccccaagccaacctgttgggggggtgggccctccagaaccaattgtttctcccctaatctggaaacagtgagctcctccgtggacaagcgtgcctcgaaggcttaagagagcctcgtgccggggcggagagtggtgcctacccattgaggggggaaggtttgggaaaaatggggtccttgcgagcacccggaagttaaacac

SEQ ID NO: 640928 - DNA, 164 bp, Homo sapiens
  misc_feature (41)..(41): n is a, c, g, or t
  misc_feature (56)..(56): n is a, c, g, or t
  misc_feature (107)..(107): n is a, c, g, or t
tttccttaataactaatgataccgctgtctactgacggcancaatggtattgatgnggatttccttatcggtaatctgacgaggtccactgctaccagattcaagtnaaaaaactaatctgacccgtccacctccatgatgatgatcgtctgatcccgggaatt

SEQ ID NO: 640929 - DNA, 368 bp, Homo sapiens
ggattatagtgacggagttactaagggtcgtgaatgggatgcccctggctgggtgctattgatgcgaagagggtccaatagggttccaacgacagcgtatgacgagttggtctgaaagcccccggtatcattcctcgaatatcatatgcgggaacctgagcagactggcattaatgctgtggataccttggtgccacttgcgccgtggtcagcgtgaactgattattggtgaccgacagattgggagaaccccagctgctattgacacatactcagttaaccagataacgtctcggttgatggatcctgatgaaacagaagaagctgtactgtatttatgttgctattggtcaaaagagatccactgt

SEQ ID NO: 640930 - DNA, 349 bp, Homo sapiens
  misc_feature (331)..(331): n is a, c, g, or t
cgtcatgtcttctgacagaatatatacaggtggggactggcaagggaaatcctatctcaggaaggcgaggaacaccaccacagagccacagacccttagcaatgttcccgtggctttcattttgcatgttggcccttgtctctaggacagatgtttgagtgtgctggggacgcagctgagcccatgatgacgagtgttggcccttgtacctcaaactcctccataagaagtgcctcattaagggccaaggtcacaggtcagagtcacactcttgaggtggtgcgtgttgggcaagggttgccacacatttccccaatgaaacaggttgggnggtgtgtgtgtgtgtgtg

SEQ ID NO: 640931 - DNA, 156 bp, Homo sapiens
taacctttccttatgagcatgccggcgtggggttgacagttgagggtaataatgactggtgggtggatggtagatatggggctgttaatggtcagttcagggttttaatcggacgcaggcttaggcgccaatcaacataggggggtacggagctcg

SEQ ID NO: 640932 - DNA, 491 bp, Homo sapiens
  misc_feature (211)..(211): n is a, c, g, or t
cagtatgctgatctgaagctggagaacttcctccatatggcagagggcttaagaaagaaacgaagaactctaagctgggtctgctaacatcactccagtttagactgatcttggctgacgcagacatgcttgtacctctggatcggaaagatgatttactctcgggaatcttctctgtcagcctgtacatctgaaggctttacagcactcnagttgggacattcacattagtgtttgttctctgatggtatctctgagaatactggttgtaggactggccggtattgccaacgggactgggttcacccccaggtctgcggcagttgtcacagcgccagccccgctggcctccaaagcatgtgcaggagcaaatggcaccgagatattccttctgccactattctcctacgtggtatgtcttcccatcatcataacacgttgcctcatgagggtcacacttgaattctccttttccgttcccaagacatgtg

SEQ ID NO: 640933 - DNA, 381 bp, Homo sapiens
ctactactcctcaggcattatactggccccctcccatccactacacatcaagctcgcggatcagccccacccaggactggcaaattcgctctactcaacatgccctgagctcaggacactcacacactcactcttagtctaaatagaccacttacactgaatccgtacacggcctttccctacagggtctgagcacaggcactgcagtcatttctatccattctgtcagacataattcctcagattaagccttcccacctcaatacagactgataacagatgagcctttattattcaaatcagacacgcagtttaacaggctcttagtattcagtgaaacctttatatcccttacggtcctccgtctacaagaaaagtaca

SEQ ID NO: 640934 - DNA, 716 bp, Homo sapiens
gtaagctttgaaaggcatgaagatgctgagaaagctgtggactcagcatgaccggaaaggagctcatatggaaaagcaacatttaagttgttgggtcgatgctcagagaaaaggtggacagcggcagacgtgacacttactgtcgcatacgattgactccgatgaaaacatcgataggatctctcagataccaggagtgtgcaatcatttatgtgaacaatatcttgcatgatgcgctatttgcactgatgactcgtctccgggaacgagtttactccattggggctaccaatcactagtgcaaaggtcatgctgcgaggcgtggtcgcagcatacatgaggctacggtcatccggaatacgttactctcatgcccccaagataggaatcgccatcttatacatacagtatatcgcccacacattgaacacaggttacggcacattcgttgggccaacaaatagccccttggttactgatcacgcttctaaagctttcacgccgcacaatggcacacggaaaggatggccacagggacgtccaaacccctttcaacgtacatccctaagatataattagttggcagtcacgcaacattgacgacgaaacgttgttacgagcaggcataggatccccccaaaacccctggtacattcaactaccccttttatgccagccaagcgacgactacctttcaagactaacaccaccatggg

SEQ ID NO: 640935 - DNA, 190 bp, Homo sapiens
gcccagtgcgcgtccacctgctcgtccgcagaggtaagcgcgttgaggagagccccgtgaggtttcgcacggttgcttactagggttctcatagaattttcttcttcaccactcaattcatatcttaccttacacaagcaggtcaaggcagtcaaccaaaggaggaatttccctttttccgagaccaaga

SEQ ID NO: 640936 - DNA, 367 bp, Homo sapiens
gagtgacacctggacacagaagaagttctacggtgtatggatggtggcaactgacaatcgataatccgtgtcagtgtctaccacattgcagccctcatccgcgacccggttgccagttcagaaggggcagagcctctaccatgggaccttcgatgccttcatcaagatcctgcgagcagatggtaatcactggatctctaccgagggttcctaggtcaatcccttcaccctcatctctggcgcagtgttatgtcaccacttatgagctcaacctgaatttggtggctgactacggccagagtaacacagtcagttcactggtggctggtggctcagcctcccttgtggcccaaagcatcagaatacc

SEQ ID NO: 640937 - DNA, 373 bp, Homo sapiens
cacgtctgtcctctttccatgcagctgcctcacctgctctgcagtggcggccgcggggccaggctctgggggctcttcacgagtagcgtgtagggtgtcttgtttccccctatactgtggcgaatggggtctcaccatgttgcccagtgccggtcttgaacctctggaatcatgcaagcctacctcggactccctaaatgctggggaattagaggcatgagtcactgcgcttggccttcatgtcattggttaataaatacccattacttgaaaacaaaccaatgaagcaacaacaacaaaaaccttttacacttgggaactgtggggttgttgctcaagaagcacctaggaatggcggaccccactcttccct

SEQ ID NO: 640938 - DNA, 495 bp, Homo sapiens
aaggtcgaagaggtgtgggagtatctgtccttacccaggtttcacactcaatctgatatagcatgaccatgtctttgctacttcctatgataaataggtatgatctttattcccactgtacatgtctgttctatcctcggcctcccatcaggccctgtgtcttagttcctttgttaatatcttgaagtttagtccctccatccttaatacgccccatccctccccatcatgcaaccagtggtttattccagtgtagcaataggggctattaccacagaggcctcctgtggtgccctcgtatcataccacactgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaggagaactttaagttccttgttccagcccggagt

SEQ ID NO: 640939 - DNA, 897 bp, Homo sapiens
cacggggcttttacaccgaaatgttgtataatagcacacattggacaacgccctgttttagtgggtgttattgcggcaggaacgacacacattatacagggatatttttaggggtgggcaacaccaccgtgtatagtagggataactcccgcgtcagaagggggatgaccccccaccgaaaagatgttttgggtgcacaccagaggaaatattacactgcaggaggcgttgtggtgaaaagaaacccggcgaccgcgccccccacgagaagacacttatttacaccgggtctcttaaaggagttaaaccgagacgcccttggggtgtcgccgaaatattctcggcacacagtagaggcaccgcgccgcctctcaccccagtgtagtgtagacacacggcgcgcaacactgcatgcgatcgcacaaagtgtgtgagaggagacccccttgcgccacatgtggggcgcactgttgccacccgatgtgttgcgctcacagatgccacatgtgcccttctcacatgggcgccagagagatctccccgccgtctcctcccataagccaacccaagaatgatagtcccgccagccaacccattggcccaaccgggggtggtgttttttccggggggaaccctggtggctacatcttcgccaatcccgtgggggccacactggacatctcccaccatctatcccaacaatcctcctggcctctgttgggtccagatgttgggggcctgcgttggggaattccacccttctttctttcttcttccccagctgaacccgaggctaaagaaagaatgaggcaagagaaaatgtaccccacaggtgtgacctcccaaacccccactcaagtcagagaaacatgaggaataaaggtctacaagcagatc

SEQ ID NO: 640940 - DNA, 399 bp, Homo sapiens
agttcgacggagactctcgggctgtgtcatgccaggcgagagaagatcaaagtcagtagcatccttgctgtcagcatcacggcatcttgccaagaaaagcaggtgagatctggcaagggattgtccacagagaacaaagaggagtgggatcgcaaggctgaggatgcctggagggactatgaaaaagccatgaaagactatgaggggggccgaggcgaatcttctatgagggacccgtcaaagaagatgacgagagtcgaggtgaagctggcaaagaagtccacgccctctaggggctcatcatccaaggtcgtcctcgaggcagctatgcgagagcttcaagagccaagagttcgtgtctagtgatgagagctcttcgagagagtctccggcgaacag

SEQ ID NO: 640941 - DNA, 1925 bp, Homo sapiens
tgtttcacggcagcctgaccaacatggtgaaacttcgtctctactaaaaaatacaaaaaaacgaccaggcgcagtggctcatgcctgtaatcccagcactttgggaggccgaggtgagcggatcacgaggtcaggagatggagaccatcctggctaatatggtgaaaccccatctctactaaaaatacaaaaaattacctggcgtggtggcgggcgcctgtagtcccagctactcaggaggctgaggcaggagaattgttgaacccgggaggcggaggttgcagtgagccgagatcgtgccactgcactccagcctggtgacagagcgagactacgtctcaaacaacaacaaaaacaacaacaaaatacaaaaaaattagccggacgtggtggcggatgcctgtaatcccagctactcaggaggctgagacaggaaaatcacttgagtctgggaggcggaggttgaagtgagccaagatcatgccattgcactatagcctcggtgacaagagcaaaactctgtctcagaaaaaaaaaaaaagaaaagcaaagaaaaaaaaggcacaatatgtaatgctatttgctaaagtcagcctctttatgggtcttttgttgacttcttctttagtggctccacttcttagaagttaatgagcaattcctgctatagcagcagagcctctaccaaagcagggggacttcagggaaccactggttgtcagatgtgctgggcgtgaacatgagcgtgaacagaggaaaagtgtctgatttaactggtctcgggtgaggcctgcatgttgggatgtttagaggttccccaatgataactaataagaagccaaggttgaaaaccacatctaggccaaactgcgattaatttttgccttccacctccttatcaatgtcctctttcccttatgaccctgctgcctacctgactcagttgcgtccactttctctgtgaatcttcccttacctccacgttggctgccagcttcaagattgcatgcccctctgagcagtttatctctaaccaagagaggtattcctttccaagagttccattaaaagtccaaaggagaagttaattggcctgactttggaccatgtgtgcccacctctcaaccaatcactgttatcagggcagtcatccctttgtccagccatgctcctgtatcagagaagcactgccatgacagatattgggcaaactgatatatgacccccaatactgggtttggtgctcattctcgttaatgcatgtgttaagggtttcattctaatcatctgcaaaaaagtgattgttgtctttaaaatgttaccaaaactagtcttttagcaagaatcttactagaataaaatggctcttgctacctgtatttttaatcagcctatgtatattgatcccattcctgatattatcaccttaatatataacagccccaattcctcttattgagcattggttgctagggaaagcaaaaagttaagagaaaactactgagattttctctctaatttgcctctgtctgcctctaactagcttagagatcttggacaagtcctttaacagttctctgtcagctgcttggactgtgaaatagagataaaagtacctgtctatttcaggccgggcacggtggctcacgcctgtaatcccagcactttgggaggcccaggagggtggatcacgaggtcaggagattgagaccatcctggctaatgcagtgaaaccccgtttctactaaaaatacaaaaaattagccgggggtggtggtgggcacctgtagtcccagctacctgggaggctgaggcaggagaatggcatgaaacccggaggcggagcttgcagtgagccgagatcacgccacggcattgcagcctgagtgacagagtgagactccgtctcaaaaaaataaaacatt

SEQ ID NO: 640942 - DNA, 289 bp, Homo sapiens
  misc_feature (24)..(24): n is a, c, g, or t
  misc_feature (146)..(146): n is a, c, g, or t
  misc_feature (176)..(176): n is a, c, g, or t
  misc_feature (197)..(197): n is a, c, g, or t
  misc_feature (200)..(200): n is a, c, g, or t
  misc_feature (228)..(228): n is a, c, g, or t
  misc_feature (261)..(261): n is a, c, g, or t
tatatacaactacgcaaaggcccnaacgttgtaggcccctacgggctactacaacccttcgctgacgccataaaactcttaccaaagagcccctaaaacccggcacatctccatcaccctctacataccgcccgaccttagctctnccatcgtcttctactatgaaccccccttcncatacccaatccctggtcaanctnaactaggcctctattattctagcacctntggctagccggtacttcaatccttgatagggtngcatccttacgcctgatcgggcactgta

SEQ ID NO: 640943 - DNA, 943 bp, Homo sapiens
  misc_feature (8)..(8): n is a, c, g, or t
agcttgtngcgcagtcgtgcgtaatatattgtatgtcactctcctatgggtgatctctcacttgcgcctctttgtcgcttgtaaagagcacactggggtgaaccagcaggagtggttcagagcagagatagacctctcgtgtctattagtcctccatatgtggtactgagacgacttggaagccaactgggtaaaaatcctcgttattgtgactctgtttccgccacgggataaattgccagcacttggtgtaaaataacgaaccgcgcacgcgttttatctgtgcctcaaaacccacccttggtattaagtatcattctccgattttcaataacctttggttaggaacccgctttctatacccttcttctccccgggaagcaccccccacaatgaccctgggacactcttttttagaggctactctacgtcccaccactttggtggttattgggtaaaacaacccaaagctctccgttttcttagattctgggagcgcggaggtccccttagaatgaaactggtgtgtcgctggtggcacaagcccgtggtaaacaatatctaaccaccactctttattctcctggtgtcaaaaacaattgggcgataaactctccccacgtgaagttgtttcacaaaatttccctctttgccccctttttttctccccccccgcaataattacctcttttccgtgtccctacctgctcacattgtgtgtggtccccccccaacgcgctgacttccctgtatacacccccactgtaacgtcaaatacgcaaacacacacaacgaccgattcagtacgattcatgtaataaatgactcggcatactaggcgcgcttctctctccgcaccccggtatcggtcgcgtgggccccccgattcctttgttctgggaccgacccccccacctacttcaatcgcaacacacaccaaaat

SEQ ID NO: 640944 - DNA, 131 bp, Homo sapiens
agtgtagcatcgtctgggtcacgggggtctacagcgttaggctctccttgcaaagttattctctagataaatatcattatgctagaaggtataggggttagtcctatgtttatccagagtgttcgcctgat

SEQ ID NO: 640945 - DNA, 367 bp, Homo sapiens
gaaacggcattctgacaactactgtaggaaaggacacctctacagacactagcaagagaaactaaaaccttaaagtaacggttaccaaataacctacggggatgacactaactttcatacgcaagacaaacacacaagggttatacaaacagcatcagtcacccaataaaatgcccaagcaaaaacaacaacctcaagtcccaacaagttagattcaacaggtccaaccagcaagcaaacgtgtcaccagtgttgcaacaccaaccaaccaactcaccacaatcatactagcatcatccggtcatcccatcactcatcatcatcgcaatcatcagcaatcagcatcatagcacccatcatagtcatc

SEQ ID NO: 640946 - DNA, 294 bp, Homo sapiens
tctagaggatccctccctatgagacatcaactgatggagtatattgggttggaaaaaaagccaggcttaggaagttagaaaggggaactaagagaaaggaaactcagaggggcaaaatcagcctgtctccctcagttccagattcctgagccatcacctagacaacgtctgaatccctttggcttttcctgaggctgttaggggtgagggttttgcagagggaaagggagggagctcacagctggaaggtgaaataaaaatagcatcagggaagaattcttcctggtcacttac

SEQ ID NO: 640947 - DNA, 883 bp, Homo sapiens
cgcgagcggtagctggtgtgtggcaccatggcttgggatcaccaccatcgaggcggtgaagcgcaaggatccatgggttctgcagcagcagggcagatgatgcagagtgagcgagctgatgctgcctccagcgaagaagttgagggagaaatggcgtggccctgggaacaggctgaggctgagtgtggcctccttgaacctgtaggatccagctggttgaatgaagagctggaccgtgctcaggagcgcctggccactgccctgcaaaaagctgggaagaacgctgaaaaaatgcttgctgatgagagtgaagagaggtatgaaggttatttgaaacaccgtggccttaaacagatgccgaaaagattggaactccatggaaatccaaactcaaagaagctaagcaccatttgcagaacgaggcatgataggaaagtatgatgaggtggctacgttaggtaggtgatcatctgaagggagacttggaacgcacagaggaaacgagctgagcctggcagaagtcccgtatgccgagagtatggatgagcagattagcactgatggaccacgaacctgaagtgtctgaggtgcctgctggaagcacaacgtaactctcaaaaacagacagataatatattacggcagaagtcacggactcttactggtaaactcaggaaggcaagagaccccggatgctggagatatggcaggagagctccggtatgcacagctggacacagacgtatgttgcctgggaggaataaatgggagatgggccaaagagggactcccgttcccaaggagtgtgggacaaccgtgttaccctgatgaattaaaggccagccaacctgggagtcctccctaccagaccgcagagagaatg

SEQ ID NO: 640948 - DNA, 1381 bp, Homo sapiens
  misc_feature (586)..(586): n is a, c, g, or t
  misc_feature (1019)..(1019): n is a, c, g, or t
agtgtagagattgccatttttatttgtgattttttgttttttcttatttggggtacttcaggatagccaaattatctatcgtgctattaaagtggctaaagtgacccaaggtgtttttttttgggtttttttttgtgagaaccaaagttctcacgtgtttgccccaggccgtgaagtgtgcaggtgggtgacaaactcctcggcctcagctgtggcaagcctcgtgtttctcccgaggttctcagcgcccaatttctctcgctggggctctacagcctctccacagagtataggcgtggggaatatacgagggcccccgcgccaagagggtgcccgggggccataaatttgcggggatattttaaagtatagaagaaacgggggtttttctcccacccagtgtgtgtgtgacgccccgaggagtagtgcgtttctctcaagactctctcctgtggcaccttgtgtgtgaaaacccacacgccgcgttttctctgccgggcctcttcccaaaagagggtgccgtgggggattatccccggggggtgttgtttgatgacgccccacccaagcgccgctggtgggcccnccgttgtggaaccaccccacgggcggggggttctttccacaagaagcggagagaccaacaaacaccctcatattttcttgtgttagaaacctcctatctccaggaagattttttaatatcactatagcggctataatttaggtggggatcttattttatacggcgatattaatctcgtgggggagacactcttatcgagaacattcttcttagaagaaaatcttctcttgttgtcccacgccatcattattgttttgttgactcatattaacaacatacagccggtgggggtacaggcgctcctcccgaaagttaataattgtggggcgccatgttgccaggtgttgcaacaagaggcaatataatacaccacacaccgttggtgtgggggggcagtcttcaaaccaaacatacgggggtggtcccacaacantcttctggttgtggggtacacgcacactttaacaccaacactttttttaacaccgcttttttaccaagaacaaccctcgtctttttaaaaccgttgctatatgtaacacagtgttgtgtgtcccccaaatatgagggggcccgcaaaccactctctgtaatatgatttattcctccccgcattttttataatacaacagcggggcgcaagacgcggacacgagtgttttcttataacaatatttcccccccccggcgtggggagatcaaaatatgcgagggacagtaggggacattgtggggccatcccatctcaaacagggcaattcaattactgttgtgtggcggagaaaatcctccccg

SEQ ID NO: 640949 - DNA, 1640 bp, Homo sapiens
  misc_feature (49)..(49): n is a, c, g, or t
  misc_feature (51)..(51): n is a, c, g, or t
  misc_feature (54)..(54): n is a, c, g, or t
  misc_feature (69)..(69): n is a, c, g, or t
  misc_feature (83)..(83): n is a, c, g, or t
agggagtcgacagcatccgattgctaaaacattcaactctgggtgagtngntanccaactaggcaggtngacaggtcagtctncagctgactgtctgcctctgcccaatttaggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 640950 - DNA, 125 bp, Homo sapiens
atacctgtccttcagagtaggttgatgtaatacagcaacatttataattttgtttttccttttgagacacagtctcactcttgcccaggctggagtgcagtggtgcgatctctgctcacggcatt

SEQ ID NO: 640951 - DNA, 299 bp, Homo sapiens
tgggctaaggggcagcaataatatggtttggtagtgtctcacccaaatctcatcttgaattcccaagtggtgtgcgaggcaccctgtggaaataactgaatcctgggggcaggtctctcccatgccgttcttgtgatagtgaataagtctcatgagatctgatggctattataagagggagttttcctgcacaagcgctctttgcttgctgccatctgtataagacatgatttgctcctccttgccttctgtcatgattgtgaggcttccccagcagagacggaatcgtgatctagatc

SEQ ID NO: 640952 - DNA, 1390 bp, Homo sapiens
accggagtctataaaggcagtcgggtagccctggacaaggctaatgcttccaggggacaggtggaacaggccaaccaggaacttcaagaacttatccagagtgtgaaggacttcctcaaccgtgagcctcccacgtgtcccaggccatgtggttgtcccctttggcaactcccggtgtctgtatctcccttggttcatacttgagcctcagggactacactggattagtgtttatgatcccttgactggctcctgagttattgcccatatgtggtcccaggtccatgttcttgagtctgagccccttgtatagtccctgtccttgtgattatatccttatgcctggtaacaaacccctatcccatgtacatgtcctgagtccataccccaaaactgtatcctcatgcccatgctggagaatctatgttcttaagttcttgctgtgtccctatagaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 640953 - DNA, 5878 bp, Homo sapiens
  misc_feature (129)..(129): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacagggtaagaaatggggcaccagagacacaagactgcgggaaaccccccctaaactgacacctgcccttcctagaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 640954 - DNA, 275 bp, Homo sapiens
attgcaaggaaatcaggaggagaagtgtactggacagagcaagagaggcaccagagcccagacccaaacacacatcatcggatacattccttgccctgaaggagatcagagaaaaacacatccactgtgtccttggagtgggaaatggctttttttaacacaatagtttcctataaagcatcaaaaaaacctcagagaaaacctcagcaaaagttcccttactctacaaatctttcggcatcaggcagtagaggctaggacatggctacgctact

SEQ ID NO: 640955 - DNA, 5767 bp, Homo sapiens
  misc_feature (129)..(129): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcacgtccccacatgcgggagtcgtctagagtcgacctcagc

SEQ ID NO: 640956 - DNA, 302 bp, Homo sapiens
ttaactaacctttatcccccctaaaatgcccggcatctttgcccgaggcgtttttgttcatgtctgtcaccgctcaacctgccagccctgcgccggatcatcacgcccagttcatcgaactgctgagcgcaagcctcgcgcagaacgcgtttatcaagctggtgctggccaagtacgtcggtgaggaagccgagttgcagcggctgatcatcaagcaggtggtggtcaaggagcaggcgtgcctgtcctttgtctatcgctacaagacccgtgacatcaccaagaacttcccgagtctcacg

SEQ ID NO: 640957 - DNA, 5924 bp, Homo sapiens
  misc_feature (129)..(129): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacagggtaagaaatggggcaccagagacacaagactgcgggaaaccccccctaaactgacacctgcccttcctagaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaacccccaaaaaaaaaccacaaaacgaaccaagggaacctcataacggaaccca

SEQ ID NO: 640958 - DNA, 755 bp, Homo sapiens
  misc_feature (752)..(752): n is a, c, g, or t
aaacaatccctttgagaggaagaggggcctgtcccattcttttgtttaaaaaaataggttaaaaaaagcccaggttcttccatttgagggtttgaaaaagtggaacaaaaccaattgcggtccccattaaagtgctttttaaggtaagctaggtttcttaatattggaaaataaatccatctccaaccatgaaataggtcatatttttccaaggcagttaagtattcatccactcctataccatcaatattaatgacaaacttttatataaagcttacaacttaggcagtaccctaattgctgccaagcaggctgtaagcgctatatgaatattgctgtatgaatgttgcctgacgtaaagagttagacactgtagagtaattttccttatattgccttttgcttaatattgcccctcttttaaatcttcacaagagccacattaactaggtactgttgtcctcatttcatagttgaaggaggaaactgaagcacagagactttaaatatattcaccaaggaaatcgagccattaattggtaaagcctggatttgaacccaggcagtctgggtttctgagcttgtgcccttatccactatactgtgtattgttccaataatttttagttgcataaacgcttagaaatagcatttataagttctctgtgctccagaagaaccagtttcaagaaagaataaaatatatgtaaatagcagataaacccattatattcagataaggttgcaggaantgc

SEQ ID NO: 640959 - DNA, 5617 bp, Homo sapiens
  misc_feature (129)..(129): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctagaggcaacagcacagcaggcctccgccctgcctggccacagg

SEQ ID NO: 640960 - DNA, 5586 bp, Homo sapiens
  misc_feature (129)..(129): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccgtgagcctcccacgtgtcccaggccatgtggttgtcccctttggcaactcccggtgtctgtatctcccttggttcatacttgagcctcagggactacactggattagtgtttatgatcccttgactggctcctgagttattgcccatatgtggtcccaggtccatgttcttgagtctgagccccttgtatagtccctgtccttgtgattatatccttatgcctggtaacaaacccctatcccatgtacatgtcctgagtccataccccaaaactgtatcctcatgcccatgctggagaatctatgttcttaagttcttgctgtgtccctatagaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagttcctagcactgccccacatgcatgtctgcctatgcactgaagagctcttggcccggcagggcccccaataaaccagtgtgaacccccaaaaaaaaaccacaaaacgaaccaagggaacctcataacggaaccca

SEQ ID NO: 640961 - DNA, 5540 bp, Homo sapiens
  misc_feature (129)..(129): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccgtgagcctcccacgtgtcccaggccatgtggttgtcccctttggcaactcccggtgtctgtatctcccttggttcatacttgagcctcagggactacactggattagtgtttatgatcccttgactggctcctgagttattgcccatatgtggtcccaggtccatgttcttgagtctgagccccttgtatagtccctgtccttgtgattatatccttatgcctggtaacaaacccctatcccatgtacatgtcctgagtccataccccaaaactgtatcctcatgcccatgctggagaatctatgttcttaagttcttgctgtgtccctatagaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagttcctagcactgccccacatgcatgtctgcctatgcactgaagagctcttggcccggcagggcccccaataaaccagtgtgaaccccca

SEQ ID NO: 640962 - DNA, 300 bp, Homo sapiens
  misc_feature (42)..(42): n is a, c, g, or t
  misc_feature (89)..(89): n is a, c, g, or t
aaaaattaggaatatttttttttgagacagtcctcactgtgntgcaggctagagtgcagtggtgcgatccccggctcactgccaacttnttgcctctgcgtcaagcgattctccttgcctcagccttcccaagtagctgggactacaggtgtcccgtcaccaacagccagctaatttttgtatttttagaaaaaatggggtttcaccatattggccaggctggtctcgaacttctgactttgtgatccgcctgcctcagcctcccaaagtgctgggattacaggcgtgagccgtcgacgc

SEQ ID NO: 640963 - DNA, 162 bp, Homo sapiens
ctaagaaataatttgtgtataagctggaccatccagaaataatgcagctctgtgtgaacatctgtattcaccttcggataaagctacgattctagctctgggcctttcatgtgaggcaaatttgccttttaagttactccaaatagggcttgtgaaacccac

SEQ ID NO: 640964 - DNA, 5176 bp, Homo sapiens
  misc_feature (129)..(129): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctggaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcacgtccccacatgcgggagtcgtctagagtcgacctcagc

SEQ ID NO: 640965 - DNA, 235 bp, Homo sapiens
ttcgtcccctacacagagactcttgcatgtagagaagcaggtcctttcgtagtagaggctgaggtaaggagcaatgggaggcggcgaggcctgagcccccttaggctcggtcctagaaggagctgagtgagatagctcttccaaggagcttgcatgaaactctgcctggaccccctaggagcttctagtgtaacaaggccgccaacagaacaggccaaccaaagcagcagatagg

SEQ ID NO: 640966 - DNA, 3905 bp, Homo sapiens
  misc_feature (129)..(129): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggcaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 640967 - DNA, 303 bp, Homo sapiens
  misc_feature (188)..(188): n is a, c, g, or t
tggtctcaaccgacgaagaatccctaccgagactctgccctaacttctcagacctcgaggctgaggccgaggccgacctcaggcccagagaagaagtgcggcggggaccgagcccctcggttcctagagctgggcctctgcgcgaagcactgtggcagcccgtactgaggtcggggttcttgtctcanggcctggcggtttcgcggggtatggcactaaggtctctgggccccggtgtgacggttgcttgccccccatcttgccttgcaggctttgaaggggtccttccccaggagcccaagc

SEQ ID NO: 640968 - DNA, 329 bp, Homo sapiens
aggtatggagagggggttcagcgagcctgacaactttcttctgccctctcttgccccagaaacagcagaggcaggagagagactccctctggctcctatcccacctctttgcatgggaccctgtgccaaacacccaagtttaagagaagagtagagctgtggcatctccagaccaggcctttccacctaccctccccgagatacccttcgagccacctgctgcacatgttcctgactgatgccctaggatcagggaactgcctggcaccactggatatctgctctactttccggcctctgctcctgcagttaaggcaccaaagcttgct

SEQ ID NO: 640969 - DNA, 801 bp, Homo sapiens
  misc_feature (305)..(305): n is a, c, g, or t
gttcgtgtactgcgcgtccgctgaccctggaaaatgtgttatccgcgaggggttcccgggaccccgctttgggagcagtgctttcccgcggaagagactattttctggcgtttgttgcccccccccagccagagttccccccccttgggcgccgccgcccaccatattcgggggattgttggtccttcccccagtaggttgccgcccgtgatgactggtgttctccccgctcacacgcgacctcgtggggggcattgctccccacctactgtggggctgttgcgggggagcacccccccacactngtcctctactccatggggggtttccccaaagtggcaatgcgcttcccagcgctcttgtcaagtgagtcagagagaagaagccccccacaaggtttcgtgtctccccgggtagtgtaccccggatatctgtcggtgacgagacccctgttgcaccacgtcctgtgcaagaatgtcttcggtcttgtggcgtctctactgaggcgaatttggcccctgtttgcggctggattcccgcagacaaaatatgtcgcccactctcgggaccacctactctatggcgggtatgctggtcgaccccgttttgtctgaagcacgatgcacaacttgtccaacgacttggatgatttttgagatgacgactctctgtgtaccttctcagatggtggttcgtcgcccaccttcaaatagtcatgttgccactacgttggggaccttggagatatcccgcagcagcaagaaaatatcaacaaaccaaaaagaacggaccacaatgaca

SEQ ID NO: 640970 - DNA, 102 bp, Homo sapiens
  misc_feature (38)..(38): n is a, c, g, or t
ggccaaaaaaaaaagccttttttttccttaggccaggnctccattgaaagatgaagaatggaggttgtttccaaaagaaataaagagaaccttagaagttga

SEQ ID NO: 640971 - DNA, 251 bp, Homo sapiens
agagacgagatgaaagttctgtggttagctgggcatggtggtgtgcacctgtagtcccagctactaaggaggttgaggtggggatagtgcttgagcccaggagcttgaggctgcagtgagccgtgactgcaccactgcactccaggctgggcaacagagcaagaccctgtttcaagggggggaaaaaaagtttctttggagttgcaaggccttgtcttcactaagattttagatggtccccccgacgatgt

SEQ ID NO: 640972 - DNA, 779 bp, Homo sapiens
  misc_feature (269)..(269): n is a, c, g, or t
  misc_feature (542)..(542): n is a, c, g, or t
  misc_feature (636)..(636): n is a, c, g, or t
  misc_feature (683)..(683): n is a, c, g, or t
  misc_feature (687)..(687): n is a, c, g, or t
  misc_feature (692)..(692): n is a, c, g, or t
gaatcccttacagccctctctaccctaagacccctgactaattcaaggggtatcaaggtaaggccaaggtaagcagttccactgcaaagaactgttattcatgaaactttcaaagacctaacaacaatctggcagctgaggaaaaaaaaaccctatgatacagtagaaagagtacaggctttaaggctggaaaactggtccagctatttacaaacttcatgaccctgagcatgggatttaacctctctgagcttcatctataaaatgcngtctcattagaaaagtattcactgagcactaagtacacgtcaggcaatgtgttaggtactgaaaattcaaagatgagtaagatgcggtccctacctcctaggaatttccagcatggtgagaaatgaagatagtgatgcctatcctgtagggccatcttgaagatgaagtgcagggtgcattctaagtgctgcataaatggcagttctctttctttttacaacccattatttaaacagaatgtgacactggttaattcacagaacagggttttngaagaacatagctgcttatacttttgaaattgatttctcaagattactacaataaatatgtcaactataattcttatactttctgttgtaattngttttatgatatttatatatactacatacttttagttagaaaaaacnaacnattcnaaactatagaaatgataatagtttagtcgcttcatataagctttatacttgagttttgaggctaaaacttttttttctgagaccgca

SEQ ID NO: 640973 - DNA, 340 bp, Homo sapiens
  misc_feature (340)..(340): n is a, c, g, or t
cccgctgccacctcggccagccatcaagccctccgataccttcggctaaaatatctttcatattttagaatttgtcctcggaaaccttttcggttggggtggtctctctcactcttgccccttctcacggagctcttggaagtcaacaggcggttgcggcttgggctgcccatgccatccaagtccaaggttccaatccggggcttgtgtttggggggaagacctcacctcgggatattcctgtttcttcatcagtggagttttctcgccccgctgagatcaaagagagggggaggtggtttataatataataatttgggggatcgtcgaagaagtaacn

SEQ ID NO: 640974 - DNA, 114 bp, Homo sapiens
ttagctcatgttgtgtttcacagcaaagagggtacagagccagcattggtgcaggttaatgtacaaaattgtctggcaatgcctgagtaaaaaaataaagttggcttgttgaga

SEQ ID NO: 640975 - DNA, 238 bp, Homo sapiens
tctgtgataccaggtaaacctttatttatgttgtactatatattatatttatgtatatatatttatatttatgtatatgatttcgtgtacatattttatatatttatatacatagtttatgtttatatatttatctataatgtgtatatatttttattaatatttatgtatattatgtatatactgtatatatatttatattcttccatctatattcacttaagtgggtagtcacaga

SEQ ID NO: 640976 - DNA, 164 bp, Homo sapiens
tatgtcgtggaggaccatacacacctgctcgctgtaagcacgggaatggccattaccggcctggacctcctccttcccccagcactccactcagggaaaagcaattccatgcacaagagacacattgatcttacccaccatacaaatagggcgagcatctacac

SEQ ID NO: 640977 - DNA, 186 bp, Homo sapiens
ctgggtagggcgggaagacagagcatacatactggaaagggtgtgtactgatatactcgtatggcaagttctgacaggttttctccctaggaagtgcagcacataccccaacacactggctctgcaattgtgccaatcccagatggtgcttgttttgtgcgcaccctcacccaaacccttgcccta

SEQ ID NO: 640978 - DNA, 89 bp, Homo sapiens
tcatctgttttctaaatcttaaatatcctgagcttaacatcagcctggatcactagcaaaggcattaagtaattagtgttgaatgaggt

SEQ ID NO: 640979 - DNA, 359 bp, Homo sapiens
cacgagggggatcgaggtgctgtcgcaccactgcgactcgcggatcacgatcccggacgacattctgctcaccgtgcacgtgcgcatggccaccatcatcaagcggatcagggacgtgaacaacttgctgctcggggcgatccaggtcatctgccgcatgatcatgcgctcgggcctgatcaacatccttttccgcaagctgcggatcgtgatggtctagatggtgctgggcatgatggtgacctgttccgaccgcagcctgcacatcgcacagggttagctcggtggcccgatcgaacatctactgcaccgccatctgaccctattggcagccagcggtatccttgtttacatcaacg

SEQ ID NO: 640980 - DNA, 253 bp, Homo sapiens
ggtgacctagaggatccctctgggtcctcatggatagtggtgggaagagggcagcatggacggccgtccggcccagtacatgcagtctgaactcggtgtgacgaccgttgcttaacagtttgttctcacgtggactgtgcaggggagtagagtgccacgatcggctgagttgcagtgacgggagcaacatagccctgatcttgtgcgcaggaaagcggtcctctagcacgaaattctctcgggcggccggtca

SEQ ID NO: 640981 - DNA, 523 bp, Homo sapiens
  misc_feature (18)..(18): n is a, c, g, or t
  misc_feature (50)..(50): n is a, c, g, or t
ggagggaaggagcccggntgccctggagaggatgcagacgccaggctcgntgcctcggagcagcagggctccgctgcctctgctgctgtcacgccacccaggctcttgccccgggagttactgttactgctgtattgccaccactgttgctcctgagtggatgctaggccttccgggcagccagttacagtcagttttcctttcctggtgctcaggaggattaggagagtggtctcatggcctgaacgccctgaaggcagaactgagagactggggaggaatgaaatcctcccgctcagaggaaatgcagagaagtagaatacccagcccctctcccacacccacacagactcagcccacaaactggagagtaaaaataaagaaatcgtacaggaagcatggagcaaatgactgtgagatgtttcgctttagagaagtgaggagcagagggggagcagaggctggagttggctgagaggggaaatccgcaggtacagcctgcggggctcttagagcccagagg

SEQ ID NO: 640982 - DNA, 550 bp, Homo sapiens
cccgtgctggtgaactaaatcaagaagttaacagactcatggttgccatgagggacatgttggctaacatccagtttcatgaacctcagtgggaggacaaccaagaaagagacgaggaggaatgggactaacagattaacaaggttgtgatttttcaaatgaagttgaatgacaaattgaaaaagcacaaaagaggaatttgtatgatctgctcaccttaattttgaataaatccaaattattcataccttgtggacaactgaattgtgctctacatatttttaatatgaagggccaaacatactgatgtatgtcttaaatgtcttaaaggttcgtttttttattattattattattaaaaaccttttaacctatgctttcctgataaatttcctgaaatttataagcatctatagtaagttgagccaccatgcttattacacaaacagtcaacacggaatattagtaaaaaaaaaaaatcatattcaatgctttatcaaactatattgactctaaattttcaataaactgctgaaaatgctgcccaata

SEQ ID NO: 640983 - DNA, 132 bp, Homo sapiens
gactctacagatcctataccactgttcgtcatgggtgcgaacgatgtagaagtatgacaacagcctcaagatcatcagcaatgcctcctgcaacaccaactgtcttagcacccctgtgcaaggtcatccatg

SEQ ID NO: 640984 - DNA, 341 bp, Homo sapiens
tcgtgtacctgtgggtatgcatcaataaggaacggtcccaggttggggacgagccccaagttgagaactaagtaagtgaacaattgttttactgaaccacttgttacgatacacgctgatcataaacaacctgtgtgtaatatgtatttctcctaaaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 640985 - DNA, 1208 bp, Homo sapiens
  misc_feature (40)..(41): n is a, c, g, or t
  misc_feature (154)..(154): n is a, c, g, or t
  misc_feature (209)..(209): n is a, c, g, or t
  misc_feature (399)..(399): n is a, c, g, or t
  misc_feature (402)..(403): n is a, c, g, or t
  misc_feature (407)..(407): n is a, c, g, or t
  misc_feature (414)..(414): n is a, c, g, or t
  misc_feature (451)..(451): n is a, c, g, or t
  misc_feature (489)..(489): n is a, c, g, or t
  misc_feature (505)..(505): n is a, c, g, or t
  misc_feature (514)..(514): n is a, c, g, or t
  misc_feature (538)..(538): n is a, c, g, or t
gggccgcggcaaatcggagccgctcttgctgcgacgcggnntcggaagcggcgaaggtcgaggccgggttggcgccggagccggggcgcttggagctcgtgtggggtctccggtccagggcgcggcatgggcgtcctggccgcagcgggcgctncctgtgtccggggtgcggaccgaatgagcaagtggacgagcaagcggggcccgcnacgttcaggggccgcaaggcgagggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctttncanngaanccgtggngcctgccatcgaaaaggacttcaaggacggtaccttngaccctgacaacctggaaaagtacggcttcgagccccnacaggagggaaagctnttccagctntaccccaggaacttcctgcgctanctgggcgggggaggggcggcctgccctcatttcatttttattattttaaaactgcacttttggcccaggctaaggagagagaagaagaaggaaggaggaagaggacaaggtcgctagcaaaggtgaagaagagaataagagcggagacatattataaagcggagtgtgggagagaaaaagagggagatatagaaggacgggcaggcgggaagaagagggggggagaccgcggaggcgcagcggaaaagttagagaagaaacgaggggggggagcagagcaggcgggggcagagaccaccaacaagaagaggggcggcagaagaagggacgggcgggacagcggcgcgaggaactcggcgcggaaacaaggcggcggaggagaaaagcagggaagaaacaaggagcacaccgagaaacgagagaggaggggggaggaaaagagcagcgtagagagagcaacgggggaaggggggaggacaggggaggagccagaggcgagagaagaagccaagcacgaggaaggcacacaccggccgcagcggagaagcaagtgggaaagagaggcgaaggaggacgactagaaaggacggagcacaggaacaaaaaagaaggggagaggaaagaggggagcaggcgcagcgacggcagagcaggaaggagcaggggggcg

SEQ ID NO: 640986 - DNA, 234 bp, Homo sapiens
  misc_feature (14)..(14): n is a, c, g, or t
  misc_feature (68)..(68): n is a, c, g, or t
  misc_feature (143)..(143): n is a, c, g, or t
  misc_feature (152)..(152): n is a, c, g, or t
  misc_feature (183)..(183): n is a, c, g, or t
  misc_feature (213)..(213): n is a, c, g, or t
gtgacagctgcggntccccagcccattttcataggtgccaccaaattagcggctgttggtgaggccgnagaaacgagtctgaagaaatgttctgtgtgaaattggactagattggctctggtatcaacacaggcacaggctgngggaggctngacagccataaacaaaggctaacggcagatntcagcgtatcgggcaggcgggggcatctcntgggaggcctcctaggccact

SEQ ID NO: 640987 - DNA, 1323 bp, Homo sapiens
acttctgttttgtctatcctatgcaaccactattataataatgaacatacgtattaagtaggcgtgttctgcccactaccctatattaacaatctgcacgtctgcctgcgccggtcatgttgtataaattagtcacacccctccacctctacctctcttcctcttgtttggtgatcgacgagcttggctccaacaccaccttcatgccttctttttctctctttcccactgccgctttgtcgagatctactattatgcatcgagttgtgtagttagatagatcagaattgtgtagggggcggtcggggctgtgtggtggccgcccgcccaccacaccggcgctggctgttgtctgtctctttcctctgctgcgtcccttctcatatgtgttgcgcttccaccctccccgcagctgatggagttcgcacacatccattcctcgggcgtgcctccgttgtctgtgttttcttctctcctcctccccccctgcaccccgtctcgcgtgccgtccaaacgtgctcttgtcttctctcccctctaatatcggggagttgtcgtctcccccgccaccgtctttcctgtctctctcgttttgttttactcgcacagtgagagggctccctccctgtctttgtcacccctcgcctatatgttagttcgccccccttgtttgtgctccgcgcaccacactcgctttgtctgcgtcattttgctgtccctcccccctccctctgtcgcctcacaacacgactcttttgtctcgtggagaaaaactagctttctctgcccccgccccgctcgctcgcactcgcccgactctgttgcggcctctgctcacgcacctccagcccaccgccctggtcggtgttgttgtgacgacccccccccccgcacgcgtgttcgcggtttgcatcaccatctttctctccgcgcgagtagatttctcctctccgcgcgccctctcttcttcttttccccacctctcttctctctcactctcttctttctttgttcccaccctcggaggggtcttctttagtatacccgccctcctcctccttctctctgagtgctgtctctcttgtggggcccactgctttctcacctcttggggcggtctccccccgtctcgtcttcgttgtctctccctgctcccacaccgccctcggggaggatttctccacgaaggggatccgtctgcaccgctgcccacggccacacgccgtgcgccactacgcacgtgttttttttttcctatacccaaaagttttttaaaaattttttttttgtggtggtgggggggtttcttccacccccccccca

SEQ ID NO: 640988 - DNA, 148 bp, Homo sapiens
  misc_feature (107)..(107): n is a, c, g, or t
gagtagtctgtggtatagtactatatgactcgattttcagatactacaaataacttagaaaaattgagtcagactgaatagcatccttaaacacggcatttacaatngctagaaattagtaatgtagtctatcatgtgcgtttgaata

SEQ ID NO: 640989 - DNA, 200 bp, Homo sapiens
cgtgtttcaacatgttagccaggatggtcatctcctgacctcgtgatccgcctgcctcggcctcccaaaatgctgggattacaggcgtgacccaccatgcccagcctggatatttaaattgttctgtgctctcctcctttccttccctctctcacgttctctctttagcatctttgcttctgtcaacagagtcccccttt

SEQ ID NO: 640990 - DNA, 244 bp, Homo sapiens
  misc_feature (244)..(244): n is a, c, g, or t
gaattgctgacagccctctcaacgattctagaatttttgttacttcttctctggaaatacaatataaagaatttttatatggtttcccaagtagatatgaagctttttaaattaaaattcttgtgtctctgataagagcaaatgaaccatcttcatacattttaaagaagtagacaaatatattatagacaaagcactaacagaaaataaaaacaacattagaaagtaaaaagtgacaagcccn

SEQ ID NO: 640991 - DNA, 244 bp, Homo sapiens
tggaacaggtggaaatgcagatccagatgctggcagaggagctccagggtcagcgccagaccaatggcgcctgcgttgcccgcatccaggccatgcggcaggccctgtggtagagtgattcgcaccaggaacgcaggtgctgggctgtcggggaggcatcaggccacctccaggaacagaacacagtgttaagtttgattttttttatttcaaaatggtttgcaaataaatgaattactgttca

SEQ ID NO: 640992 - DNA, 3016 bp, Homo sapiens
  misc_feature (129)..(129): n is a, c, g, or t
  misc_feature (2839)..(2839): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaaggtactcttctgccccttgttccctcctatgcttctctctccttcccattacngttctctctcctccttctggacctgctgctggtttcctcaaactaagtcttggaccctctactctcaacctgggtcagttgtagttctcttccatttcctgaccttcccacctagactcccactactcacactccctatgagaccctcccccacccggacctcaattaaggatcctg

SEQ ID NO: 640993 - DNA, 261 bp, Homo sapiens
  misc_feature (185)..(185): n is a, c, g, or t
  misc_feature (253)..(253): n is a, c, g, or t
catttttcaacttatctgcagaagatgaaggccagctttagtctataatacacagaggacttactacatgcgaggcacttatttcaagcatgttacatatctcttttagtcttcacagaaactttacgaggtagttattacatatcatcccttacttaacggggtaacgaaaacgtggaggcacnagaaaggtgtcaagtaacttgtgcccaagggttattcagtcactggagtggttccaaccttaagctgncgtgaggt

SEQ ID NO: 640994 - DNA, 3103 bp, Homo sapiens
  misc_feature (129)..(129): n is a, c, g, or t
  misc_feature (2707)..(2707): n is a, c, g, or t
  misc_feature (2732)..(2732): n is a, c, g, or t
  misc_feature (2926)..(2926): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctgtgagtgtctgtgatgtgggttgatggggcagaggtggggacccagnctgattggcaacctcctccccacancatgtcagtgcacctcaaggttcactgagttctgagtgcaaccctcatggtggtcagtgcctgtgcaagcctggagtggttgggcgccgctgtgacctctgtgcccctggctactatggctttggccccacaggctgtcaaggtactcttctgccccttgttccctcctatgcttctctctccttcccattacngttctctctcctccttctggacctgctgctggtttcctcaaactaagtcttggaccctctactctcaacctgggtcagttgtagttctcttccatttcctgaccttcccacctagactcccactactcacactccctatgagaccctcccccacccggacctcaattaaggatcctg

SEQ ID NO: 640995 - DNA, 137 bp, Homo sapiens
atacagcactaggccatcctcccatttcactcagaagaaaagctctgacagcagctgaaaacccgagcctccttctcgggcccctctgtgagtcactgtagtgtgggctggacacgccaggcccctgccctgtcgcg

SEQ ID NO: 640996 - DNA, 391 bp, Homo sapiens
  misc_feature (16)..(16): n is a, c, g, or t
  misc_feature (37)..(37): n is a, c, g, or t
  misc_feature (65)..(65): n is a, c, g, or t
  misc_feature (102)..(102): n is a, c, g, or t
  misc_feature (154)..(154): n is a, c, g, or t
  misc_feature (174)..(174): n is a, c, g, or t
  misc_feature (194)..(194): n is a, c, g, or t
  misc_feature (209)..(209): n is a, c, g, or t
  misc_feature (228)..(228): n is a, c, g, or t
  misc_feature (244)..(244): n is a, c, g, or t
  misc_feature (281)..(281): n is a, c, g, or t
ggactttgtgctcccnagacggccgcgtcattccccnaaaggcattgtctgcctcatcaatattntcggggatcccattacaaccccaactgtgtggccaanacccctggaggctacgaccccttccgtttcaacccaagagaacatcaagganaggtcacctctggcttttantcccttctcgcagggcccanaaactgcatcgggcnagcgttcgccatggctganatgaaggtggtccctnggctcacgctgctgcacttccgatcctgccgacccanactgaaccccgcaggaaacccgagctgatattgcgcgcagagggtggactttggctgcgggtggagcccctgggtgcgaactcacagtgactgccctacccacccaccca

SEQ ID NO: 640997 - DNA, 2278 bp, Homo sapiens
  misc_feature (129)..(129): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggttagaccctgttatctaatctggagctgaacctctgggtgtgggagcatctcctccatcatcccgttttcccaggtccctgagcaata

SEQ ID NO: 640998 - DNA, 203 bp, Homo sapiens
  misc_feature (50)..(50): n is a, c, g, or t
agtcgacatagtggatcaaagaattcggcacgagtgaatatctctatcangaacagtatttgtatcctttcgtctgatatacccattagcacttaaaattagacttcttatagataaagtgttgctaactctatatgatcattctctgggatactaggaggatgtgttattgcttcagagatatgcactcctcacgcatatag

SEQ ID NO: 640999 - DNA, 3000 bp, Homo sapiens
  misc_feature (129)..(129): n is a, c, g, or t
  misc_feature (2707)..(2707): n is a, c, g, or t
  misc_feature (2732)..(2732): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctgtgagtgtctgtgatgtgggttgatggggcagaggtggggacccagnctgattggcaacctcctccccacancatgtcagtgcacctcaaggttcactgagttctgagtgcaaccctcatggtggtcagtgcctgtgcaagcctggagtggttgggcgccgctgtgacctctgtgcccctggctactatggctttggccccacaggctgtcaagctctgcatctgccgcgggatgggctgagatagtggtttctgtcccctgatatccgcttgttctcctccctttgttttctccctctcctcccttccactcacttttgctacctttactttcttcctg

SEQ ID NO: 641000 - DNA, 995 bp, Homo sapiens
agttggtatgcgagtcttatatgtgtcacgctccaaagatattggccagcttatggtgtctgtgcttgttgcgtccttgcattaaattcggggtgcggtgggagaattgcttgaacctggaaggcagaagttgcagtgagctgagatcacaccatgcactccagcctgggtgacagagagactctgtctcaaaaaaaaaataaaattcccaatcttaatgtctgtttcagaatttcagtgattaaagacgtgatagtagaaaataccaagcatatgaggtattccaatatgataggcttcttacatttataatagtaacacatcttggttccaggacccttgacatgatgctcggggaaacggataaagcagtagaataccaggccagttgggcctctgatttgagtacatatataataaaggttggggagataatcatagacatactcaatattcattagctgataatgtagtcaataaatggcatcggggagaagacaaacaacacattgatgcataaaccttctgtaacacgatagcagacattacacacgcgcattgtgactttcacactctgatgtgaatgcccacctgtaagaacacacacaagagggagatagaactcaagaattgaaggaaacccttatgctgcaaaataaggtacctacacctaaaacatatagacctggcacacccacacactccatacatcaagtgagaggaggacaaccgaaataccacggcgacagggaaaggacgccgacaaaacacacagggagcacgcaaatacagggcgaagcagaggccacgcgacaaacagcaacacgacaacacacagcaacacgaacaggaaacgacaaaagaggaacagagaacccgcaccagccagcccggcagcgcaaacgctggaccagaaaccagaaaccgcaacaaagaacaagagcagccacacacaaacagaacaaccccaccacaccgcgaggcgcagaacacta

SEQ ID NO: 641001 - DNA, 259 bp, Homo sapiens
acactataggagaccccattttccaaagtagcagttgtaccgaacaaccctaacctaaccgatcttaattgaactatttatattatcctaactactaccgcattcttagctctcagctgaaactcgagcaccacgaccctgctactatctcgcagttctaccgtacaaccgtaacttaaccattcttaatctaactatttatatgatcctaactactaccgcattcctactactcaacttaaactccagcaccacgacc

SEQ ID NO: 641002 - DNA, 203 bp, Homo sapiens
attcgcggccgcgtcgaccaaaaaatacaagaaattagctggatgtggtggtggtgcacacctgtagtcctagctacttcgggaaggctgaggtgggaggatggcttctagctgggaagcggagggtcagtgagctgggatcatgccactgcactttagcctggaaaaataaagggacattgtctctaaaaaaaaagttaaaa

SEQ ID NO: 641003 - DNA, 793 bp, Homo sapiens
gacaggttgcccacctcccccaagccaccccgttcgcagtagacggacagaggagtcgtagcggtcgaggcttgggcggctccggtgtgccggaaaagtatgttatgcataaaagtggatacattcacttgataccatgaaaatggccaaatttctttaagaggagaagtactaaaatttataaaaatcggggtgtatctgtggacagagattatcccaaaaggagcagactatttaaaaaagcgttggaagacacatttttctctttaagagaacaacggagtgtgaaagaaatccaaggagaaagatccaagcgaacttttattgtgcaccaggggcgcgaatttgtgggtaatgggaaaagaggcaggctaaggaaaggtttgggtaactatccctttaagggaaaattaagaaggatgctaattggaaacaagagggtctaattagtccagattaaccaagaaaaactaatgagacagcattacatagtttaaattataggcttaattcagtgcccaggctgggttaattgttataccccaagcagtgttgcggtaaaaacataattccctaacgctttaaacatggggcacagatattcccttggttgtgtaacaacaattcccttgaagctggcccatagtgacataaacagaggggttccaacttcctgtgcattaccggacgaatgtatcaggcaacttagattgctcatggtgtaacagaccttggcaatgtggcaatactaccgtcataaattagggcgaaccaatttgatggacacttctcg

SEQ ID NO: 641004 - DNA, 149 bp, Homo sapiens
cacacgctgatggcaggtccaaagcactgctctcctctgacaggctgcctgaagtggcgtccctggctgccatagtcctctcgaattccaccacactggcggccgcaaggagaggacagcgattctcgtacgaacggttacgattcgaa

SEQ ID NO: 641005 - DNA, 187 bp, Homo sapiens
acattagcccagtgcagaacctgctcagcatcagcagatccaaaagaccagcgcaagttaatccactcattaagatacaattcactccttcctaaaatgtcagaatagtcggtaaccagagatgaataaaatcttatccaaaagagtaggtcttataacataaaagttttttttaggaagtatatgt

SEQ ID NO: 641006 - DNA, 233 bp, Homo sapiens
ggggccaatttttttttaaaaaaacagggtttttttgccccaaactgttccgtttttaaaaatttttaaaccccctcaaggggttttttggggggtgaaacaaaaggggaaaattttaattggtccccccctttaaaggtttgaaattaagtttcctttttttttcaagttttgtttcccccccgtttttttaaatttgtttttttcaaaaaaccttttgttattttttttta

SEQ ID NO: 641007 - DNA, 354 bp, Homo sapiens
  misc_feature (125)..(125): n is a, c, g, or t
  misc_feature (184)..(184): n is a, c, g, or t
  misc_feature (186)..(186): n is a, c, g, or t
  misc_feature (333)..(333): n is a, c, g, or t
tttttttgagacagagactcactctgtcacccaggctggagtgcagtggcatgattttggctcactgcaacctccacctcctgagttcaaacaattatcctgcctcatccttcggagtacctggnattacaggtgcgtgccaccgtgcccggctcatttttgtattcttagtagagacggcatntnaccatgttggccaggctggtctcaaactcctggcctcaaccgatccactctcattggccttccaaggtgctgggattacaggcgcgagcaccacaaactggctcagtaaatacattttttattatcaaaaaaggagtagtgtatggntggcgtattctgtgtagaatg

SEQ ID NO: 641008 - DNA, 509 bp, Homo sapiens
  misc_feature (509)..(509): n is a, c, g, or t
tcgagctcggtaccatctagtcaggagcagagggggccagtcgatggaaatgactaatgcgaggaaacatcaggggtaaagggggatggttactaaactgacctgacaagattctgctgaaggcaggtgagggtgatcaaatattacgtgggggatagtacaagatgaggaatttgatcagatattaagggtgatcagatattgaggctgggagattctagctaaactgacttatcaggaatctggctaaaattgggcaatgccaggattcccctgggtaatcatgatcagttaccccagccaaaaccatagctcccttgtttgccagttgattcaggagcatgagggacccgaagtggtcgggtgggagttttcacttttagtttaggggaatcatggtgtgtctcctggtggaagtatttctcccttgggaattaagacctctagaacagcagagcataaggtcacagagacaggtagcaaaaattttgctagtggactagaggggn

SEQ ID NO: 641009 - DNA, 934 bp, Homo sapiens
caccttacaaaaaaagcacttgaagttttgtgttgttgtttttttttcctgagccagagtcttgctttgtcacccagactggaatgcagtggcatgatctcggcttactgcaacctccgcctcctgggttcaagcggttctgctgtctcggcctcccaagtggctgggattgcaggcacgtgccaccgtgtccggctaatttttgttattttttttttttttggagagtggagttctggactccgtgttgggaattgcaggtggtgtgactctcagtctcacgtgcaaccctccaccctccgcgggttcaacgcaattctccgtggcctcagcccttcccgagttagctggaattaagaggcctcccgccaccaggcccagcctaattgtggtatccttggctagagatgtggggttcaccatgtgtttggccagggtgggtctccctgacctcatggatccatctggcctcggcctcccagggtggcggggatgaatggggcggtgagccacacaggcccagttgatagaaattttcaagggttacaaaggatttataacctggtcatcctggtaaccgaaagtactatataatttaccttctcaaaccgagtttgtctattcttttaaaacagtttttttatttttcccacctgatcttttttaaaaccaaacgtgtgagtctctatcaggtcccacgggttgagaatttcccccggtgaaccaagggggcttttttcccccctagagattcgcgcataggtcccattgaccccttgggagggtttcagcctccagaactttttggcacaccaattttcgtgtttgtttggcgcccctaacttgtcttggtacgcgcgtccaggaactatccccttttctagctttggttccccttcgttagttaccccccttgatttggacacggctctta

SEQ ID NO: 641010 - DNA, 129 bp, Homo sapiens
tgcggctgtggcggatgtcgcgggtcgaggcgctgattgccggcaccacgctgctggtcacgctggcagcagctgcggccctgtacatggggcgtgctggcgggcgtgctgatgtcgctcagccactta

SEQ ID NO: 641011 - DNA, 220 bp, Homo sapiens
  misc_feature (105)..(105): n is a, c, g, or t
gataggcactatgaatcacgctgagcagacactggcatgctgcacctccctcaagtcaaacagacacaggcgtcccatacaaagaatcttgtccctcactcacangacaccttgtaggcacccgggccacacccgaaacacatcgagtgcggcattacacacttcaggggacgtgcatgtggagtgcagacacacgggtacacggcgcagtcacacgaat

SEQ ID NO: 641012 - DNA, 726 bp, Homo sapiens
agcggggcgggggaggagacggtggtgtactcgcggtcgcaactgtctgctggttgacagcaccaatggcgctgggctgatgccttcaagctctttcatgccctgcagcagaaggttcattgatgctctggatgttgggaagcatattgggaagtttaatacatcttgcaattgccgtaaagcagcaaagttttaccgccaggatagaattgcacgcatatttgtgaaaggaacaggcaaggaaaagaaaaattaaatatagaatagaagaaatatagaaaaagaagtaaagataaagggaagaatagaatagaataattagcaatgagaagagagacaaaataggcgaaagttgagagagaaaggaaagataaagtaggataaaagacatggaagacaaaaacgagagatagaacatagcggaatacgactatacacagaacacagtagttattagaaaacatagaaataggacggaatagatgagaagcaaacaggaataacgaacacacgatgagaagagatacagagtggaaccgaataacaactaacaacacggaacacacagagacgaacgcaccgcgaaccaagggagacgaagagggcaacgaacacaagcagacacaaaagaacacaaaaccacgacaagcgcagccagaacgaaaaacgagaagaccgagagaaaagtaagaaacgagaacgaaacgcaacgacaagcagggaacc

SEQ ID NO: 641013 - DNA, 691 bp, Homo sapiens
tatttctgaaacggagtctcaatctgtcgcccaggctggagtgcaggtggcgcgatctcggttcactgcaatttccgcctcccggtttcaacgattctcctagcctcggccatcctgaagttaagctggatctacagatgcccaccacacacgcccggctaatttctcattttaagtaaagacggggatttcactattttggccaagctgttctcgaactcctaggctcaaatgatccgcccgccttaggcctcccaaagtgctgggattacaggcgttgagccaccgtgcccggcccgattggcgttttaaagtcgctcgtgaacagataaaatccgaaaggactgaagggaaaggctccgacattctcccgtgatctgggcaggtgtagcagactgccgggcagagaacggtagccttgggacagcctggccccggaccttgacaacaggcccccggggagccttcagtcaataatccccggtggcgcgtagtccaaatagtcctattatcccccaaacagaagagcggcgagatacctcatttagggggcgttgacctgcatattgtgtgggaatgaagttcggcaagtgagggtgaaaacatcagggccaagtttatcagaaaccggcgcgagaaaaacgcttccttgggacacaaaagagcgaggatataaatgggacccccaagt

SEQ ID NO: 641014 - DNA, 1103 bp, Homo sapiens
tggaaagggatttcactcttgctgcccaggtctggagtgcaggggctcaatctcgggtcctgcaaccctccgcctcttcccgggtttcaagttgatcgtccgtgccttataggcctccgtgagatagcgggggatttacagggtgccataccagcattgctcggcataattttttggatattttaagatagaagaggggattttcaccagtgtgggccgggcgggtctcaaactcctagggtcttccaccttgccttcggcctcccagagttgctgagatttacggggcgttgagcctccgcgccgcggccccctttgcagttctctcgtgattgggttggtccgtgtcctcaggcttcgtgtggcaggatgtggcccagggtaggaaggaagccaggagccacacctggggagaattggggtggctccccggccgggagaggttgggcctctggggcagacctcgtcctgtatggtcaggtaaggaagagatggtattataaagggttaaaccctcctgggccgcagatggcaaaggggatgtgccttgggcctgtttaccccaggggttgggattccacaccctgtgtggacgccctgtgggcccaagtgccgtggttgtctgttgctcaccttggcctctggagggttgccctgaagttggggccttgcagacaaggtcgggttgtagggacgagtctcattacccctcccataaggcatccagggtgggtctccggaacattgaagcccctgcacctctcggagggcagaacaccccaggcaagggagaacacgacacgggtccctacacaccacagttccctgtaaaaccgcatgggccaagaccaaccccttccccgggttcgttgcacacagagccacagcaagaaatttgcgcctcacaaggttatcaacccacacaccaatatgtggcccggccccacctgtggtcatgtgtgcccaaagcacaaattgttcaccaaatttccaccatctaggcctcaacaaattggctggtaagcggattaaacacaggccaataacttccgggcaaatgttcctcctgcatggtggtttgcctcggaaccaagatttccccg

SEQ ID NO: 641015 - DNA, 696 bp, Homo sapiens
  misc_feature (15)..(15): n is a, c, g, or t
  misc_feature (212)..(212): n is a, c, g, or t
aaattaataaggtanataatttctgaaaaatatacaacttaacatgaaaatctatattatcgcataaatacaggccagattttggcctaagtgatacatacaaagtgttacactttttttaaaggcatcacgcttttctttttatctaggctattaatgtatcttgtcctttttacctacattatctgatagtgagctggtttattagcagntacagctccgcaacaattactttatattgtattacacactaaccatgcctctcactttaaaatagtatggagcatatgtttctactttgaccatcaaggcatagaaataatactaccaagggtgcatccatttagtataaaatattatagatgcatagacttatgcgttaaggccctcgccagaaaagaattgttggatttcgtaagtgacgagcctggacatcttaaaaattacctgttaatgaaataaagccgtgatagctcgctgcaccaatgtattgatgttcgaattacgtggtccactttttgaccttcataaagtcaaaagagtcaccactctctaagaatttgagaccgcttaatcaatactttgtttaaatgtgcaagacattgaatgttttcctgaaaatgttgttcttgcccaattaataccattttttaccagtgttcgcgaactaaaagtatacttagcccaaaataacct

SEQ ID NO: 641016 - DNA, 301 bp, Homo sapiens
gtcgattcagacatatgaagcatacatatccaatcatcaggtgaccttgacaacgctgtagctttcattttcttctatgcaaccttatgaaaacccagcaggggtggcaggtcacacacggggccatatgtggatagacggacattgctgtctatccccccgaccgtgtgtgtgtgtgtgtgtgtgtgtgttgcgtgtgtgtgtgtacagcgtgtgtttatactatccctgtgtgacgggacacgtgtgtaccactactactgtacgcgacttgtacacccagaccggaaacacgacactg

SEQ ID NO: 641017 - DNA, 224 bp, Homo sapiens
aggacccggaagtgtgtggtgttatggttggcttcaatcagatcagtaattcctagagttaaaatcggagccaacgaatatcatcatttgtgtcatgccatacttttcaaaatacgaaaatacaggcatgtgactgaggcacagcaggcaacacaagagagctaaagccctcaatttgcccaaagctgtctggaacaagtactcatgcataacaccacacaatt

SEQ ID NO: 641018 - DNA, 326 bp, Homo sapiens
gacggaacacacttcccgacagcccctatcgtggtgcctgtggcttctccgtctggcgacgcccgccgcctcactgtttctagccttcaagagtcagggcaaaaggtcaaccagccatccccttttgcatgtcagcccgaccggggcccatcggggcaatcgatgccaacgtgctccgcccctcaggagccctggaggagtgctatgtcacagtaattgaccgacatacgtatgctgtgcgcttcatccctcgggatactggcgttcacctcatttacgtctagttcaacggcacccacctcccttgaagcccctccaagatccga

SEQ ID NO: 641019 - DNA, 323 bp, Homo sapiens
tgttttgccaccaagtttggttttttaaaaaagaagtctgggccgggcacggtggctcacgtctgtaatcccaaccaatttgggaggccgaggtgggtggatcacctgaggtaaggagttcgagaccagcttgaccaatatgggaaaccccgtctctactaaaaatacaaaaatttgccgggtgtgttagcaggcgcctgtagtcccaactactcaggaggctgagacagaagaatcacttgaacccgggaaggagaaagttgcagtgagccgagactgagtcactgcactccatcctgggtaaaagcagtgagtccgtctca

SEQ ID NO: 641020 - DNA, 796 bp, Homo sapiens
tgtactgaggctggtttaattggcacggaggggacccggctgcgttggttgtgctgggcgctgttgccttgttggtgcgcctttgcctggaggctgggaggccgcccccagccgctgctacccacgcatgagcctgggctggcttctgctggtggtgctgtgctgggcgtgcccgagccccgtggctgcagctcgtaaggggagccctgctggcgtcgctcgtgtgatgcttgctgtgctgcttggccctggtggggatgccctgtgggcttgtaccacacggctgcggtgttgcacctgcgcgcccagtgacctccatctgcatgatgcgctcatgcctgcgcatgctctccctgtccatgcctgccttgcagcttgaccctgtaccagtacaagacgtgtcccttctgcagcaaaggtccgagccttcctcgacttccattgccctgcactaccaggtggtggaggtgaaccctgtgcgcagggcttgaagatcaagttctcctcctacagacggtgcccatcttgcttgcccaggaagggagaaggctcgccaacaactacatgaatcctcctgtcgatcgatcagcgcctcaagacctacctggtgtcggggacggcacgctgcgaacgcatccctcacctactacccagcccatgagggctgtgcacgagccgcgccagcgagtgaccgagcttcggccctaggttctggctcatctcacggacacgagcccagccagtttgctgccgcgcccgagccggcatcctgccccttcgccaccctgtctccctc

SEQ ID NO: 641021 - DNA, 746 bp, Homo sapiens
ggccccaggagcccgttgggtacggcactcccgttcgtgccggtgcgtgcgccggcttgtggctgtgggatgaccagcggcggcctcctgggctcctttctcgcttcctgctgctagttctgctgcgtggtgacgcgtcagcacctgtgtcaattgcctgcctctcatcacgcgtgcgagcactctttctgttcgaactgcgctgtcttcagctttgagcctggttccttctcttgcacggccctgcacgtgctcaagccccgggaccgcatatcgtgccatcgcccaccgttgcggcagccacgacgcgcccgattaacactgctggacggtcacttcgcgcatagcatctaagcaagtggagcaaacacggcgtggatgtataggacattgatcttttacttctgacgcggacttccttgtcgttagattgcaactgataacgactaggtaggataggagacggacgtgactcggcgaccttgagacgagttggtgttcacttatgacgagtattgacacacaccgtttaccgaaagccatgaatccctgtaggcgcatagcgacggatagatcgaggaaatcgagtgttccccgtgattgaccaacgaatcccataggccatagacgggaaaagcttgtttgctgcaggtagcactagagcacatatggtctcagcaactccttcttgtgatcgttcaaagtgccattgcaccacggagggtacatgacggctctaaagagcc

SEQ ID NO: 641022 - DNA, 764 bp, Homo sapiens
agagagggggttagagagagagagagcgagacagacctatgggatctgagccggagtggatattcgcatgggatggaggctaccttggagcagcacttggaagactcaatgaagaaatcctccattggtgtagtactgtgcacagattcacaaggacttaatctgtgttgccgaggtaccctgacagatgagcatgctgtagtgatatctggtctagctcattaagcatctaagctaacctctgaccacactgatattcctgtcgtgtgcctataatcagataatgggaacattaatgatccagaaacacgatgtcatcacggtggcagatgacaaattggccttttgatgctcatatcttgttttcatgaggctgtcatagtaactggatcctacctaggctaattaccttatataactactaaagtttcagtaagtaggccaatgcatttaatgtgcattaggcacttttctgtttatttaagagtcaaattgttttctaatgctctatggaccgactatcacgatattactaagataggatcatgttttgaagcagctggtccacgtcaccttgtatatagaactctggctgcattaaatgaatcttgtttgtacactaaaaatcacttgtcttctcttccatgttgccgggttttcccatctatttcttaatcaactttatgataccggcctattttggctccattggccatctagccttaggggatgttttaatacatggccttctttcgttcctgtgt

SEQ ID NO: 641023 - DNA, 490 bp, Homo sapiens
ggatccctccgctctggtggaggaatgacagctgccgccgcgcaccgcagcgacccccgccgcagagtcccaccgccacatggcctcgggccagcggccagtgagctgcctcccccagggggggggggaacgagcggccgacgagcggggagagcggaggagagaccccggagcgctgcgcggacgcggcaggaagaggtgaggaggaaaggatgtggtgatgtagaggtcgcgggagagaggatggaggggagagagcgacagggaaggagaacaagtgacggtgtagaggtggactctagagaatatatgataacaagaagtacagaacagtgtgggagggatggagaacagatagaagggacggaagaagatacacaagacatggaggggagcgagtggatacggaacatcgtccgtgattagtgcaggcatagtaaaagaggacggcatcttgagactattgagacatagggagggaagcggagtt

SEQ ID NO: 641024 - DNA, 1645 bp, Homo sapiens
atttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaag

SEQ ID NO: 641025 - DNA, 691 bp, Homo sapiens
atttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaaatgtaattctttaaacccgtggagctaaagttgcacacttggttttaattttacatcaaagggggtttaagatgaaggatcaacctgagtgaagtccaccgtggtgcccccaccct

SEQ ID NO: 641026 - DNA, 289 bp, Homo sapiens
ccaatgatggcactgagcctggctagttttgtttttttgtatgtgacatttttagtgtaagcacatacacacacgcatgcatgcacgtacattcatactatcccccttctttgtttctttgtacgtattatatgtgcactttttccacctaacactgtcttgtggagatcaccggatggctagcctcctatttagataacctgcctgggaggcaggctggggtgccctgcagctgctttcagagtttgctgatcagagtctgaaactgcaggctatgcatgggtaacag

SEQ ID NO: 641027 - DNA, 1132 bp, Homo sapiens
tgctgcagctgtgaggccaacaagaaagatcgagaagcagcatgcatgaagtgacacatgcatgtgtctacctggtgccacgcacctgccatgctgctgctggtgtgctggagaatctggtaaaagcaccattgtgaagcagatgagtgatcctgcatgttaatgtgtgtttaatggagagtggcggcgaagaggaccctgcaggctgcaatggagcaacagcgatggtgagaatggcaaccaaatgtgcagtgacatcaaaaacaacctgaaagaggcgatttgaaaccattgtggcctgcatgagcaacctggtgcccacaccgtggagctggccaaaccccagagaaccagttcagagtggactacatccatgagtgtgatgaaatgtgccttgactattgacttccctcccgaattctatgagcatgccaaggctctgatgggaggatgaatggagtgcgtgcctgctacgaacgctccaacgagtaccagctgattgactgtgaccaggtaccttcctggacaagatcgacgatgatcaagcaggctgactaatgttccgaggcgatacaaggacctgccatcagactgacctgtgtacttgagtatctggaaatactaagaggaccaagtaccacggtggacacacagtcaacttccacatgtatgacagtgggtggacaagcgcgactgaacgccgccacagaggactccggtgcaatcacgaaatgtactgcgaacatcatcaagtgaggcaacaggaaatacaccaaggaaccacaggtagagcaaaccagaacaatgcgccagcaggagacacgaaatcttaagcacgaaatggcaacaacagaggcaggaacagaaatgggcaatgagcctaaagagcaaacggaagcgaaaaagcagcagagagtacacagataggcgaaaagtagagaaagagcaaccataaagaggacgtacagaaccggccgcaaaagagagagaaagagaagacgagaagacgagaacgagagaggacaaggaaggagggaaagaagggctaaggcgaacacgcagccgagtgcagagaaacgaatagagtagaaaataagagaatataaaaagcgccacgagaaagtagcgaaaa

SEQ ID NO: 641028 - DNA, 130 bp, Homo sapiens
aagtctgagaaggtgaagggggggctgcactgagccacaggaacaatgatggagattcagctaagcccagaccccgtggattctagaagtagattttagaggcagcagacagaattactgaggaattgag

SEQ ID NO: 641029 - DNA, 775 bp, Homo sapiens
  misc_feature (14)..(14): n is a, c, g, or t
  misc_feature (100)..(100): n is a, c, g, or t
  misc_feature (103)..(103): n is a, c, g, or t
  misc_feature (148)..(148): n is a, c, g, or t
  misc_feature (160)..(160): n is a, c, g, or t
  misc_feature (163)..(163): n is a, c, g, or t
  misc_feature (170)..(170): n is a, c, g, or t
  misc_feature (177)..(177): n is a, c, g, or t
  misc_feature (186)..(186): n is a, c, g, or t
  misc_feature (188)..(188): n is a, c, g, or t
  misc_feature (200)..(200): n is a, c, g, or t
  misc_feature (209)..(209): n is a, c, g, or t
  misc_feature (211)..(211): n is a, c, g, or t
  misc_feature (214)..(215): n is a, c, g, or t
  misc_feature (217)..(217): n is a, c, g, or t
  misc_feature (235)..(235): n is a, c, g, or t
  misc_feature (253)..(253): n is a, c, g, or t
  misc_feature (257)..(257): n is a, c, g, or t
  misc_feature (263)..(263): n is a, c, g, or t
  misc_feature (267)..(267): n is a, c, g, or t
  misc_feature (279)..(280): n is a, c, g, or t
  misc_feature (282)..(282): n is a, c, g, or t
  misc_feature (284)..(285): n is a, c, g, or t
  misc_feature (319)..(319): n is a, c, g, or t
  misc_feature (322)..(322): n is a, c, g, or t
  misc_feature (325)..(325): n is a, c, g, or t
  misc_feature (330)..(330): n is a, c, g, or t
  misc_feature (333)..(333): n is a, c, g, or t
  misc_feature (335)..(335): n is a, c, g, or t
  misc_feature (338)..(338): n is a, c, g, or t
  misc_feature (341)..(341): n is a, c, g, or t
  misc_feature (346)..(346): n is a, c, g, or t
  misc_feature (353)..(353): n is a, c, g, or t
  misc_feature (368)..(368): n is a, c, g, or t
  misc_feature (383)..(383): n is a, c, g, or t
  misc_feature (388)..(388): n is a, c, g, or t
  misc_feature (393)..(393): n is a, c, g, or t
  misc_feature (396)..(396): n is a, c, g, or t
  misc_feature (402)..(402): n is a, c, g, or t
  misc_feature (411)..(411): n is a, c, g, or t
  misc_feature (416)..(416): n is a, c, g, or t
  misc_feature (418)..(418): n is a, c, g, or t
  misc_feature (428)..(428): n is a, c, g, or t
  misc_feature (433)..(433): n is a, c, g, or t
  misc_feature (438)..(438): n is a, c, g, or t
  misc_feature (489)..(489): n is a, c, g, or t
  misc_feature (506)..(506): n is a, c, g, or t
  misc_feature (547)..(547): n is a, c, g, or t
  misc_feature (553)..(553): n is a, c, g, or t
  misc_feature (559)..(559): n is a, c, g, or t
  misc_feature (565)..(565): n is a, c, g, or t
  misc_feature (675)..(675): n is a, c, g, or t
  misc_feature (769)..(769): n is a, c, g, or t
tggggggggatagngaagcaactcatttattctgaaaacaagaaaataaggggaaagaaacaaagtattttattctaactttcctatacaaattgtaccnccncatataaaataactgaggagcaaaaacaaatttttcagaattccngcaataaatgcnganggggggnggggggngggggcccncncctgtaatcccngccctttgngnggnngnggggggggggtcacttgngcccaggggtttgagacnagcntgggcnacanagggaaaccccnncncnncaacaaatacaaaaaaattatctgggcatggggntgngcncctgnggngntgngcncctgngatcccngccacttagggggcnggggggggggggtcncttgngcccnggngagggnagttgcagngagcngngatcatgccnctgcnttccngcctgggggacagagtgagactctgtctcaaaaaaaataagtacagaaggnataatatccccattacncagcccttaaacaacgggtttgggggataatcatcaatacnaccccnaaaccnttaggngaaaagctgacagggaactttataatggaaagttccgactagcaacatagcacatgtacagaagaagagaggatatcctacctgcttgaaaattcttttctttacagggnggaaaggtcaattagaaatacaaagggaagaagaaattcaccagtttacaccataactactcttttacattaaccactgttgtagatgaaagtntgcagt

SEQ ID NO: 641030 - DNA, 586 bp, Homo sapiens
  misc_feature (492)..(492): n is a, c, g, or t
tcaggcgactgtacactggctttatcttctcagctgccctgaaggtgatttcatttgagccagccccacactgagggttccgttactcaaacaagtttgcagaagcagcccaggagtcttgggctggctcaaatgagccccttgttttcatttccttatcaaccatcttgtgtacagtaggtgcatcaaggtcccaaaggccaaagcgtcccaaataatgctagactcattgcttaccatggaccaaagggaacataaaaggaaactgttaaaaataagctttgggaatgtttttaggaaaaggatatattttggctttagctagaagtttagtatttgctatggagataagatatgccagactttcactcagtaaacactgactgagcactaattaagaactgtgagatatgcaggcacgacagacatggcttctgctctggggcacccagcctggcacatggatgaatgaccatgactggcttaactgangacgtgacaggggtctgtacacatcctttggaaccctggggctttgcaggagctctgcggaataacggatattggtgaagactgtctttagttg

SEQ ID NO: 641031 - DNA, 122 bp, Homo sapiens
cacgaggtggaacgccacagggcactagagctactggcatcccggtagacgctcaaggtgcgaccctcgaagtctaaaccaacactgcgggtcgatgaagctcaactgttcaatacaacaca

SEQ ID NO: 641032 - DNA, 84 bp, Homo sapiens
  misc_feature (52)..(52): n is a, c, g, or t
  misc_feature (76)..(76): n is a, c, g, or t
gtttttttttgttttgctaccatttatttgctgtatggtatgtactcaaggnatgagtcagggcttctgtactacnctctgatc

SEQ ID NO: 641033 - DNA, 823 bp, Homo sapiens
ccattctggatcagtggctttcagaagcctggtgggagaagtgaggtattcctaaaagattggcaaggacagggtctccttgaccccttgccacaactgggaacacacttgaaagggggaccccaggccagctgttaacagcggcgttcactgggagccacccactggcgttctcccacaagcccgtgatgcgctgacattcccttagcaccagttgtcccacactcgcagggtcctgaccaggtcagagatgtccccggccattgcagagccaggaagccatcaagcggggccgtggaggtgctcccgtggctccagacccgtgccaggggacaggttttctcccgtggaatacttctgaggcccacgcgcagaactctgtagccagttcagaggaggaggaaaagggagcccccttcagcagaacggggtgccagtatcgcgcctcagaagctggcaccaccgtggggcttccaacgcccagaaatagtgccgtgacagggccctataaggctttccaggggcccggggcccgcgtgggagagaccaccccatacccttcaccaccgcacacacaattaaacacaaagcttgggcctctgggattcccgagtctctatgtggattgggcccccaatctcagggggaccccttaggatggtcatccacgtacacttaccaaaaggcatcccccaacaggggccaacccgtgggggcaaaagggtcagtggtctaggaggcccccccaaacattgcccagggcaccattgcgcccacacagcccgggtggtgacccaaatggacacacaccctgggactccca

SEQ ID NO: 641034 - DNA, 188 bp, Homo sapiens
atcatccaggatcttatctacttgcgaaaaatcacagtggcactgctaacatcattgcagcacctttactccttcggctgtgatccaatctccagctcactttttgccagcaactaacattgtgctttgcagtccccctgactttcttcattctgttcttgcgtacctttcgttggggtaccgagctc

SEQ ID NO: 641035 - DNA, 102 bp, Homo sapiens
  misc_feature (1)..(1): n is a, c, g, or t
ngttttagtttccatgttccatccacagccagtgttcattctcccaggcagcacatcatcagcagcagctccaacgggccacatctccagggtgccatttca

SEQ ID NO: 641036 - DNA, 158 bp, Homo sapiens
tcaagcttctaacgatgcacggggacatggtggtacatacctgttagtcttagctactcgggaggctgaggcaggaggactgattgatcccaggagttcaaggctgcagtaagctgtgcctgggtgacagagcaagaccctgtctctcaagaaaaaaa

SEQ ID NO: 641037 - DNA, 367 bp, Homo sapiens
agcggatcccttacccgtacgcccaaaaaagatgggtaataggaatttttttttaaagacagatttttgttctgtcactgcaggctggagtgcagtggcatgatcatagctcactgtaacctcgaacttctgggctcaagggagcctcctgcctcagcctcctgaatagccgggactgcaggcatgtgccactatgccctgctattttttttttaattttggtagagacgaggtcttgctatgttgcctcaaactagaggctaatcttgaactcctgacctcaagtgatctgcccatcttggtctcccaaagtgttggggttacaggcgtgagcccctgcgttggggcgtacggggagggtaccgag

SEQ ID NO: 641038 - DNA, 102 bp, Homo sapiens
taggtttggtctagaggtgtagcctagagaataggggaaatcagtagaatgaagcctcctataatggacaactacagctcctattgatcaggaccatagtag

SEQ ID NO: 641039 - DNA, 159 bp, Homo sapiens
cctcataggcacaagtcatagtcgtctcccaggaccctggctagcccctgcagaagctcccgacttcctcttcttggagcgaagccggaacttctgccaccagccctttagcttcgggatgaggacctcctgcatgtggttgatgacctgcttgccaag

SEQ ID NO: 641040 - DNA, 126 bp, Homo sapiens
ttactatacaattcagctcggtaccctcgaatagacagcacagcaaaaatgggactcagagtggatcaaacatgatttagagcttgtttatggaaaagtgcttatttctgcatttcaatgtttcaa

SEQ ID NO: 641041 - DNA, 114 bp, Homo sapiens
ctgtggcggagctgaggacgagaatagtctgcacctgggaggtggaagttgcaatgcagccaagatcacctcattacactccagcctgagcgacagagcgagaccgtctcaaac

SEQ ID NO: 641042 - DNA, 238 bp, Homo sapiens
ccttggccataatatgatttatctccacactagcagagaccaaccgaacccccttcgaccttgccgaaggggagtccgactagtctcaggcttcaacatcggaatacgccgcagcccctttcgccctattttttattagccgagtacacaaacattttttttattaacaccctcaccactacaattttcctagggacaaccatatggcggggctcttcccctgaacctctaccaaaac

SEQ ID NO: 641043 - DNA, 390 bp, Homo sapiens
agcggggaacatcacttcagttcggctcacaggaagccacatccataggaaacggaggagcatactacatcaatgggaacaccccgtgggacaaaagaatctgaacaacagtcttcacccctagaccttccctctgacagagcctacccaaatgagaaggaaccagaaaaccaaccctggtaatatgacaaaacaaggctcttcaacacccccccaaaatttctctagttcaccagcaatagatccaaaccaagaagaaatccctgatttacctgacaaagaattcaggaggttagatattaagctaatcagggagggaccagagaaaggtgaagcccagtgcaaggaaatccaaaaaatgatataagaagtgacgggagacatattcaa

SEQ ID NO: 641044 - DNA, 404 bp, Homo sapiens
ccccgggttgggttttgttggcccattaccggtcttttgctccccaattcccccgggcttagcaatccttccccccttttggttggggttccgcttccccccccccttggttaaaatttttttttttttgggcgggttttttttttttccccgggttgttttcgggtttttgggtccggttgtcccccttcccttggttcccaaggccccggcccagtttttggttttttcccttccctttttgccccccagggggttttttcccttttatggaatggcctttctaaaatgggtttttttgtgggccaatttttttagcttggaaatttaaattccccctggaatttttttttttgccggttcccttgaatttttttccccttaagggttgtttttgggttcca

SEQ ID NO: 641045 - DNA, 257 bp, Homo sapiens
ccaggttcaagcaattatcttgcttcagcctcccgagtagctgggactacaggtgagcatcatcatgcccggctggtctcgaactcctgacctcaagtgatttgcctgacttggcctcccaaaatcctgggcttataggcgtaagccactgtgtctggccagaataccaggatttttgatggtacacttgaagaaacgaaaagatccaaaacaataccagaaaagtcatcaatactactcactttcctagattcact

SEQ ID NO: 641046 - DNA, 108 bp, Homo sapiens
ggaatcgtggtgctgctgggacttcgtggtgctgctgttacggctcatcttcatgattgcctgcgcttcttattgcccccacagcggaatcttctgctgaggaggatg

SEQ ID NO: 641047 - DNA, 344 bp, Homo sapiens
tggcgactctgcacagcgacacctttatgtaccacgtctggagtaagtccctgctgatgtacggatgtagtccgcgcaatttcttccttctggtgcgtacgtggtctcgctggctcaggagtgaagctgcagaccttcacagtgagtgtaacagctcttaaggcagcgcgtccggagttgttcgttcctcccggtgggctacgtggtctcactggcttcaggagtgaagctgcagaccttcgtggtagagtgtcacagctcataaaagcagcgtgcacccaaagagtgagcagtagcaagatttattgcaaagagcgaaagaacaaagcttccacagtgtgaaa

SEQ ID NO: 641048 - DNA, 455 bp, Homo sapiens
ctatctccagccatctataattcagatcagttcaatagctatagttatgtatactctatttcctcctgtatttggaacacacgcaggtgtgtacctatctccagccatctataattcagatcagttcaataactacagttatgtacgctactttctcacttcatgtattataagtatttctaaaatctcctgtaatcccagcactttgggaggccgaggcgggcggatcatgaggtcaggagatcgagaccatcctggctaacacggtgaaaccacgtctctactaaaaatacaaaaattagccgggcgtggtggcaggcgcctgtagtcccagctacccgggaggctgaggcagaagaatggcgtgaacccgggaggcggtgcttgcagtgagctgagatcgcacccctgcactccagcctgggcgacagagtgagaccctgtcttggggaaaa

SEQ ID NO: 641049 - DNA, 900 bp, Homo sapiens
  misc_feature (11)..(11): n is a, c, g, or t
  misc_feature (58)..(58): n is a, c, g, or t
  misc_feature (66)..(66): n is a, c, g, or t
  misc_feature (152)..(153): n is a, c, g, or t
  misc_feature (176)..(176): n is a, c, g, or t
  misc_feature (178)..(178): n is a, c, g, or t
  misc_feature (187)..(187): n is a, c, g, or t
  misc_feature (206)..(206): n is a, c, g, or t
  misc_feature (274)..(274): n is a, c, g, or t
  misc_feature (299)..(299): n is a, c, g, or t
  misc_feature (301)..(302): n is a, c, g, or t
  misc_feature (514)..(514): n is a, c, g, or t
  misc_feature (535)..(535): n is a, c, g, or t
gcggcgcccangtcctaattcgggaaacgtgcaccttgactaattcggttttctgtgngctacgangagcaggcttggctgggcggaggcgccagcggatgtctcatgcaaggatcgtctctgtggctaagcctcactttccgctccgcccnngtgtgctctctagagcccggttntntcgagtgtncagtctccatgggctgccngaatacagcatgcgatggagaacggcaccggtgccctacggagaagaacgtccactgtgaagtccagnagacgacagtcaccgagggggctgncnnaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggacaaggttgaactgaaagagagtgaanacctggcctcaggagaccaanctcgcacagcggccgtgggggagatctgtgaggaaggcctgcattgttgctggaaggcctggcagcttcaggcctacgtttccattcgatttgccctagaggtgcctgggctcagatctgtggttgcaaacgatgcctccacccgggctgtggaatctcatacgccgggaatgtccagctcaatgactgttggccactggtacagccgagccaagcagattgcccggattgctgatgtaccagcaccagaggggtgtcggagaaggtttgacgtcatcgatctggacccctatggcaagcccagcacctttcctgtgatgcagtggtgcaggctgttagtgaatgacagggtgctgtgtgttacc

SEQ ID NO: 641050 - DNA, 681 bp, Homo sapiens
ggatcactggagctcaggaattcaaggccagcttgggcaacatggcaaaacctggtctctacaaaaaatacaaaaattagctgggcatgggggcatgcacctgtagtcccagctactcaggaggctgaggtagaagaatctcttgagcctgggagactgaggctgcagtgagccatgatcaggccactgcactccagcctgggtaacagagtgagatcctgtctctaaacaaataaattccaacaaaagtatcattaggtcccacttttcaattccccggatccggtggcaatggctcgagggcttcatcataattatttcccagaagtcctttccaagaagacacaagtatatggatcagaaataagaatcctctcatgagtggtaaccactggcaaaagtcaaaaccaaatgggctaaaatgagtaaccaaattgggtttactctttcagacgacacaacaactgcaatattctcaaaatgtccacgggtagcccattgcccgtacatcagtaaaaaactttagaatagtacgttaatcacgctactaaaccggttacccaaatcaaacgcaccagtaagattcctggggtatggtgtacaaacaacaggattgcgaacagtaacttcctaaaggatcatctacttagattcaaggattggcaggattaattctaacag

SEQ ID NO: 641051 - DNA, 167 bp, Homo sapiens
  misc_feature (34)..(34): n is a, c, g, or t
  misc_feature (42)..(42): n is a, c, g, or t
  misc_feature (49)..(49): n is a, c, g, or t
  misc_feature (51)..(52): n is a, c, g, or t
  misc_feature (64)..(64): n is a, c, g, or t
  misc_feature (71)..(71): n is a, c, g, or t
  misc_feature (103)..(103): n is a, c, g, or t
taagctccactgctggcctcaagtgatctcctgnctcagccncctgagnanntgggattacagngccaccnccacaccgggctcaattatcattgtttacttngtagtttgtttaccgtttgaggtctctcttttccatgagggcagggaccttgggcgtacgggga

SEQ ID NO: 641052 - DNA, 560 bp, Homo sapiens
tcagcaggtaagccttgttgtgatcttggctcactgcgacctccaccttccagttttaagtttttttgacccggggggggaaaaatttgttttaaaaaaaaagtgccccaccaaagaggggtgagtgcttgtataaatgcaaaaaaagcgcctctacgtcttgggcctgctgacctggggacacctcccctttggaaaccttcaggccaaaacctcccacaaagatataaagtcgttactttgggaagaaaatcctttctttaagaaacggccgtgtaaacctccaaagcttcctccttggtggggggggccacctgagctacacaggggaattccctggccccaaaaaaaacaggggggggggcccaaaacttaaaaatcccctttttggccgggtggggggaaaaaacctgttaccccctttttttggagcccccggccaaaattattttacccccttttttaaaaatcccgccgtgcgaatatgggccaccccctctcccacaaaaggggaacccggggatccccccccctttttcttttagccaaaaacaaatttt

SEQ ID NO: 641053 - DNA, 296 bp, Homo sapiens
agagtcccagaagcgtgtatcggcttcctggaagaagagggccaatcagtgtgtgatggcctcctgtaggtaagagtggcccagcattctgtgagggcttcctggaggaatagggcccaataaagtttgacggcttcctggaggaagaggatgttcatgagctacgattcacagcagggactgtgcaggaaatcttgtaaacttgaatctcaattctctgacctaaattaagcagaatgcaccatcatccaccggtgacacctgagcgtgtaatgggcctctgctgggtaccgagc

SEQ ID NO: 641054 - DNA, 447 bp, Homo sapiens
  misc_feature (435)..(435): n is a, c, g, or t
ggccgcgatatccacacacgagaaccaacctttattttattgagaggtaccccctcttcctcctatactcgagcgggcggaatttaaccaaacgggcctgtccgcctataaatcagatatattaatattacggaacacatactgttgtctcgcttaacctgggcatgtcgatgcccaggcgcagcgatgcataaccggaaacacaacatcacattttgatagatacttactgcaaactgggtagaaaaacctttcaggggagaaccctatcctccttttttacacggaactggattcccgtcttttggactaagtcaagcccccagcatggaaggatgaaattgtctgggagagacaagggacttcggccaaaaaggatttttttcgagcccgtcaaaatgagaggttcttatctaaagggatactcataggatngaaggcacaacg

SEQ ID NO: 641055 - DNA, 352 bp, Homo sapiens
gctcgactttattatttttttttttgagatggagtctcgctctgttgcccaggctggagtgcagtggcgcgatcttggctcactgcaaactccgcctcccgggttcacgccattctcctgcctcagcctcccgagtagctgggaccacaggtgcccaccaccacgcccgcctaattttgtttttttttgtatttttagtagagacggggtttcaccgtgttagccaggatggtctcgatctcctgaccttgtgatccgcctgcctctgcctcccaaagtgctgggattgcaggcgtgacgaccgcgctcggcccttcaaagttttattaatatattttctaaaaagtcgacg

SEQ ID NO: 641056 - DNA, 283 bp, Homo sapiens
taaattccccccccctcccttaaaggaaatgggccttcccgaaaatagatggggttatagtttttaaccaatttttatttaaccccatgattgctgaaaacccgggaggcctttgttataaaggataacccctcgtttcccggatgttttagttggccggttcaaccctaaatggggaaaaacaaattccccgttaatttttaaaacagtgaaaaatttcctgccctttggggggccttttttaagggccttttttatccccaaaaaaattttttttctttta

SEQ ID NO: 641057 - DNA, 363 bp, Homo sapiens
taatttttactaggtctctgcttccgtacctgtagaggtcaatattgttaagatacaaaatacatggtaccaaggcatactagaaaaactttaaaaattggttatttggatttggcctacccacttgattgttatctgtaaacgatgttgatatgatttggaatttgactatgcattcaaaacaatgtttttgtcaaatgggttgggtcattctagagaaagaaagaaaaaaaacagacattaacaattagtcatgaggctggtctggaaatcctgggctcaagtgatcctcccaccctggcttcccaaagcccaaagtgctgggattacaggcgtgagaaaagcatttacatttaaaaaaaa

SEQ ID NO: 641058 - DNA, 206 bp, Homo sapiens
  misc_feature (78)..(78): n is a, c, g, or t
cagaatcagacaggtatgagctagtcacagcaagtctttgttggattcgagtagctcaggatctgctgaaggtcgganagttagtccccgcatcacgagcctgtcttcactgaagcccttagtgatatttagacactcagccgagaatgagaatgcattcttcagattctctatatgccgaacatggaacccatccacgccagtcc

SEQ ID NO: 641059 - DNA, 665 bp, Homo sapiens
tatttttcccaggtatttatttacctgggttgacaagttcatcttcaggcaagtagggaaggtgttccttggtagaaacaagtgttggctaaagcaaggtgaataacgccaatacacaatggtgggcagagatcccagcctcacagaaggggccagggaagctctcagttaaattcactgagatcttattgatggggaggatggaagccacctcagcttccctgccaggccagcaggaaagcaatctacctcccaggcacactcttgacccagagttctggctattcagaccagacaggcacctattttcatctgcagaaatgttgatgttccaagtagagaggaattgtgaccctatctcccatgcaagcctgaacctgaagagtgctcctcctgtgtgaatgcagtcaccttaaagtgttccagaaaggctgtctatatgtgcacccatcctgagtgcccatgggagaaccctcagctatgtctgcagtggtggatgggggaaaaataagtccccttctccaagattcttcaggagtaccaggactgcctgactgttggagtagagctgcagactttccccactgagcccagcactacactgtgcctctgctgaaaggaacttcccaccaatggaaagatttaggactcaaggccttccatcc

SEQ ID NO: 641060 - DNA, 586 bp, Homo sapiens
atgcaaagaattcacacctgtgtcccactgtgaatctaggggcctttcatgtagaggaaccacaccaggagttctaggctgtgacctgcaggcaagtgagtggcccaaggcagaatggaagtcagtgtcaagcagaagacttgagggaaaggcatgagacaaaccttgcctcccatcccacttcttcaaatatactcaagaaaagtaacccttaaaatggaggaaaatgctgacacctggattttatatacattatctcacttaacacaaaaacctcaagagtaggcattagccccattttacaaataaggaaatgatggcttaaagaggctaatttgcccaacattatataccagtaagtgaccatgccgagatctcaacctgtatctgtgggtctgacctgatcacatctcccactttttcctatggaaatggaggtggctgtagacattggcagtcacggcagtccatatgctgcctgtcgatagctgggacgtttgttattctctattctacggaactttgtattgtttagtgctttcaagcgtatattgcttttgtattccacagaaataataaagatatc

SEQ ID NO: 641061 - DNA, 113 bp, Homo sapiens
tccggtgttatgatgcacactgctggccctgagagtctctacaaggtgcatagacctgtgtctgtatagccaagtcccacattctcagagtgcctcacagcatggtagaaatg

SEQ ID NO: 641062 - DNA, 599 bp, Homo sapiens
  misc_feature (38)..(38): n is a, c, g, or t
aaaagtgacaacttcgtcaacaagcagacgaggccggncttcccccccctcattggggcctccgcctttggagagattgagcccgttcgcttcctgctggagtggggtgccgaccccaccatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggaccgaggcgctgacctcaccactgaagccgactctggatacaccccgatggaccttgccatggcctgtggataccggaaagtgcaacaggtgatcgaaacccacatcgtcaagattttccaaagcaagctggtgcccggtgcccctgagtgaaggccgcaggctggggagtcagacactcaaggaacaaaatggtcagccacagctggggaaacccaaacctgacttcaaaggcagcttgtgaacaggtggtgggaggggacccttcccaataggaaccaatgaaccttctgggcataaaa

SEQ ID NO: 641063 - DNA, 189 bp, Homo sapiens
taaaaagcccaattccacctctgatcattgctatacctttgagatggtatttctggaggaaccaggggaatcaggtgagaggcaggctctgtatttatttatacaactatgctcagatctcgctaagaagagcctcatgttctatctctatcctcctgagatggagatcaaagatggtgctcagacccc

SEQ ID NO: 641064 - DNA, 137 bp, Homo sapiens
agaattggcattgctgtccttttttctgtgactgtgatgtattgctgcttttactgcttgaagctggctcgtccttggctgacaccttctgtttcttgttcatccctgagtaaccaaatgatatgcttgacattgga

SEQ ID NO: 641065 - DNA, 882 bp, Homo sapiens
aacgaataacgtctgttgcctctttacattagatatgaagcctagcagtcttgtctaaaaccagtatttgtgtggtcatgttataacgctaccttgtgctcgatgcgcgcgccaaaagtgcacgcatttacctgttgacattcagcatcttccgagagcactgatggtgatagagagagatacagaaccctagcgaactattgttatcgccggccgattaactgactctacatgtagaccttctctagcttatgctggatgtttcgacaccagaggatactttgacttagttatgtgcaagaatagaaggattcttaatctccattactttgagaataggttcactaatacatgtaacataaacttgccatttgtgccttctgttctctatcgagtaactgtttattcctaggagttaacagtgacagaaatccctgagtgcggaagtagatttctccatatgagaagagtactgattctctcccaaactggtagctttttgctgctgatccattgccgttctatcctgattgacttactgagtttcttacagaacaaattgtcagctgtaaggtggttatcgcatgttagaattctcagacgtaatgattcgacactggggaagggcatccctagtgtattggccatgtctagccccacggaaacatccttgttcttgcctaaaggtttcccctttcccccgaaggtatgagagaggcttggcttataagtctggaacgagtctagagtgagagatagaatatagccaggtggggtgatgttcgtagcgttagagaaatgccctttgcgtgccaggacatatcttgggtgggaccccgtattccttggtttccaagtatgccagtttgtggaccattaaag

SEQ ID NO: 641066 - DNA, 316 bp, Homo sapiens
tagcaacactaggaaggctccccaggttggggagagccccaagattgagaacaataatgaacaattattgtatgaacaattgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgaccttctttacctacaactatcttgataaatggctttaccacctgcaaaactgaccctagg

SEQ ID NO: 641067 - DNA, 1571 bp, Homo sapiens
agcggagtctgactgcagtgtgcccgacatggcgagtgtacgtgctgctgagctggcatcccagtgtgctgcgctggcagcgtgcgagcggctggggccatctcggggctccgtgcgtccggctttgctcggtgttgctacttactccgacgcgcgtgaactgatcccccacatggttgaattgcgcgagcaatcgtgttatcactgacacagacggtgacagttgatccgaagcgagagagcgtttgcagacaactccagttggccaacgcgttcacactacacggagttggagccgacatcataggtgactgccagggctacctcgacactccctaaggcatgggccaggaaccaagtgtctactatgccccaaggggtggagctttccaggctgcccctatttgagacgggcacgaggccgacgcggttgtcaacaatttgtgcgttcgcaaatttgtcctacgtaagccaacgttggaaacacgttccacaacaaggttagttcattttgcagcagaaaacggtttcctacaaagaaagtctgcctgggacttgacgacggggcaacggaaattacacctttttctgggacaccaaacgcctttccgttaattaggccctggaatttcccacccccaaactaaggtgcaacaggtgtcttaacgagcaccgagcacgaattccaacgcaagactctcgctagggggtcctcacaacacccaaactgggttttacaattccgctgggaacttgcactttccggaacgttacatcgcccacgggaaacacaggcaagcaagtcgtggccgtcggttgcaggaacaaagcggcgttgacagagcgtcgacggcaacttgttgccacacacttttgcaaaagtttatggccgagcctttgatcttacagtgtagtctccccatgttcacattgtcacgaagggcgcaaaccgcaacgcgtttaattccgcagctgcctgtgggttccccacagcaatgtgctggcaaaaaccgaacaaaggcaaatggccatctacaacacgaccggcgtgcccatagaaaaatccggagacaagcggtgactgcaccacacccaaccgactgtggtgaacgctagtaacccgagtttgcttatcaccaccgttggttgggtcagaccccagatgactcacagctcccttgtgcaattgctcactgtgctacagacgggtgcatgtcccaaccacacacagttgcaacgagacaccaaactgggagggaagatccccccgagatccaatgtacattatcctatgtgcccaaagtgacagcgaggacacgcccacccagcccacattgcactgtgggcacgccaccctgttgtcaataaacaccgcttggacctagcaaacccgcaccaatgccagtgtcgatacatttgttgacgcacacgctcacgacgggtaaatcataaagcggcacgtgagccaggtttctacacacgcattaccccagtgattcgaacatactacatcgcagtacctacagaaacagggtgcacatgatagcgcacaccgtggtgacgacacaggg

SEQ ID NO: 641068 - DNA, 318 bp, Homo sapiens
gagtcagtatctactattacaagtactatgttcggtgctaggaaaaactgttacataattgtttttaattagaattactttttagtttgtcaaaaattctgtaaaatgtgtatctctaccatgattaatagtgacattccttaaacaacaaaaaacatgccgaataaaataatctacccataagatcattgccaaaggagtcaggaatctagcaacatttggtgctcttaccttgtggacaaagtcaaagtgtatctcacaattggtaatcatcacaaggtactgaatgcgatccgggaatccatctaaagtcgacct

SEQ ID NO: 641069 - DNA, 1657 bp, Homo sapiens
  misc_feature (751)..(751): n is a, c, g, or t
taagaccctcatcaatagatggagacatacagaaatagtcaaaccacatctacaaaatgccagtatcaggcgggggtcttcgaagccaaaggtgagtgtttgggattgttaaaggtgaaaatattagtgtggcggagtgaagcagattaggtgaggaaagtttgacccaataagtgacggtgaagctccggtggaagccgtggtggctacaaaaaagtgttgagccgtaaattgccgctcggaacaagtgggtgagagggagaactctcgaaagtatacctcgtgagaggcttgtgttaggagagggctaacaattaaaagacaacccagttaacaatgtggtcaattaacgcaggtgcttgtgaaatttatttggggttctcggagtgtggtatttctatatatataagacatatgtgtgtgtgacgcctccaggggtgattgtgatatactctcctgtggagtgcgagagtataaataacgggaagtgtgtgttaacagagaggtggagcacttctataagggggattttaacgcgggaggggtgagtgcccgtgtgtgggcggcgccacggtgcccccctcccataaaatgtggagaaggcatagaggggccatagagccgtgggcacgtgtggcctaacagagggggctccagcaaaaaactccgtggcgcaaagcaaacacacaaaaacctctcgtgaaaggcgtacatacacacactcagagaatctaataccccggtaatatcngaacaaagcgcactatatatatgggcaccagacgggggggggtccaaaaaaaacaccccaaaaattggtgcgcgcgaataggaccgcccggtgtcgacaacgcggggggggggggcccccctgtgggtgtgccccccttggggtgggggccccttgtggagtcattcggcgggcgaaaccccgaaggggggggagactacaccccgacagagaaaagattctaccgcagccccagtggggcgcaatactccggaggcgacccacgaagggatccagcagggctcagttaggcaccactgatggtgcctcgtgcggcggctcccaaaagtggcccacgggggaaaaccctccgcgggagagggcacaacaggccacaagggagacacaaacgcgaagcagtggggaatatggcccggataacaccacaaaacatttgcgcgccgcgttgagggcaacacagggaacatgtgatcaaagacacaaagctcccgtggagaggaagaaaaaacataacaccatattcatcccgcggcgaccaataagaaaggagaccgacgagcaccactgaactaacatccggagggggggcccccacaaagaagagagagggtatgcaagaaaaatatcgtcgaggcacagaacaacacaccgcacggtcacgacacaccaacacgatgaacgaacgaaatttgtagactaacggtagaaaaacacacgccgcacgagacggtaatagagatcaacacaagtagaagcagacaaacagaaggaagaatcaaaggaacaaaccacagcgagacgagatgaggaagagataacaccacaacgaaagagcaggcaagagagaccaaagcacaaccagcagacagcaactagatacacgtagtgaaggacacacccacacaa

SEQ ID NO: 641070 - DNA, 251 bp, Homo sapiens
tctgcaggatctccaataaattgttggtcattgatgtattcatcgtcaaagcgccgtataagctgcggatcaaacaggtcgtgccttgcggctcgatggaccaatccgcttttgccgcagctgcttccaatgctccgctcgtgatgtaccggtaattatcgtctaccgagacgtaatgaccggttacgcgattgcggatgcggtacgatccgttatcttcttcaagcagatcaatgaccaacaatttattg

SEQ ID NO: 641071 - DNA, 459 bp, Homo sapiens
catgatggcgcgctatattcccagctactcggaaggctgaggcatgagaatcgcttgagctggggaggcagaggttgcaatgaagctgagatcaccgccactgcattccaagcttggactacagagggcctccacctcaaaaaaaaaaaaaaaaaaaaaaaaaaaatttttgggggcgccgccttggcgcctgggaaaaatgtttttataaccctttctcgtgggggcgcggcggggcacccagtagggtgtatgtccgcaccctgggccccttaacacggttcccaaagggaaacatcgcgggccagagaatagaggtgctgtggttttctcccaccaaataaaaaaggccgcggggaacccgcacgtttgtggaacaaatcccgagaggagtccgggaggacctaacggatcttaccaaggggtccaaggggagcgattcaataccgcctgtgggaa

SEQ ID NO: 641072 - DNA, 720 bp, Homo sapiens
gggcagtttactgagaggtgctttacgtgtgcaccgtgcatctttcagcagctcccctcctgtcctcacctggtcttttccctctttatcccaagcctttatgcttgagtcccttccccaggggctgcccacccgacagttccaggcattccctacctgaccttcttgtctgcttttccttctcccactgcaagcggctgcttgtggcggcctgggatgacgtcccgtctactgtccctcatccggtgcctctcgttgccgaagccattcctgtggtgacgttcgagtgcctgacgggagaccacaacattcgatctccagcctcggacactgtgatgcctgcatggccagatcccctcccatcctgactgctgagtcgaggtcgagcttcgtgatattgtcaaaatgaaatgccttctggatgctgttaaggatgtaccgcttcaggtgaacctggtatcagacccacagtacttgctgttggagaataaaaattaacgaaccagataaatgcgtcatccgctggttgcgtccagtcgcccttttcgtcttagcctggtacttctcccttccttttgctccctccgcccacccgcaaaataagaaaacacaagaaaacaactagcacataaattcatactgtattgaatgttcgtaggtctaggtgaaacaaaactgagaagatagatgttccactgctctattactatataatgtcga

SEQ ID NO: 641073 - DNA, 115 bp, Homo sapiens
cgcatctaggcggcgtcttgcgggggctgccccgccagttatagttagtgaagaagccgtcgcaggaatcaaagaagaccctgttgtgctggttgagttcgtcttgcgggggctg

SEQ ID NO: 641074 - DNA, 299 bp, Homo sapiens
  misc_feature (2)..(2): n is a, c, g, or t
  misc_feature (208)..(208): n is a, c, g, or t
  misc_feature (236)..(236): n is a, c, g, or t
  misc_feature (249)..(249): n is a, c, g, or t
  misc_feature (272)..(272): n is a, c, g, or t
  misc_feature (281)..(281): n is a, c, g, or t
gntcaaagcggtcctgcaccggtgcttggacgagttcgagaaggaccccgtccccgaccggttcctgaaggacctggacgagaaggtcgacctcgactcagcgtggtcactctggttgtgggacaaggcctcgttgagagaccggagtttcaggcacctcagaaaagacttccaccggccctacgtcatggacgtgccccaggacccngggtagtatttgttcccacaaaaatccncttcttcatgcancccgaccgggggtcgtttcaccntcaattccnacattcccacgaggccga

SEQ ID NO: 641075 - DNA, 249 bp, Homo sapiens
gatgatgcgctgggccaggccttccacgatcgcggtcttgcccacgccaggctcgccgatcagcaccgggttgttcttggtccggcgctgcagcacctggatggtgcgacggatttcctcgtcacggccgatcaccggatcgagcttgccgctctcggcacgagcggtcaggtcgatggtgtacttctccagcgcctgccgctgttcctcggcattctccgactgcacgttctcgccgccacgcagctt

SEQ ID NO: 641076 - DNA, 155 bp, Homo sapiens
gagcatgttgtggtcttgctgaaagataatccagagctgggccctgattataggaggcagagcagaggacgctgggcttgagaggttgtctaggaagcagaatggactgagcttggtgaccagttggatttgaggactgtgcataggaaacacag

SEQ ID NO: 641077 - DNA, 417 bp, Homo sapiens
gaactttatttacccattcaatgaataaattactcaatattgccaatggaatcttgatataactctgctaggatctggagatacaaaggtggttctgtctctggtcttgtgtaatatcctcacatacaaggctaatcagagctggaatgaggagtctaggaagcccttagaagatttgtgagatcaggaaaaatgaatcccagaaacattaagtgacttgcttacaacttaacaaccaatttaaggcccgaaagcattttggaagtctagaaatgttcacaatgataaactacttccaactcattacagtggctaaaatcagaaaagctgccaataccaattatggatgaagatgggaagcaactggaatactcatgccctgctggtggaaatgtaatttaatacaactattttgca

SEQ ID NO: 641078 - DNA, 622 bp, Homo sapiens
ctagaggttcccccgggagacgaccttttccaaaaacattgtgcaatttttaaaaattgttgtaaaaatatgtcacataaaatgtactatcttacccatttttgagtctacaattcagtagtgttaagtatgttcacactgttgtaaaatccagacctttcattttacagaactggaactttatacccattaggccatcaacaacggtttaagaattcctcacttcccctccccaggctctggcaactggcagtctactttctgcctatgaatttgactagtctaggtacctcacctaagtggaatcatacagtatttgtctttttgtgactagcttatttcacttagcattatgtcctcaagtttcttctatgttgtagcatgtctcagaattttcttcctttttaaggctgaataatatttgattatttggatatgccacatttggtttattcatccatcagcatgcaattatttaatggtcagcttttcatgtttatctgcctcctcctcctgcaggtactgtctatctagtatcactgggtccccagtgtgagcatcataatcagcatataataggagctagaaggtcggctcaagggggtacgagctcgattcgcat

SEQ ID NO: 641079 - DNA, 124 bp, Homo sapiens
ttgtttttaataaaaaaaacctttttggccttgccttatcttattaaggagttgtatgtcagggtataaaacaaactgtgtgggataaccggcttaataaatttttttaaaggaaagaactgga

SEQ ID NO: 641080 - DNA, 819 bp, Homo sapiens
  misc_feature (106)..(106): n is a, c, g, or t
  misc_feature (385)..(385): n is a, c, g, or t
  misc_feature (450)..(450): n is a, c, g, or t
ggacgtctcagcctccagatcataaagagtacaatcaaagctatagatgtaaggaaaatctgatgccaggaaccgaggcctgtgagggacaagggttaggtccttntgacaaacacatgagagtaagaatagggttgggagatatgaccttaaccttataggtaggtaaaagccctgtaccctgcataaagcccaacagccaagtgctcctttccttgatcacagatgctcaaagaagcctggagaggccacaaagaggtttgccatctatcatggcaatgttgagaggtgggcaagttgctaccaaaatattaaaagcacaagtcagaagagcacataaatgtaagatccataatcaaactacctacatgcataaggaaatganaacccaagaaattaacctaaaaattagtgtagaaacactgaaaccccaagaaacaggtagaaacnagactgaatagtattgggagaagctttcacagttctgaatccacagcctgctgccagtacacaccgataactcttccccctaactctgaagtagacaaattcatcattttataaactacagacttcatgtaaaaagaaagtatcaacaactcaaaataataaacaaatatggctgggcgcggtggctcacatctgtaattccagcactttgggaggccaaggtgggtgtatcatcgaggtcacggagttggagacccgcctgaccaccatggagagatcccgtctctgctaaaaatacgcaaattagccgggcgtggtggcacgcacctgtatcccagttactcaggagcctgagccagtagactctct

SEQ ID NO: 641081 - DNA, 156 bp, Homo sapiens
cccccccccccccccccccggggtagggggggggttcccaaaaaaaaaaggggttttgggggtttccccttggttaattttttcccaacccccggggggggggggccccccccccctttaaaaacccccgggagggaaggtttttccaagggttta

SEQ ID NO: 641082 - DNA, 116 bp, Homo sapiens
tgtactggatgtgtgtgatatcatcaaggtctctgtcccattcttcagggttcgattaagctgtaattccagctatgcgggaggctgaggagggagactcgcttgaacccaggagg

SEQ ID NO: 641083 - DNA, 368 bp, Homo sapiens
cccctgctgctgcggcgactctaccggatctctgggagcaaaagcttttttcgagatcttactgcaatatatgagtcctgtcgattaggtcaacatagacctgtttctcgactgttaacagatgggatcatgagagttggatctactgcatcaaatgaaacttatccagaaaaagtttggtacgccagaactggttattctacaggcagctgcatggtaaccaatgaagcatatttcttaaaactccaagcctttattaggcaccaagtcttgcaagataattgaccctaagggtccccctttcatactttgctttcccatggccatttgggacaagcttcctacttaactttttccccagaccaaaa

SEQ ID NO: 641084 - DNA, 334 bp, Homo sapiens
tgctactgggcgtatggtgaaacctcactgctacaaaaaacaaaaaattagccaggaatggtggcgcatacctgtagtcccagctacttgggaggctgaggcaggagaatggtgtgaatccaggaggtggagcttacagtgagccgagatcgcaccattgcactccagcctgggcgacagagtgagactccatctcaaaaaaaaaaaaaaaaaaaagaaaaagagggagatacagaggagatcccagttgaccattttgtttttatcccagcaaaattgtccagggtctgtttaagggagggctggtttccctttattgtgacttatttttttt

SEQ ID NO: 641085 - DNA, 824 bp, Homo sapiens
gaggtagaggctgcagtgagctgtgatcgtgccactgcactcagcctgggtgacactgagaccctgtctggaaaaaaaaaaaggtttcactaaatttcatgtcatcatcattacaattttaggattaaaggtaagcaactcgggacattctttttggctctatccagaaatttacacaaattattgccggttttaagctcaggccaggggtcaatttacttactcaagctttggaccttcaagtagttatgaggggctagctagcttttatcccttaagaaccaacccaacaatttttaagtggccacaaattgataaacacagaatagagcaactaaagctaacaattaggaactgtaaaactaaaaattttctcaaaacaacatattattagttggaccggacagtcatacctggctcttaagagtggacctctcaacccaaaaagacttacccagaagtctgtgcaaaaagattaggtaaaacattcttaaatctagtgtaaatcagttacccctttgtagcaatgcctttgtgaatcagaagcgttctccaacttgaattggaaacactagcaccatctgtgcgtggaacgaccaaactgttttcaacactttcctcacataacagctaaacgccatagaatgttaaatttttccggaaaggaggtggggtgcgtatttctaagaacattaaaggcggagaccagaaattgtcccatggtgggctggaagtcaacctgagtctagagggaaaacgaaccaaaaccgggcagtctatacggattatacagcaccgagattttataactataggcattttgg

SEQ ID NO: 641086 - DNA, 345 bp, Homo sapiens
tagctcgatcctagagtatccacccccaaggaatcccccaaatggaagtctccatattcgtatccactttaccatatatttgaatagttactatgatcgctcattgtattctggactatcttatttgaagttctaaaacaattatagctaaggatttattattttgggcctccatccagattctttttccaagatcattgactagaatcatctgtcgtctgtttccagataacatactttccgttctataggaatcttcactgccaatcatagtatctaccagtggctttcttagactattcactccaaagctgggactgatgtcctgccagtagagaatctaca

SEQ ID NO: 641087 - DNA, 341 bp, Homo sapiens
agacacatgagagcagtcctacagagagcaagatgcaccccaggatttcttcattttctaatagctgtgggagtgcacagtattccccgacagcgaatttcccctgagacaagatactagaacctgggttagcccaccttgtaactcttccttaatctcctccttaaacatccctaattcatcctccctctggcatggaattgacgcccgagcagtacatttgccaagtggcaccttctttcaatttatgtttaatttatgctatggtaggtgattctttatttagctggttgtcttaaactcacacatctttctctctgtctctctctttcctgctcttt

SEQ ID NO: 641088 - DNA, 392 bp, Homo sapiens
gtaatcagtaccctgatacgaaccaggatgcccagtattggaagctcatatgcacactctttccctacaccagactggagtctgatgcacactgtgccgactcataccaactgactaaggaggctttatatgaaacatgtgctgcaacctgtggaataacgagctattcactgaactcaaggaatgttagacctcgttataccacatatgccggtcgttagcccacaatcattgcaaggctgcatggacagcaacaagctgcaagtcatgcacgcgagtgacagtgacgcacgctatgtttatgatgcactatacttggtccgagtgcctcatgagctgttcgacagcgtcacaccgtggttcacgaccttgttggtgatcacatggatcag

SEQ ID NO: 641089 - DNA, 345 bp, Homo sapiens
cagacttgaaccgcataggaagtcatactgtgccagaggcgctgtcaagaagaacgttgcgctttttgccctcgagaagctcctgcatttaggttctatctttccaggcgaaacacatgggtatactttacatacagccatcttcaaatgaaccttagaatgaactcgcagtggagttcgagtaaagataatgactgatgtgctagacccagtcagaattgttggtgctagaggtccgcatgacctaattgagactctacatatagcttagatttcctatacgcttacagtatttgctagatcacatggagcactgacactgatatattccgactcggtcatctg

SEQ ID NO: 641090 - DNA, 133 bp, Homo sapiens
attctagctcggtacccatcagtcggccgtgtatcacgcaaggtatggtggtatatgcatatcacgctgactgcctgaacttgtacagaacggtccgagcctacacgcacgcgagagcctacacgtacgcgag

SEQ ID NO: 641091 - DNA, 268 bp, Homo sapiens
tacccgtatatttttcttcttccgtgaccttcatggcggctgccagaatctcgtcccctttgaactccttgtagagctcccgcagtgcctctccgttctcggcatttgtatttttcagataataagacggctcctgtttggccttctcttcatctgggtctattattttcatgttattcttcacatgatagaagttagagacattgaacttgtccaaattggtggggtcctggagggtgatgatgtcctgccggaagaagaaaatgat

SEQ ID NO: 641092 - DNA, 341 bp, Homo sapiens
ccattgttggccagcacgggtcggattacttgaggtcaggagtttgagaccagcctagccaacatggtaaaaccctgtctctactaaaaatacaaaaattagctgggtgtgttggtgcatgcctatagtcccagctactcaggaggctgagtcaggactgcttgaacccgggaggcggaggtgcagtgagctgagattgtgccactgtactccagcctgggcgacaaaaactcagactcaaaaaaaaaaaaggaaacttaatttaatttaaaaggaaaaaaggattccattcccagcatttgggaaggccgaggccggtgtttcacaagatcgggaaatcg

SEQ ID NO: 641093 - DNA, 138 bp, Homo sapiens
cgatggaggttgtggcaggaagaggttgaacagacgacctctcttagcagggaactactcccatcctggagcctccgtagacctaaccgatcgttctccttacacgctagcaggtgtctcctctatcttaggggccat

SEQ ID NO: 641094 - DNA, 109 bp, Homo sapiens
tagtccattttggccggtcagtaggtaatgcagtctttcccagggtaaaaatttccatattggtatggagctggaatataatggaagtaaaaataattaattgttttta

SEQ ID NO: 641095 - DNA, 221 bp, Homo sapiens
tttgtggtattcctgtgagggataattatgacagatgctccatcgtgcctacgacaaacagacctaaaatcgctcattgcatacgcggcaatcggccacatggccctcgtagtaacaggcatgctgatccagagccccgtgaggcttcaccggcgcaggcaattctcagtaattcggccaggggcttacatcctcattactatgctgcctcaggtagagca

SEQ ID NO: 641096 - DNA, 107 bp, Homo sapiens
aggactaatagatgcttactggaaaagaaagaggaggggaccatgcagactggcttaagggatatgagaagactcctggagatctattaatagcagtgagatgtgct

SEQ ID NO: 641097 - DNA, 244 bp, Homo sapiens
  misc_feature (147)..(147): n is a, c, g, or t
  misc_feature (211)..(211): n is a, c, g, or t
ctagtgagaagatataggaatgggaacccaggtaacagtctggccacttttccatagggctgctgcagtatgcccagggcccgctccagtctctagtagcctcagattttccagtacctggagttatcatcagtgaagcctgtgaanaccaaagatggcagcctaccgctccctttggaagctttgccctagggaggtatgaatgaacttnttgctggcccaaacacacctgtaggaggtggct

SEQ ID NO: 641098 - DNA, 255 bp, Homo sapiens
ggagagcccagcggagtttactgggcactagttaaaatctcaggagaatgttgcatttgcctcaccacctgcccccttttcctggtgccttctcccctttaaagaaatgggtaaataccgagcaacctctttgggagctccagccacagaggattctgtgatttgtgtgtttctcagcagcccctcaagctctggcttaattattccccattgagactcttgcctcagtctctcatttgggcacacattatggag

SEQ ID NO: 641099 - DNA, 184 bp, Homo sapiens
tccgagagattctgagcccctctactagaaatttcttgatacccatgttggcagactaatacagtcagcatgttgttagggaagttcagtaaaaatgatctctcagttacaggggagtgtatgttggtaatgtgacatatctagtaggttagagatgtgagctctagcatgtgtgttttgtgca

SEQ ID NO: 641100 - DNA, 268 bp, Homo sapiens
ctgtggtgtaccgcctgtgcgggtatgtgtatgagtttttgtttgaacacctgtgttcaggctttgggggcatctacctaggagtggaatttctgggttaaatgggaatttaactttttctccttttttttaaaatttgaagtatacctgatttgcagtggcaggttagtttcaggtgtacagcacagccattcggttgtgtgtgtgtgtgtattctttttcagattattttcccttatattttattataaagtattgagtgtagttc

SEQ ID NO: 641101 - DNA, 730 bp, Homo sapiens
  misc_feature (399)..(399): n is a, c, g, or t
ggatacgggagttcctccttgctctcgcccctactctttctggtgttagatcgagctaccctctaaaagcagtttagagtggtaaaaaaaaaaaaaaacacaccaaacgctcgcagccacaaaggggatgaaatttcttcgggacattcctccgtgcttctcccgttactgatcgtcttgctccctagagttccttcgtgaagcttttatattcctaagaggagaaaatcagtcaccggcgaaatcgctgctgattacaggagctgggcattggaaatgggagactgactgcctatgaattttggctaaactttaaaagcaagctgggttctcggggatataaaataagcttggactggagggaaacagtctgccaaattgcaagggactggcgtgccnaggttcatacctttgtgggtagactgcagcaacccgagaagatttttacaggctctgcaaagaagcactacaaaggcatttcttcctgcaatgacgaagaataaccatggccatattggtcactgtgggcttcggcagtgggacatgtttcggtccccttcttacgggcttactgtccaacgcaagttggctgctgtggatttcataaaatttgacagatgaactgctgccttacaaataactggggtcaaaacaacatgtcctgtgtcctaattccgtaaacatggttcatcaaaatccagtacaagttggggaccaattctggaacctg

SEQ ID NO: 641102 - DNA, 250 bp, Homo sapiens
  misc_feature (42)..(42): n is a, c, g, or t
  misc_feature (87)..(87): n is a, c, g, or t
tgtcagcatcgctaatgtggtgtaccgtagagccaagctgantgaaagggcacaggcagagatagctgagagctcagtgtttccaantggtataaataccaaggatatgtatcctcttacccttcttagacccacaaattaacccggtacttcacctaaggtgagatcagattatcagatgatttccaaattaaacttaatgccattacaactaagaaaaatcattttaccagcacaatacaaagaatag

SEQ ID NO: 641103 - DNA, 746 bp, Homo sapiens
cctttctctggtgcctccctgattagcttagtaactaacctcctgaattctttttcaggtaaatcagggatttcttcttagtttgggtccattgctggtgagctagtgtgattttttggaggtgttaaagaaccttgttttgtcatattaccagagttggttttctagttccttctcatttgggtaggctctgtcagagggaaggtctagggctgaaggctgttattcagattcttttgtcccacagggtgttcccttgatgtagtactctcccctttttcctaaggatgtggcttcttgagagccgagatgtagtgattgttatctctcttctggatctagccatccagcaagtctaccaggctctgggctggtagtgggggttatctgcacagagtactgtgatgtgaactgtctgtgggtctctcagccatggataccagcacagtatttggggtgtctcctgagtcctgcaaaagcaatccacttccatcagggggtctgccggtcctctcaggtttcctgattcattcctgcagtcattctggagcaaaaattcacaatgtgagcttcacatgctgctctgtccatccgagttggagctgaaatctagtcctgcctcctatctgccaatgacttcttttttctatttaaatggcttttatttatttctcttggctgaatgctctggcttggaactccagtactatgttgaatcttaaacattttaatctaatcataccact

SEQ ID NO: 641104 - DNA, 1384 bp, Homo sapiens
  misc_feature (194)..(194): n is a, c, g, or t
  misc_feature (273)..(273): n is a, c, g, or t
  misc_feature (882)..(882): n is a, c, g, or t
gcaaatacatggaagtgtaactctctgcagcttgtactaatgtggcgcatgctaagtaggtctctagtatcgggggatccctgacagctagtcttccggtagctcctctccgtgggcacgtgggttccgagctatctcgcgctttgtcttgcgcacaacgccgcatcgcgtcggccactgctctctctcattcngtcggatagtatatgcgtgtgtgtgtggtttgcgtccactctatcgtccgtcgttgcgcattttgtggcgtaactctcngagtcgttggcgtctcttcgcaaccaatggcatgtctccacaaaaagcaaccatctgtgcaccgcattggcgtttccttgcgcatgcagtggtatggccacctattgtgtggcctgctccgcgtataagcccaccaagtaatagtttccgctcgaggcccctagtagatagaagcggatcctaggaattttcccattttgtgcaaaccccctttcctgaacccttcgcttgcccagcaaagagaccatctcgtcgaggtgatattagaatacctactcattacatttcgctttcgatgtaaatcagcccctatttaatctctcagagacccctcttggttctagcgactagcatagctatacaaagatctgtggaaacgtaggtttttctattcctagcatggagacaaattcacccctgagatacttcctgaacgtcgcatctttccccattattgtaaaagaacgttactcaagcgcaacgaataccaacgcattaggaatttttggcatcctttctttgaacgtttgcctcttagagaccttactgcccagtttgaccctttaagcgctctcttaaagttcgcatagagaagccacgaagagcctnggacgccaggttgtgggattcccaatttggcacaaggctctggccaaagaaaggcggcataccgagggggttagagagtaaggctccgagtgaccgtatcgcaccatttgttcgccttaattggggtctccgattcggagggcaacacactccttgtgaatagagtttcgagccagtatcgtgaattggcccgccggactctttaaccctcaaacgctcaacatttagttggaatctgtcccactatccagagagtctcttggttgggccgcaaaaggtctccctcaagagggtagttaactgtggtgtatcccagccccccacgcatgtacgcaaggttgggcgcacttaggttgggaacaaccttatatgcacaacctggatcggccttcaacaggggtcacccgtcgtcacacttggactccccccaagctcgtctaaaggagactcatttgcacgcccgttgcatcaagagttcgcgcaaatacaatacgtgcgcggc

SEQ ID NO: 641105 - DNA, 150 bp, Homo sapiens
cgtggggcgtgaccacccctccacctggaccgcggctggtgtcactcactcatgttttctaccgttttttttggtttggtttggtttggttggttggttggttttggcgccagaacctctccctggggggccagctggaggggtcccgag

SEQ ID NO: 641106 - DNA, 246 bp, Homo sapiens
  misc_feature (214)..(214): n is a, c, g, or t
agagacagggtttctccatgttgtccaggctggtctggaactcctgagctgaagaaacctacctgcctcagccccacaaaatattgggattacaggtgtgagccaccacatgcagccaaaaaaatttttaatagggaagaagctagtaggaataaggatataagggaaagaaaccattttgtgtacagctgtacacaaaatgtgtttttaaggntaagtgttactacaaaagagttcaaaaagctt

SEQ ID NO: 641107 - DNA, 401 bp, Homo sapiens
ctttagggccgggagacagcccccaggccaaagttgggccctagctcctggggctgttcccgcattcaaccactggccttttccacccttgctcaccctactgttccccccatcaaaacagttttgccctgtgaaaaaatccacccttcccccccggcaagggggggtcttacccgggattcctcctgttgttgtggccctgggtaaaagcccccccttaaaacacaagacaggcctgcttacaagggtgagtttaccttggcaaaaaccaaaatatttttcctgggcccctggggaattttaggggtgatgggaaaaaaagaacccggagtggaaggaacacagtttccaattaaccacctgccaattaggtgccaataaaatgccgatgattgggcggg

SEQ ID NO: 641108 - DNA, 259 bp, Homo sapiens
aaggctaggtagcgaggctgggtggttggatctcttcccactccctccccagccttccccgcgagcggacgcggcagcggcctctgtctcgctttttcttatttttcccccctttcccctttctttttttttttttcttttcttttctcccctccccccttttacacacttttcccctgcggaggcgctttccccgggcaggggcagagcgggtctaaccccggctctcgggccgggctatggaaggaccctcaacggg

SEQ ID NO: 641109 - DNA, 323 bp, Homo sapiens
gtcctgtcaaactcagttctccacactcacaaagaaggcctgctggccgggcatagtggctcacacctataatcccagcattttgggaggccaaggtgggcggatcacgaggtcaggagttcgagaccagcctggccaacatggtgaaaccccatctctactaaaatacaaaaattagctgggtgtggtgatgcgtgcctgtaatcccagctacttaggaggctgaggcagcagaatggcttgaacctgggaggtggaggttgcagagagccgagatcgtgccactgcactccagcctgggcaatagagtaagactctgtcta

SEQ ID NO: 641110 - DNA, 128 bp, Homo sapiens
tctagaggtatcacccccatgtactttatgttgcctagtcatgaaatgcgttatactcttcttagacgtcttggttgtgggccgtgggtcacccctgtaatcccagtgctttgggacggctgaggtgg

SEQ ID NO: 641111 - DNA, 488 bp, Homo sapiens
  misc_feature (13)..(13): n is a, c, g, or t
  misc_feature (167)..(167): n is a, c, g, or t
  misc_feature (190)..(192): n is a, c, g, or t
ataatacatacanatgtatgattctgtgtggcttggagaagttggcatgtgttacagcaagtcttagtattgtgaatcatatctgtaattgtaagaagtgtctgtatgtccagcgattctatgcacagggaggtaagtgttggtgttatggagcaagaaagtgtttngtgggattagtcgttatgttgtnnnaaggatttgtatatgtagggttatgtccatatactgtggctcctatttgggtgttctggagctagtctggtttctggggggtcattctaggtgtggcataatgtatctctatgtttcagatgagtctcagtgttacaagacaaggctagttgaagtggggtatgtccaggccttgttgagtctatgtgtatttttgagcatttcttctgattttaaactaagttttgaagagacaaggaagtgttttatggagacagtttgtgtgttaaaggtagagcctgtgtagttccatgtgt

SEQ ID NO: 641112 - DNA, 1122 bp, Homo sapiens
  misc_feature (833)..(833): n is a, c, g, or t
  misc_feature (1049)..(1049): n is a, c, g, or t
gggagaatccagaatgaggacccggaggagcctccgttgggcacctggacagaagatctatgccatgtcgacgtgggggaccgactctaaggctgctggtcaggcgccttcccaggattgggaagctcatctatctgggacagcgtacagcgcatcacaatcaaggtccatcgccatccgcgctgcgctcctcctgggtaatgacctgtgcctacgcgccctcgagggaacttggtaggcctgtggggggttggacaacatctgcttccatctacgagcgctcgaagagcccgtcgagggcgaacgtcagggtcagtccggggagctgactggccacactgggtacctgtcgtgttgccgtgttcctggatgacaatcgcaagagtcatcaccaggctctggggagtaccacctgtgccctgtgggacgattgagatcgaggccagcagacaggtgggttattggctggacacatgtggggatgtgatgtccactgtccactgagcccccgtatggccgcacgtcggtgtcaggcgcctgtgatgcctctatcaagctgtgggacgtgcggggattccatgtgccgacagaccttcatcggccatgaatccgacatcaatgcagtggctttcttccccaagggctacgccttcacgacggctctgacgacgccacgtgccgctcttcgactgcgggccgatcaggagctcctcatgtactcccatggacaacatcatctggtggcatcagctctgttgcctctcgcgcagcggacgggtgctggtcgctgggtacgaggacttcaagtgggacatctggggatgccatgaaanggcgaccgtggcggagatctcgtgggcacgagaaccgcgtgagctgcctcggggtcagccgacgatgggatgggtggtgcccacgggtcccgggaagccttcctcagaaccggagagaaaggtgccaccccccacggtgccgcgacgagaggggcgtcgcatggccacaagaggacaggggggggcgcgggacaacacccctccgcgaggacgagngggcagcgcccaccgagtgtcgcgcccgcgaaagagagagagacacagagagacagacacagccgcagaacag

SEQ ID NO: 641113 - DNA, 377 bp, Homo sapiens
ctgtctctatgtcttctactctgttcatcgctgtgtctcgctcgatgcatgtctctctgtctgcttgctgtgtctgattaggcgactgtctgtgcttgtgtgcttctatgtgtgtgtgcttgctgtgcgtgtggcctcatggtctgttgtgcgtcgagttgattcatgtcggtctgttttttcctgtctctgttcctctctgtcatgtgttctcttctctttcttctgttcatatctctctcttctctccctctttgtccttgatccctcggctgtgcttctcacatggatccctcctactggtttggggggttgggttcctgaatgcaccataatcgctgtatgaatattcaagtctaagtgacaaaagacaaaaa

SEQ ID NO: 641114 - DNA, 205 bp, Homo sapiens
gggatatttacacagtggcttctaagtatcttggcttcgtctctactaaaaatacgaaactagccaggtgtgatggtgcgtgcctgtggtcctagctgctcgggaggctgaggcgggagaatggcttgagcccaggaggggaggctgcagtgagccaggatggtgccactgcactccaccctgggtgacggagcaagaatctctc

SEQ ID NO: 641115 - DNA, 952 bp, Homo sapiens
  misc_feature (4)..(4): n is a, c, g, or t
  misc_feature (7)..(7): n is a, c, g, or t
  misc_feature (10)..(10): n is a, c, g, or t
  misc_feature (16)..(16): n is a, c, g, or t
  misc_feature (30)..(30): n is a, c, g, or t
  misc_feature (42)..(42): n is a, c, g, or t
  misc_feature (79)..(79): n is a, c, g, or t
  misc_feature (117)..(117): n is a, c, g, or t
  misc_feature (125)..(125): n is a, c, g, or t
  misc_feature (131)..(131): n is a, c, g, or t
  misc_feature (138)..(138): n is a, c, g, or t
  misc_feature (141)..(141): n is a, c, g, or t
  misc_feature (144)..(144): n is a, c, g, or t
  misc_feature (161)..(161): n is a, c, g, or t
  misc_feature (178)..(178): n is a, c, g, or t
  misc_feature (182)..(182): n is a, c, g, or t
  misc_feature (184)..(184): n is a, c, g, or t
  misc_feature (186)..(186): n is a, c, g, or t
  misc_feature (189)..(189): n is a, c, g, or t
  misc_feature (192)..(193): n is a, c, g, or t
  misc_feature (196)..(196): n is a, c, g, or t
  misc_feature (198)..(199): n is a, c, g, or t
  misc_feature (203)..(203): n is a, c, g, or t
  misc_feature (205)..(207): n is a, c, g, or t
  misc_feature (214)..(214): n is a, c, g, or t
  misc_feature (223)..(223): n is a, c, g, or t
  misc_feature (230)..(230): n is a, c, g, or t
  misc_feature (235)..(235): n is a, c, g, or t
  misc_feature (238)..(239): n is a, c, g, or t
  misc_feature (253)..(254): n is a, c, g, or t
  misc_feature (256)..(256): n is a, c, g, or t
  misc_feature (271)..(271): n is a, c, g, or t
  misc_feature (276)..(278): n is a, c, g, or t
  misc_feature (286)..(286): n is a, c, g, or t
  misc_feature (289)..(290): n is a, c, g, or t
  misc_feature (296)..(296): n is a, c, g, or t
  misc_feature (298)..(298): n is a, c, g, or t
  misc_feature (313)..(314): n is a, c, g, or t
  misc_feature (329)..(329): n is a, c, g, or t
  misc_feature (335)..(335): n is a, c, g, or t
  misc_feature (338)..(338): n is a, c, g, or t
  misc_feature (342)..(342): n is a, c, g, or t
  misc_feature (349)..(349): n is a, c, g, or t
  misc_feature (354)..(354): n is a, c, g, or t
  misc_feature (359)..(359): n is a, c, g, or t
  misc_feature (366)..(366): n is a, c, g, or t
  misc_feature (373)..(373): n is a, c, g, or t
  misc_feature (375)..(375): n is a, c, g, or t
  misc_feature (382)..(382): n is a, c, g, or t
  misc_feature (410)..(410): n is a, c, g, or t
  misc_feature (450)..(450): n is a, c, g, or t
  misc_feature (547)..(547): n is a, c, g, or t
  misc_feature (839)..(839): n is a, c, g, or t
  misc_feature (869)..(869): n is a, c, g, or t
  misc_feature (882)..(882): n is a, c, g, or t
  misc_feature (887)..(887): n is a, c, g, or t
  misc_feature (915)..(915): n is a, c, g, or t
gggngtntgngggggnctcggggggcggcngcggtgtttcancgggaaaggctcgaggagagcgcggctcacgagaganaacccagctgtgctccctggaaccttcaatttcaaggnctccctgngtctantaggggnctnagntcagtatgggggagcanttgagtgagatggggcncacngngnccnccnncgngnnccangnnnaagcccngcatgtggnggtcatngggcnggnntgtggtgggaaganntncctcctttaccgccncaagnnnaaggagtntgnncagagngncccgcaccaaaggcnncaacaccgagaaganccgggngcncctngggggancgcgnggcancacgctncgcaagngngggacgncggggggcaggagaagctgcgacgcacngtggcgctcttataccgcgccggacagacggtctagtgtntgtggtggacgcgtgcggaggcgtgagcggctggaggaagcgcaaggtggagttgcaccgaatcagccgggcctcggacaaccagggcgtgccagtnctggtgctggccaacaagcaggaccagcccggggcactgagcgctgctgaggtggagaagaggctggcagtccgagagctagcagccgccactctcactcatgtgcaaggctgcagcgctgtggacggtctgggcctgcagcagggccttgagcgcctctatgagatgatcctcaagaggaagaaggcagctcggggtggcaagaagagacggtgacccgagccccccctccctttcctcccacctagtaggggtctgcacacttggacagcagggtgggacagcctgtganctctcagtcagactggggtgcagacctgtncacctcaatgaangaganaggagatggggtgtccgttttggtgcanactggggtggggatgggaaagggatgtctttcatatt

SEQ ID NO: 641116 - DNA, 738 bp, Homo sapiens
tctgcctggcccactcagtggcaacaccgcgaggagctcgtatcgtccttggtgagagcctcagcggtctccctctttcagaactcactgccaagagccctgcacacaggagccatccatgctagctgcttgcagcttcattaagaccatgatgatcctcttcaatttgcgtcatctttctgtgtggtgcaggccctgataggtcagtgggcattctgggctgtcaattcgactggggcatcctttctgaatgatcttcgggtccactgtcgtccagtgccatgcagtttgtccccgtggtgctacttcctcactctgcagccggcgtggtggtctttgctctctggtttcctgggctgctgatggtgctaagactgatgagcaacgtgtgccctcgtgacgtccttcttcatcctcctcctcagtcttcgttgctgaggttgcagctgctgtggtcgccttggttgtacatccatcaatggctgagcacttcctgacgttgctggtacgtgcctgccatgcagaaagattatggtgccctcgaagactctcactcccggtgtggtgaacaccacccatgcaccgggttcaatgtgctgtgggttcacgcacctatgggctttggcgcgagtcaccctacttgcggaccacagggcgttcccccatctgtggcgtgctcgtcccagcctgcctatgggccggccggtccgggtccgacccagctgggtgggccagcga

SEQ ID NO: 641117 - DNA, 305 bp, Homo sapiens
gccaacgtttgggccccaaaaccggtgcaggttttgctgtcatcgtcaggactccttgtgggctgtggggctggccactccttggccctttgccagatgccagctcaccctgcattggtccaggaccccaaggtcacctacctttccccaaatgccatcgaggaccctgaatttcagaaagccatgggcaaaaagagaaactggaaggaaagccaatcagaaacttcaacccaaagccaatttggctggtccaaaaatggggggctgtgataaagaatctttaataaagtggcttttccccccca

SEQ ID NO: 641118 - DNA, 295 bp, Homo sapiens
agaactagtaggcctcaagcagtcctcctgcctcagcctgccaaagtgctgggattacaagcatgagccactgctcctaattcttaagagatcatttctaaacctccatagtgtatactcttccagaattcactttttgcacacccaaaggtttcaaatggccaccacactttctcaaatgtatcttactgcaaaggcccagttgcagaagacagcaggattccatccatctgtttgcaattcaccatgcaggcccaggcccattcaaaattccatgcattcaagcagccacagg

SEQ ID NO: 641119 - DNA, 900 bp, Homo sapiens
  misc_feature (73)..(73): n is a, c, g, or t
  misc_feature (107)..(107): n is a, c, g, or t
  misc_feature (193)..(193): n is a, c, g, or t
cgtggtggctcatacctgtaatcccagcgctttcggaagccaaggcaggaggagtgcctcagctcaggggttngagaccatcctgggcaacatggtgaagccccatntccacaaaaaattaaaaataaaaataaatttaaaaaaaggcatgcatggtggcatatacctgtaatcccaggtaattggaggcaanacatcatctcaaaaaaaaaaaaaaaaaccttttttgtgaggcaaagaggccgggaaaggggttgaatacctctcgctttgtaaagggggccaaaaaggtgtctgaaccgggttttccgaatcgggaaggtaaccccagggggctactaagcgaggtggggatatcttctcccattcaagagacgtcctcgagggtttactagacacgtttatgttggccctcactgattgcgcgatctcgcaggctcctaaaggggagtttagaaagcggaggtgcccctcagtccccgatgataacctataggcctgtgcgggtgattcacaccgggttaaagactcttcaaagctcccttctcagcgaaatgggccatattccatctgatatagggagctcgtgggtgagaacccaatgacaggttcggattcatttggacctgaaaactggacccaaaaaaaaccttttcggcatgggggtttacaaaacaacctttggcaggtacggtctaacttattgctaactgaagggagactacacggtggggcacacactacggtactaaatttgtaaggcggcaccgggtccagccgtacccacacttgggggggggaacaccgagggcggattggaaccggtccactgaacggttctcagaaacacaacgggaagagacgaccacgaggcccacagcgctacaggacacagactga

SEQ ID NO: 641120 - DNA, 728 bp, Homo sapiens
tcatgaacccgcgggtaacgagcgttgagctcttcccggcaggaagaatatgacaaatagcacgaggcgagctcggttatgggaaagcgccgacgatgatgggctattctgcatgccgcccgcaagcatgagggactcggaaggatctatgcagcatgaagcagaaaaaggcaaacgagaagaaggaggaaccgcgaagtagcgtttgtggcattcggtgtccaatccctcttgcctttcgcctgtgttcctggagtccagtcccaccacgctcgtcgtttccgtcctgttagtgcatcacatggtcccatgcaccgatggcgattccctttgcccatgagtcgtgctagctgggtcccattttgttgcattcctttccccgtctaggtaggcctcgtctccccgcatgggcgcagctccctgcggggtgagcggggttaccccgttcgccagtgttttttacttccttgtggcggctcacgccctgaaaggtatttaacacagtaggctatcgtaatgagagataaaagaaacaaagggctaacataattgtagataaaaataaagacattagagaaacaaaattgaaaagagaaattttaatattgagggagtggagagagtgaacttagatatttgcacacggcaagaggggggtgcaaaagttcatgggcagaagggatgccttgggaagttagatactagagtacttaggcagtgaaattagg

SEQ ID NO: 641121 - DNA, 605 bp, Homo sapiens
gggcccaaaccaaggtttttaaaattttccggcctgaaaaaagtggaaaaaaagctttgccgtttgatttccaagggttttaaagtatttttaggcctcccctttgggggggggcttatttattaatttaatttgggtttgggggcccccccgggcttaaaatggaaatttttggcaacaattaaaaaacgctggggggcgttaaggaaaaaaattttgttgttccaaaaagatttttttttccgcgggaaaaaaaatatttttttttatgggaaggttttcaattataaaaattttttaacgctttctttttgttccacaaacacggccaataagggcgccgaatatcccggggaccacaacacaaaggggccgtttttccgcagagaaaaaaaaaaaaaagacgctgtccacaaatctctggggtgttgggggaaaaaaaaggagcaaaacgtggtttcctggggggaaatatttgtgcccccctccaacatggttgtgaggacactttttatttttttggcccgctgtattttaccaacaaaccccgccggaatatttccccgggggaaacccgggttatatttttttcccggggcgatgcg

SEQ ID NO: 641122 - DNA, 307 bp, Homo sapiens
tagagagtgcgtgtaactaagaactaaaagatagggaataataggagttgggatacagtgttagatactaacgatcttcaagctttgaagatgtcatgcatgaagaaaattatgggaaacactgttcccgagtaattacttacagcgcttagtgtaacatatggtagatcactgtctccgcatacagacactgtaggtacgtaaaaactaccttgattctttatacattatgagacgacactgactcccgcataatgtcgttagagattgtagacaaacggtactcggaagatttcgcaacaatggg

SEQ ID NO: 641123 - DNA, 446 bp, Homo sapiens
gttccaccgctgcctcacgcgtatacactgggcgtaactgagtcacccccggctccgcgcgagattctcactggatgattactcgtatgagaccacgagcgggaacttcacgtctttcccgggccttggctggaattttttggctctgctgttttcgccacgcccataaatcttacacctggaagctgctgattcacaccctccaccacgtacctcccgaaaaggactgtcctataagttgtacactttaaaaggtcatgtagaggttgtaatagaatggcctttcagcctggtgactattggatagagaactcttgaatactgcctgcatccgggcaccctggcccggttgccctaggacctcgcgggtcccctgatgcaaagaggtgtttggtacttacataagaaaaatcatttctgactgattttacgcaaaagaaattacc

SEQ ID NO: 641124 - DNA, 805 bp, Homo sapiens
gtgatgtcatatcgtatagtaatacgaaaaagcagatacaagcctgccggagttccctatctgctaaagaagtaatatggtgatcatcagtggggattcccggtacggaagagagacagctctgataacaatgtttcgtcagggacgacaagaacgcggacaggtagtcacttacccagtagtgtcacaccccgagtttgcttacgtgtaggtttgcattacccaccctggttgtgctgcgaatttgcattagaacctgatcatttcctggggccagcatctaccaggggcgtatgaccagtctagaggaccattacccttgtgctccccctcgaggcattgagagttatagttacctatgctggtcagaaacgctatgggtgtatcctagcgtggtgtgttactacgttgaaaactcagctgtcaactttctcctaaatacttcagcactttttgcattcttgtaccatttgtcggttgcttatattccacccttgtatttgtttgtaacttgtaaggctccctaggggggcaagcaaaattatgtgtcttatggcgtgtaccctgttataggtgcctggcaaatgcccaatgtttatatcaaggtcttaattatacaactttgagttatttcatcccaattcttcatggaagtgatgctcaagccttgctaaaaacactgagggtctcccgataagccacggcattggggatccttggttttcaaagtgcttctgttttccccgaaggtccacttgagatccacaaatccccctttcctcttgatttttgccatgtaagtata

SEQ ID NO: 641125 - DNA, 648 bp, Homo sapiens
gccatgataccggagtgggggccagcaagggttgctttagatgtactctccccagaagaagcactaaagcagtacagaaatgaacggtacatttgtggccacaaagccattgtatgtagccttagctcagcgcaaagaagagcgccaggctcacctcactaaccagtatatgcagagaatggcaagtgtacgaagctgttcccaaccctgtaatcaacccctaccagccagcacctccttcaggttacttcatggcagctatcacacagactcagaaccgtgctgaatactatcctcctagccaagttgctcaactaagaccatgtcctcgctggactgctcagggtgccagacctcatccattccaaaatatgcccggtgctatccgccctgctgctcctagaccaccatttagtactatgagaccagcttcttcacaggttccacgagtcatgtcaacacagcgtgttgctaacacatcaacacagacaatgggtccacgtcctgcagctggcgccgctgcagctactcctgctgtccgcaccgttccacagtataaatatgctgcaggagttcgcaatcctcagcaacatcttaatgcacagccacaagtaacatggcacagctggtgtcatgtccaggtcagga

SEQ ID NO: 641126 - DNA, 108 bp, Homo sapiens
  misc_feature (36)..(36): n is a, c, g, or t
gcttctctgcgcttcacgtgctcaggtcacaatgcntgcggacaagaagcagtccagaagttctgaggctggacatcggcccgctccccacaatgaaataaagttatt

SEQ ID NO: 641127 - DNA, 193 bp, Homo sapiens
  misc_feature (112)..(112): n is a, c, g, or t
tagaggatcccctccagtatgaattatttatgtgtagtagctttgaggattgcattaagagcttatcccagcattctatcacattatgatatgtgtttctctcctagtgtgnaatcctcgaagaagctgtggcggtcggatgaatgctagtaggcggaccggggatacctgagactcgacattcgtgaatcgt

SEQ ID NO: 641128 - DNA, 137 bp, Homo sapiens
ttaggattcgtagatcacaagcaagctaggcgcctgagcatctggttcaaacgggtgctggtcagaaggcagccgcccacttcccgtttcctctttaactgaggagaagctgatccagtttccggaaacaaaatcct

SEQ ID NO: 641129 - DNA, 839 bp, Homo sapiens
  misc_feature (419)..(419): n is a, c, g, or t
  misc_feature (600)..(600): n is a, c, g, or t
  misc_feature (637)..(637): n is a, c, g, or t
  misc_feature (735)..(735): n is a, c, g, or t
  misc_feature (780)..(780): n is a, c, g, or t
ggtccgccgattcctcctccttggtctgcgcgcgtccttgagctggcgtgaggccaaatgcaaatatgagtgagcgggaaggcctcctgcaccctggataccgtgtgggaagacaagcacaagtatgaggaggccgagcggcgcattcttacgaacactgaggcgctacacagggcggtgcgctctcgctgcctcagtcatgtccttgccaatgcctgagtgggccatcctatgaattggggcctgggcaggatcgacctctgtatggacgctgtatgaggctggaagcccactgtacgggtgtgcagcagtgctgatgatcccatggaaagatgctcgaggtactagccaacgggcaacgtccctcttgcctagacatacacatagcagggaagactgcttgcctcctcaaatggagnctggggcgtcgagccaccgacaggagacgctttggacaccagtcccttgagcgccttcctctgtgaagctgaaagcgatagttgatgtcgctggcactagaggtcgaactttttcgctggaacaccagtggacaacgcaggtagtcttcctccttatctccagcacaccgtaaaggcattnggtcaggtgcatctgcttgcgttcttggcgtccaggngccgaggccacttcgaggcctttcccatttggcacatattggggacccccattttcgagggtgtttcttccttagcaccgccccattgtgtgagatanacccaccggaggttgaggcccttggcccaggccacacttgttganaccgttcgtggggagggaccttccttcggggggttcatacccacaagggtcccgtcccc

SEQ ID NO: 641130 - DNA, 850 bp, Homo sapiens
  misc_feature (98)..(98): n is a, c, g, or t
  misc_feature (183)..(183): n is a, c, g, or t
  misc_feature (198)..(198): n is a, c, g, or t
  misc_feature (334)..(334): n is a, c, g, or t
  misc_feature (409)..(409): n is a, c, g, or t
  misc_feature (510)..(510): n is a, c, g, or t
  misc_feature (518)..(518): n is a, c, g, or t
  misc_feature (543)..(543): n is a, c, g, or t
  misc_feature (554)..(554): n is a, c, g, or t
  misc_feature (564)..(564): n is a, c, g, or t
  misc_feature (566)..(566): n is a, c, g, or t
  misc_feature (682)..(682): n is a, c, g, or t
  misc_feature (692)..(692): n is a, c, g, or t
  misc_feature (708)..(708): n is a, c, g, or t
  misc_feature (828)..(828): n is a, c, g, or t
cgccggccgccggtgtccggaccgctcgcccccgtttggacccgacttcggttcttctggggtgttgatgctcctaaagcccgagagcacgtgtccanaccctagcctgtacgacgctgactctgcccggtcccagaaccaaagccatgccggggtgtggcctctgaccccacgcggtagggnaccccgcttgcgggnaccccacctggcaacccgcacctcccagcctcgcagccggcctgagccgccatgcgcgggaacgttgctgccgctggccggcctctacctggtgcagggcctgccctacgggctccagtccggcctcctgccagtnctgctgcgtgccggcggcctctcgctgacgcgcgtggggctggccaaggttctgtacgctccgtggctgctcaanctggcttgggccccgctggtggacgcgcagggctcggcgagggcctgggtgacgcgcacacggcgggcctgggcctggtgtgtgggctgcattcctgggcntccccctncatggagcctggccaggcccgggcntgcccgccgcntgtggcgggngnttgcctgcctgtttgttgaaccctggggtgccgccaatgcacggaatgtggcccctggaccgcgcctggcctgtgcagcctgcctggagcccggccgaacctgggggccgggcaanacccgtgcanggtggtcgcgtacaangctggggggccgcgctacctggggggcgcgctgctggcgctgctgcccaccttctcgtggccgcaactctttctgctcctggctgcacctactggctggccgcggcctggcctgggctgnacaagcctgcggcggctccaca

SEQ ID NO: 641131 - DNA, 904 bp, Homo sapiens
gccatgaagagcaccatgcagccaaaagcctggtggattggcaaagccattgctgtcttaacctctggtggagatgcccaaggtatgaatgctgctgtcagggctgtggtacgagttggtatcttcaccggtgcccgtgtcttcttatgtccatgagggttatcaaggcctggtggatggtggagatcacatcaaggaagccacctgggcacagcgtaacgatgatgcttcagactgggcaggcacggacgattggaagtgcccggtgcaaggacatttcgggaacgagcaaggacgaatccgagcatgctacaacctgtgtgaacgcgtgggatcaccaatctctgtagtcatatggcggagtgatggcagcctcactggagtgctgacaccttaccagttctgagtggacgtgacttgtatgacagatgacctcccagaaagcaggtaagatcacagatgaggagagtacgaagatcacagactaactgaacattgatgggcctggattgggtacaaatagagaatgacttctgtatggaacagactatgacccattggcaactgactcgtgaccatgaaatcggatccatggacaaaagcacgatgcccatcaataccacctggcccagagccaaccagaggacaataggagtaagaaagtaaagagacagcaaaatggatgagataacccatgggccccatatggatcaaccaacatcattgacccaagatggagaagccagacacatgagacgattacacaacaacaccttgacaattgcgtcacacgcaaacaccaccgaccctggggaagagaaaacaccattatggaacgcagaacaccaaccgacacaacagacaccccggtggcacactgcattagcaacatacatatttgaag

SEQ ID NO: 641132 - DNA, 358 bp, Homo sapiens
agaggctttagatggctgtgcgcaaaggagatcctcatgtgagctatgcccgcgtctgtaggtggcctgagctttacaaaaatgagactcatgtgtaaatattgtcagtatgcgtttgactttggaattgatctctcaagattaacactgtagagtaatgcttcattaagtatgaaggtgaaggatgaatatgtgcatgactttgagggacaggcattggtgtgcactgaaggacattcaattcccattcagcattcaccaagtaatcgtgcattgacagagacatacaggaccccaactctgttagccccatctgaggctaatgctaccagaactgtcaacttttccctttctgtgg

SEQ ID NO: 641133 - DNA, 437 bp, Homo sapiens
  misc_feature (8)..(8): n is a, c, g, or t
accccagnccgctcctcagcccccacccctcccttccaggagtgcagcccgtcccccctcagcaggctggggacggccttgcgcgctgcggggacccgacggggcagccccagccaggccgtcaggctccgagagaggtgcggagccaacactgcctcccagcgtcccagggtcctgtgaccgggaaggccccgcatctgctgcacccggagtggtggaggccagaacgctcgccagcaaacccgcccgttcacagaggcaccggagcgggcgggcgggggcggcctgcggagcagccagtcccgggcaccccacgccgaccgccgcgcgtccgggccggtctctgggcccctctgctggtggaacccggcagcgcctcctccgtctcagccgcgtcggtcccaggcgcctcccctacccgcacgcccaggctgggt

SEQ ID NO: 641134 - DNA, 269 bp, Homo sapiens
tatccacaggcagacacaaagttaaatgatgcaggattgccaaccacaggaatgaagacgatttctatacggaaataaacagaatgttaggacactccagtgtacaaggctcacaggggtcaaatatatgatacaaactgccatagcccacatggaaattgttggatcctgaaaccggaagtctgtggtgtttggattcagacagaactcgttcaagtcgcttatacaatgccgttgatagtccatctctgttacttacctttattttc

SEQ ID NO: 641135 - DNA, 311 bp, Homo sapiens
cttctagctcggtaccccatagaacaagcctgtgccaatggctgatcctagcgcgatgaagtgaacgtgccgagcactcagtcctctttttaatcctttatcaccggatgatgacgtctctgtttttgcgttactgcccatacataaaaatcctttactgttacgcagtagactttcttgaatttcatccagcgaatggacgatgtttcacgtgaaacattattccgtttccatacaagaaccacgtggggacaaccagtagtttctcgctcccataagttaaccacttcggcggggtcggactgactaga

SEQ ID NO: 641136 - DNA, 174 bp, Homo sapiens
acaccgagtaggaatatagatagagtagcctatcgctgtactgagactaggactacggtagtaagcatgactcccagaagtaagcacccaggcctgggaagatgccgataacatactgcagcagaagggcagtggatggaggggccactcaggggaggtgtttcccgagcagac

SEQ ID NO: 641137 - DNA, 266 bp, Homo sapiens
ctaaaatttttttttggaaatttcccaaatccttttccccaaattcattttgttttttcaacaacctcatctgcattttctatttctatatggaaccggctctatattgctatatctctgtataaactttcccagccctgtttgtttcccccccatccccttttgtttttgggaaccattttccccccccaagttcccccttttatgtttttactccctccctggtctttgaatgccttcgcctgtttaaagggttgggctttcca

SEQ ID NO: 641138 - DNA, 136 bp, Homo sapiens
ggggaaatggggggatttttcgggggacccctggcccccaaaggtggacgggcccccaaaggtggaaaaatttttttttggccaattgggtggtttaaaaaaaaaattcggggaaaattaaaagccgggacttcca

SEQ ID NO: 641139 - DNA, 219 bp, Homo sapiens
cggcacgaggattttgatgttggagcaaccaactgcagaacaagataattcatactgttgacattaaaattaaaattttcttttttttttgagacaaagtctctctgtcactcaggctgatgtgcagtggcactgtctttgttcactgcagcctccacctcccgggttcaagtgattctccagtatatttgtaaaaaataaaaaaaaactaaacccgta

SEQ ID NO: 641140 - DNA, 542 bp, Homo sapiens
tgaggatctgctctagtctgaatcagactgtagctcgagagtaatcatatagaaaataagtcgggggggagaggagaaggaaaaaagagcggagctgcaatccggggcagaggtgtgtcctgtgctatgaaaaacacgtaggaataggtgaaaattagtctatttagtctatgcattgagctctagggaaagtatgtcgtgcaagagatgagagtaacaggtgagagtacgtatactgtattagaaagtgagcgagccctttgttccatgtaagacagtcttgccagtccagtttaggttgacatgtggacctgagtacatcaagtttgaggattcagtttaatgaaaatgatgaacattgtaacattttagttggattagtatcatagtgctgtaaatactacttcatgctgtttcttttttgtgaatttgcttttatgaatatatagcacttatctagataaatatactacaaatgtgattattgatggaggtgggcctgtcccacagaaagtttcaacattgagtgtgaaacacttgtg

SEQ ID NO: 641141 - DNA, 1205 bp, Homo sapiens
  misc_feature (23)..(23): n is a, c, g, or t
  misc_feature (33)..(33): n is a, c, g, or t
  misc_feature (38)..(39): n is a, c, g, or t
  misc_feature (54)..(54): n is a, c, g, or t
  misc_feature (60)..(60): n is a, c, g, or t
  misc_feature (62)..(62): n is a, c, g, or t
  misc_feature (65)..(65): n is a, c, g, or t
  misc_feature (130)..(130): n is a, c, g, or t
gaggacgaggaaacaatcgtggntacaaaaatnaatcnnagggctacaaccagnggcagnanggncaattctggggtcagaagccatggagtcagcattatcaccaaggatattattgaatacccaaatnaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaaggtggcttggtaccgggggtcttttattaagaatttactccccccatttctcacagagaataacagtcgggagtcatggtcacaatataatagaatgtgttagcaaccagattcatgtagggactaaggggtcctcatgaatggcattaagactctgtacggctcatattacactccatcctctcgtgtagttggcggggtaggggagggggtaagctaaatcatagtttcggacaataacggggagggttttttcttaaaataacaagggaatgggtataatggggatggaaaactaaaactgggaactaagatagagaagagtggagggtatgtagaagggcggttaaaattgtaaaactgggtgcataatgggggaggctcaaactgtgagggttaatacataatttttcccatgtctgcaattggatctgaaaagaaagctggtttgcccatttcttattgaagaagcttgtgtaaatccaggggcaaggggtctatatgacgttggcatgggctgtgtgcccttctcccacaaaataggttaactgctggccggagtaggtaactcccccatcttgtaaggccaatgaaaccgtggttccgccataatctttaatgtaacccggcggccggaggggacacaagccggcggagttgttttccaaagaagaggggcgagacacacagggggggccacaagaactttaaaaaagggggggcgaagatacaggagcggagacacccgtagagagccttagggttaaaagcgtaccgacaa

SEQ ID NO: 641142 - DNA, 414 bp, Homo sapiens
gtgtggataggcgagcttgaccaggatggcattcagcgaaaagccggccgatgcgatgaccgcgagccagatgccgaggcgcgcgtcggcgctgctcaatattttcgtcgtccaccgaggatggaaccgagcacgccgcgcacgatttcgcggccgatcgagctggcgacggtgcgcgccaccgtcttggcggcggtctgggccagaccgtcacgctgaccgccgcgcgggccggtcgagccgaacaccagatcctgcagcccgccgagcaggccgccgtcaccggctggcgcgttggtcgcaccgggttgtgcgcccggcacaggcttgccggtggcgaccggattcgcgttcactgcagcggccagcatttcgtaggcggactcgcggtccagcgtctgttcgtagcggccg

SEQ ID NO: 641143 - DNA, 207 bp, Homo sapiens
  misc_feature (6)..(6): n is a, c, g, or t
  misc_feature (18)..(18): n is a, c, g, or t
  misc_feature (27)..(27): n is a, c, g, or t
  misc_feature (29)..(29): n is a, c, g, or t
  misc_feature (63)..(63): n is a, c, g, or t
  misc_feature (65)..(65): n is a, c, g, or t
  misc_feature (103)..(103): n is a, c, g, or t
  misc_feature (119)..(119): n is a, c, g, or t
  misc_feature (125)..(125): n is a, c, g, or t
  misc_feature (127)..(127): n is a, c, g, or t
  misc_feature (167)..(167): n is a, c, g, or t
  misc_feature (178)..(178): n is a, c, g, or t
caattnacagcaccaaantcacctcananacctacccaaaaggcataattaaccttacttccntnttctctccactcatcctaccctactcctaatcacatancctattccccgagcantctcantnacaatatatacaccaacaaacaatgttcaaccagtaactnctactaatcancgcccataatcatacaagcccccgcaaac

SEQ ID NO: 641144 - DNA, 254 bp, Homo sapiens
cgtaatgctgaaagcggcagggaaacgtgctaccatacccttcccagacttctgtcggggctggccttgctgtctgtctcctctatgccactgccttgttctctgggccctctaccagttcgatgagaagtatggcggccagcctcggggctcgagagatgtaagctgcagccggcaactatgcctactaacgtgtgtgcctgggaaccgccgaactggctgttggcccatccttgaagggcctatcaacctaa

SEQ ID NO: 641145 - DNA, 212 bp, Homo sapiens
ggagctggggctcgcttaggctgggtcacgcttccctggtgcctgcacccctcaagcctgtctcaccagtggcctgccctctcgctccagtgctgttgtcattgtgtctccttgggccgctgggtggtggcgtggtccgggtttgtaggagtggtctagtgggggggtaggagggatgtgggtgtgtggcttggggttgcttacggtgctgc

SEQ ID NO: 641146 - DNA, 130 bp, Homo sapiens
tgaggatccccgctacaacgcaaaggaatcatgaaatctgccaatgccaactcccgtcaggctgatccggaagctcatcaaagatgtggctgatcgtcctgcaaggcctgtgacggtccattccctgggc

SEQ ID NO: 641147 - DNA, 231 bp, Homo sapiens
cgctcgtccctgcgaagcggcttttacaagaaggatgagaacaagttgagcagtgccaacggccatgaagaacgtgcataaagaggaaaaaaagcaagagcagaagtcgtagtctataacgaaagagaagcataagtaggaacggaagcgaagtatagacagagaaaggaacatgagcaaaagccgtgaaagaaagcgaagttgaagcaaagagaggcgacggagccgctc

SEQ ID NO: 641148 - DNA, 422 bp, Homo sapiens
aaatactaccattattattttgtgagttatgacagcagtgcaacttgtgaccagcattgtaaagccttacaggtctgtgcaattatgaatcttgatagcatgtcctatgatgattgccttaaacagcatttataaagcacagtcactagtattccagttgtgtttgtagaaaaaaaaaatcacatcatggtgctcctgcgatcagcttctgaagtgctgggagcataggaagattgacattctgtgtgacttgtgaggctcagatgctgataccagtaacattcaaaattaacttcacgcattgaatacatttaaactgttcattagcggagtgatatttggacataaatatctcgtcttccaattttatgtaattatacctaacttatacccttgtaaaacttgtcatctatgcaataaag

SEQ ID NO: 641149 - DNA, 327 bp, Homo sapiens
  misc_feature (20)..(20): n is a, c, g, or t
  misc_feature (22)..(22): n is a, c, g, or t
  misc_feature (324)..(324): n is a, c, g, or t
ataaggattacaggcgtgcncncattacctggctgacacttcattcctttttatggctgagtaatattccattgcatggatggaacacttttatgtatccattcatccattgatggacattttggttgtttctcttttttggctatcatgaataatgcttccataaacattgcgaacaaggttttatgtggatatatattctcatttcccttgaatatgtacctaagagtggaattgctgggtcatatgttaactatgtttcacccttggaggaactgtggagctgaatttcacagcagctgcacccttttacattcccaccancag

SEQ ID NO: 641150 - DNA, 334 bp, Homo sapiens
  misc_feature (28)..(29): n is a, c, g, or t
  misc_feature (64)..(64): n is a, c, g, or t
aaaccttgggttatatagaaggacttannaatttagtgttgtgtccgggtgaggtggctcctcncctgtaatttcagtgttttgggaggctgatgcgggaggattgcttgaagccaggagtttgagaccaaccagcctgggcctcatagtgagattccatctctacaaaaaatttttaaaaattagctgcgtgtagtggtttgcacctgtagtcccagctactcaggaagctaaggcaggatcatttgagccaaagttggagcctgtggtgagctatgatcgcaccactacactccaagatgggtgacagagtgagaccctatctctaaaaaaa

SEQ ID NO: 641151 - DNA, 157 bp, Homo sapiens
ttcagactagtgatgagtgtgtggctacatacaaaggagatccttggaggtgaaagggaagggagtatgtagggctcaaacgatgagcaagagtggaatcaaataaaatgcttccactaccaaacagacattagatgaaaaccttaaaagataataa

SEQ ID NO: 641152 - DNA, 101 bp, Homo sapiens
gcacacgcgagtatcacactgcacacgccgaaagtcagactgcacacgccgagcatcacaccctgagatggggcaagaatccaatatcgccgatcttcacg

SEQ ID NO: 641153 - DNA, 139 bp, Homo sapiens
tacgtcccctcctactcgggcccccgactactggcgttccccgcctacacaccacaccactaccgcttctgactcttaccctccctctctcctacctccgtgctcgcactctggctactacgtgggacggccgggacgg

SEQ ID NO: 641154 - DNA, 355 bp, Homo sapiens
gggatttcccagcccaaggcagggtttttccagcaccctcctgtaagcagaagtttcagggtccagaacctttccttaggccccacccccaccccaatttctgccttccaaacaaacagccccaggctaagggttagacagggtgagcctcatacagactgtgcctttatggccccaaccttgggagaagaattttctgttaacctggaagactactgaatcatttttcccttgcccagtggaataggaccttaacatcccccttccggggaaagtgggttattttaattgggggtagcaatttatactgttttgtaaactacatttcctacaaaatatggatttattcttttga

SEQ ID NO: 641155 - DNA, 476 bp, Homo sapiens
tttaagagcgtgggtcgttttgattacatggtcaacgcacctttcataagcttctcttgcaggaataacctccatcccgcaagctcataggaaattactataaaccacacaggattcttgaacgtactgggggtttccaagagggaatgagtccgaccccaaggtgtcccggtcgctaacaaaaacaaactaaagggcctaaaactggacgcgagcccatatgcccaacagggggcacagaaatgataaagaaccgttcctaacatccatggcaacttcaacacacgaggatactgacccttacatattagcgattttagggaaaacttccacccttttaagaaagaagaacaagcttaatagctggatttcacagtgatcgaaatatttgttactatcagtattatgagacaataccttgggctgttggatgcctaaagagactacctgcgtgtcatatatccgatcagaaccaa

SEQ ID NO: 641156 - DNA, 104 bp, Homo sapiens
ggaggaggtggcgatatatcgaagactccgaggcggatccaaaccgtgtataaggaggccacgggagtccccctttaagatgggcccccccacttccctaccga

SEQ ID NO: 641157 - DNA, 737 bp, Homo sapiens
agcggagggaaccccggctgctcagcgcgctccgaggtcatggagatccccgggagcctgtgcaagaacgtcgaactgagcaataacgcgcagaacgaggggaatgcagacgagcaagctcaggtcggcgaccaagaccatcatgtcagcaggaagaagagaggtcaggtggtggggagcatgaggtggctttcggtggttgcactagtctggtaagaggcttgtgtggagcgggaaagattactgtgagcatggggtaggaggagtacctggtgtgtcatggtatgccatgctagcacgtctggatggtgagcaagtatgacgtgcaaggtgctcaataagaaatcttggctgtagtgctgaagacagagaagagactgttcgaggcatcgagagagttgctagaactgttagcagatgcgtaggcgttagtgtgcatcacaagttatcatagtcaccttacactctaggtatcgctagacaatgcaaggcaagattcatgtaaggtgcaagtttaccgtgtaaggaagtatttgtagatgactccgtctgcatgtttgtgaacagagggatgtcaaaggactctactaaaaagcccgggcaggagagattaccaggtggcactgggatcgatgctgaatatgaacaggcagaggcgcctgagttggtgctgagaaacagactccgtgtgatgtaagtgactgtgtccagacaagtagtggaactttacaggaacg

SEQ ID NO: 641158 - DNA, 219 bp, Homo sapiens
ttttaaccggggggggggggccctttcccaaaaacctgggccccaaaggtgttttttaaggggatgggaaggtaaccctttcgttcccttttgggatgggaaaaaggggggttggggggtgggtttttttgtttggtttgttggtttgttttaaaaattcccccaggggtgggatttctttttgaatggggggtgggggggccccgggggaatttttta

SEQ ID NO: 641159 - DNA, 155 bp, Homo sapiens
  misc_feature (15)..(15): n is a, c, g, or t
ctgatgtgaacttcntctctctccccagaaaaggctcaacatcaactatatagccaacatgtccaaggtgtttaagaagaccagctccaatgggaagctctccatctacctggggaaacgggacttcgtggaccatgtggacacggtggaaccca

SEQ ID NO: 641160 - DNA, 1538 bp, Homo sapiens
ggccggggaatgacgtcaatccgagctcgtcccggcctcaccagcgccatgctgggctcgcgagccgcggggttcgcgcggggcctgcgggctttggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggcttgacatttaattggggagcgttacttggatggtctgctatcaagggttcctgtgatccatctgtttgcctgcctctttatttttctggagttatgtggacactaatatatgacactatttatgcccatcaggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagatttacactctagacatccacagacctgaggattgttggaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatggga

SEQ ID NO: 641161 - DNA, 1180 bp, Homo sapiens
tcgctgttctgtaactcggtggtctcttacctcgagtggtgctcctggtgttttccccgatgtagcctcccgtctttgctgcctctgttctccgcaacacaatcccacgagccgcgttggtcaccccgttggttttttgcgccccctcctcttgtgttgccttgaagccctgtgcggactgtttggtcgcctgcgtcagcggctcgacccactcagattgctagtgcacacttgctgggttgtcccaccacctttgctcccaccttgtctgcccacctctcttgtcgtgaacatcaccttctccaccaatggggtgggtttcctctggcttttgcccctgtggcttttgtccacagtcacacacacggttgtctgtgtttctcgtcatttgttgtgtacttttgtggtcaagtgcccccaccccccccccctctgttcctaccgccctcgttgggtcactctttgtcccctcttgtgtcgcacatactccctcttgggggtgcccgcgtgccccctctcgtttctatggcggagatgtcctccacaggtgtgacccctcctcccccctcgagaagtgtgggaaaagcgaacggtacacggaagttttccaccagtcgcccgtgttttctaagagatccgccttgaccccctatatccccttctcacaattttgcgctctttgtttacaaggaagcataccaagtataacaacacctagcttgtgggttctctggggggaataacgtggaatattttgtcgttctactcgttgtgttttgtactataaatgggacatttccggagatattttaacatccatactatgccccgggcttgtccccctttggtggccccactattctacaggcggcaggggacattctcaccccggctgcgtgggtgagacatcccccccccccccgggactccccttccctctggctcctctcccctctttctatgaggaaataagatgctgtgaactttttggaacctcccgttttttgattttttatttgggtaggttttggcggtcccggcccttttttttaccccctggaggaaataagatgagggagaaaggaaaaggggaggagaacttctcccctccccccttcacccttagcttccttgaaaatgggccccccccgaataaatctgcccctttttataaatgctt

SEQ ID NO: 641162 - DNA, 3282 bp, Homo sapiens
ggccggggaatgacgtcaatccgagctcgtcccggcctcaccagcgccatgctgggctcgcgagccgcggggttcgcgcggggcctgcgggctttggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggtgagtgcgggcgggcgggcagcccgggaatttgcaagtagcagccgccgagtcggctccgcggagctgtccgcggcggccggccggggcgtgatggaaatgagaacctgaaagcttgggcttggctgccgggtgccgtgcgccctggggcgaatcacctcgggacactttgaaatgagagcctgaaagcttgagcttggctgccggctgccgtgcgccctggggcgagtcacctcaggacacgcagtcgggacagtctcctaaaggacccgccagtttcacgtctgtctgcatcctgagcacctgaagcgggcaagataattctcattccacaaacacttgtttaaatggtgactcaagcggaaggttccgttctcgtggccctccttcatttattagaatgtttgattctccccgcaatcttgtaaggcccacaaagacaatccttaagacagttaagacgctgaggaaactaaggctcctcgtcagagccagaccagaagaactctgtgttttgatgctgagtcggagctcttttacctgcatcacccataaggcaaagatttaattcatttgaacgcagcagggacagcgcttacggactgcctgtcagcttacaatcgcccccgacagaaagattttcctgaccttcctattttaattaacacctaccaacctcactttctatcgctttatccgcaatttttcttaatagcactcaccactaactaaccttatgcgcttgttgattgattggcttctccagtagtgttaagtgaattaataagttcctactacgttgtccggccatagagatagaaaaagctatggaaaccctttgctttcaaggaactctggtctagttgaaaaagactatttggtgagctaggaaaatatggatcaaatatgagtgatacaaaagcaagtgctacaggaaaaagagaaattactgtggatcccttgctggaaagtttcgagaagaaattatactccaaaggacaagttgattttgcagaggagggaagagatcttagtgcgggaagtacttttgcaaagacccaagggtggagtgttagaacactaagaatacgagcctgacctggaacaccaagtgggtgtggaaaatgggaaacgagactagacaagaacatatctgaagaagctggatagcgtggaggaagaagtgaaggatgaactccagccaatctagatgatgacatttgccattgcagtgtatggagatgtagtcaaaggcctaggtacatttactccacttttgcccgtacaagacccgaattaggccttgcttttggtattctagatttatgcacgacctatttgggattagagcactaagttataacaatcagctatcaaagcataaaagcctactgaatgataggtacagccctgccatcattgggaagctgtgtatgacccccatgagttttggggccacattcacgttgagaggcatgcatttccaagcccagttccaatctgaagcctggctgtaattctgttcttggagtctgtggcatggagtggcagtgtagccttatagatgaacatctgccattattcccatttccccagttaaacctctggcttctatcttagtggctggaccttccgccatgtaacagaaggcaacaaaggggttatgagcaaaactttggagccaaacctcttggatgtgaacctccaccctgctcatctgagggaccttggataaattacttcacctctctgggcatccgttttcatctgtaaaatgaagatactattaatgataatatggacgttatgaggtcacgaaaattcattaatatatgttaagtgcttagaacagtgcctgtcataatatgtgctgaagaaatagccattattatcttagaagtggggaatggagaaaattgtacttacagattgtgtatgtttggaagataccagcctgcatggtttggttctaaataaggtgatcattacaggatttttcagaaaactaaatagtactatgttagaattcgctcaacaaatgtattttgaacccctaccatatgccagaaacaataattgacaggagtagaattccaggtttgataattctttatttaaattcttattttgtgggataattatgtgttcgttgttttactttgttgaagttatatcttgttaccttcattgatcaatagtaggttttcgttgtttttgagaaggcaatacagcttctttcaaatgggctaaactaccttattccagaaagtgtcagcaggtggcactctttccaccaaattggaagtgtaattttttgttttaccacgtttatgggtgattatgttgtcttgaagatcatctgtttttgatctgtccatcacccctcagaacttgctcattttatttcatctcccatagagtttttcccttttctacaaaaacatttctttttgcaatctacttgtctcttgtctttgctacctctgcgtctttcttcacagaaaagtatggggaatgaaagtgtcatatggaagacacaacaaaacaaaaaactggcaaggaatcaaggcgggcccacacacgcgggcgaaccgaccgctgctatgccagacatcaaggaagacccgacgtgacaccgattggcctccggaaccaactggcagccacaacgggccggcctggacttacaacccttagcccattaaccgctcgtgccttggcacaaaagccccctcatcgcgcacgcccgcattgcaaacaggcgtgatgtcacactcgtccatcgcacagacgaccacaaccgaacacttcccacctgccctcaaaaccacacactccgtgggcgcgcccacaacgacaaccactccccacaccgggaagcgccgcacacaccgccgccgccgaaagtgccacacagcagacgaccgccgcacaccaaaacaacacacaacaacgacaatcccaccagccgcaccaaccaa

SEQ ID NO: 641163 - DNA, 781 bp, Homo sapiens
  misc_feature (563)..(563): n is a, c, g, or t
  misc_feature (565)..(565): n is a, c, g, or t
  misc_feature (568)..(568): n is a, c, g, or t
  misc_feature (570)..(570): n is a, c, g, or t
  misc_feature (572)..(572): n is a, c, g, or t
  misc_feature (580)..(581): n is a, c, g, or t
  misc_feature (588)..(588): n is a, c, g, or t
  misc_feature (592)..(592): n is a, c, g, or t
  misc_feature (601)..(603): n is a, c, g, or t
ctgggaatttgtggaaagaaaagaagacagacaaaacaaagaagggtatagagaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatgggaccaaacaaancnaancnanaacaacannaaaacanaaancaaaaaacnnnacaaacagacacgcggcacgacgacgcaccaccacgaccagcccccccctaccacgcccacgaccacctcccgagaccccccccgacagaccaaccccggcccccgcagcgcaagagacgactacacaacgagccgccgaccaccagcacacacacgccgcgcacgcacaaaagacac

SEQ ID NO: 641164 - DNA, 1656 bp, Homo sapiens
ggccggggaatgacgtcaatccgagctcgtcccggcctcaccagcgccatgctgggctcgcgagccgcggggttcgcgcggggcctgcgggctttggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggcttgacatttaattggggagcgttacttggatggtctgctatcaagggttcctgtgatccatctgtttgcctgcctctttatttttctggagttatgtggacactaatatatgacactatttatgcccatcaggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagaaatggggtcttgagattttgcccaggctggtctgaaattcctggcttcaagcaatcttcctgccctggtctcccaaaagtgctgggattaccagtgtgagctaccaaccccagccaagtttacactctagacatccacagacctgaggattgttggaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatggga

SEQ ID NO: 641165 - DNA, 1834 bp, Homo sapiens
ggccggggaatgacgtcaatccgagctcgtcccggcctcaccagcgccatgctgggctcgcgagccgcggggttcgcgcggggcctgcgggctttggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggcttgacatttaattggggagcgttacttggatggtctgctatcaagggttcctgtgatccatctgtttgcctgcctctttatttttctggagttatgtggacactaatatatgacactatttatgcccatcaggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagaaatggggtcttgagattttgcccaggctggtctgaaattcctggcttcaagcaatcttcctgccctggtctcccaaaagtgctgggattaccagtgtgagctaccaaccccagccaaggtatattattttttaaaaataatataggcctaaatccaaattttcccatctgattttcctggaattacttctgattcatgtctggaaaaatttcagtgatatctgaagcttgtggtttgagttgaattactctaaaagcaaactgacagataaagcttttaaaaaaaaatctgggtttctagtgatggttagtagactaattattcataaatttggtttctgctggcataaagaccaaggacagataagacatgaaatgcggaacatgtcaaagttctgccagtagagagcaggaagctgtcatttcaggatattcacccacaccacatcccctacctgtcagaaacttatgttgagaatctacattgttgacttgtaaatgaatgaactaaatctaattttgattaaatcacttgctaataaattgactatatttttatatcagtgttattgttattttcattaaacagaatcaaaaaggtattcatggtggatcacctgaggtcaggagtttgaccagcctggccaacatggcaaaaccccgtctgtaccaaaaatataaaagttagctgggcatggtggtgggcacctgtaatcccagctactcaggaggctgaggcgggagaatcgcttgaacccaggaggtagaggttccagtgagccaagatcacaccgactgcactccagcctgggcgacagagcaagactccgatctc

SEQ ID NO: 641166 - DNA, 132 bp, Homo sapiens
atgagcatctgctgacccccagtgccccagttcagactctcccatctgccttccagacctgtcaatctgaacccgcacaccagggagtggagttgaccataagtggtgccattgactggtaaaaacaagcct

SEQ ID NO: 641167 - DNA, 1520 bp, Homo sapiens
cttccctcatttacagatgaaacaaagacttaagccttaagatactttactgtctagtgtcactcaacttacaagtggcagacatagaactgagaagtcttcttactttccccttcactgtaggaacccttgtcatctgtaggggagctctacagattcctatcagaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggcttgacatttaattggggagcgttacttggatggtctgctatcaagggttcctgtgatccatctgtttgcctgcctctttatttttctggagttatgtggacactaatatatgacactatttatgcccatcaggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagaaatggggtcttgagattttgcccaggctggtctgaaattcctggcttcaagcaatcttcctgccctggtctcccaaaagtgctgggattaccagtgtgagctaccaaccccagccaagtttacactctagacatccacagacctgaggattgttggaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatggga

SEQ ID NO: 641168 - DNA, 109 bp, Homo sapiens
tcagaactctaatggtatgcctccaaccaaaaatgtccaaaattgaatttctgagccgggcatggtggcttatgcttgtaatcccagcactttgggagcctgaggtagc

SEQ ID NO: 641169 - DNA, 1884 bp, Homo sapiens
  misc_feature (1666)..(1666): n is a, c, g, or t
  misc_feature (1668)..(1668): n is a, c, g, or t
  misc_feature (1671)..(1671): n is a, c, g, or t
  misc_feature (1673)..(1673): n is a, c, g, or t
  misc_feature (1675)..(1675): n is a, c, g, or t
  misc_feature (1683)..(1684): n is a, c, g, or t
  misc_feature (1691)..(1691): n is a, c, g, or t
  misc_feature (1695)..(1695): n is a, c, g, or t
  misc_feature (1704)..(1706): n is a, c, g, or t
ggccggggaatgacgtcaatccgagctcgtcccggcctcaccagcgccatgctgggctcgcgagccgcggggttcgcgcggggcctgcgggctttggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggcttgacatttaattggggagcgttacttggatggtctgctatcaagggttcctgtgatccatctgtttgcctgcctctttatttttctggagttatgtggacactaatatatgacactatttatgcccatcaggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagaaatggggtcttgagattttgcccaggctggtctgaaattcctggcttcaagcaatcttcctgccctggtctcccaaaagtgctgggattaccagtgtgagctaccaaccccagccaagtttacactctagacatccacagacctgaggattgttggaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatgggaccaaacaaancnaancnanaacaacannaaaacanaaancaaaaaacnnnacaaacagacacgcggcacgacgacgcaccaccacgaccagcccccccctaccacgcccacgaccacctcccgagaccccccccgacagaccaaccccggcccccgcagcgcaagagacgactacacaacgagccgccgaccaccagcacacacacgccgcgcacgcacaaaagacac

SEQ ID NO: 641170 - DNA, 473 bp, Homo sapiens
tcattcaataagtgtttgtaatattggtatacaagaaaccagaataaacactaactatttaacaatagggactgaaaagataatttgatagagaaattgtattttatgactacttcagttcatatcagccatcaacacttactcactcctttcagtccttcttggtcaaacccggctgcggttttgtacaacttacaaatgctgaatcacctggtcccacatcacagttgcaaggcccctttctattctcaaatcaaatgccctggctttaggcagcagctatatgctataatctaccttatgtctatctccagctgtgcctggaattagctgagtaaccaaatgactacttgacctctctacgattgtctaaaagacagttcaattttcaagtacaaaataaaactcttggctggcacagtggctcgagcctataatcccagcactttgggaggcccaggcgggtgcaccac

SEQ ID NO: 641171 - DNA, 1766 bp, Homo sapiens
  misc_feature (1548)..(1548): n is a, c, g, or t
  misc_feature (1550)..(1550): n is a, c, g, or t
  misc_feature (1553)..(1553): n is a, c, g, or t
  misc_feature (1555)..(1555): n is a, c, g, or t
  misc_feature (1557)..(1557): n is a, c, g, or t
  misc_feature (1565)..(1566): n is a, c, g, or t
  misc_feature (1573)..(1573): n is a, c, g, or t
  misc_feature (1577)..(1577): n is a, c, g, or t
  misc_feature (1586)..(1588): n is a, c, g, or t
ggccggggaatgacgtcaatccgagctcgtcccggcctcaccagcgccatgctgggctcgcgagccgcggggttcgcgcggggcctgcgggctttggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggcttgacatttaattggggagcgttacttggatggtctgctatcaagggttcctgtgatccatctgtttgcctgcctctttatttttctggagttatgtggacactaatatatgacactatttatgcccatcaggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagatttacactctagacatccacagacctgaggattgttggaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatgggaccaaacaaancnaancnanaacaacannaaaacanaaancaaaaaacnnnacaaacagacacgcggcacgacgacgcaccaccacgaccagcccccccctaccacgcccacgaccacctcccgagaccccccccgacagaccaaccccggcccccgcagcgcaagagacgactacacaacgagccgccgaccaccagcacacacacgccgcgcacgcacaaaagacac

SEQ ID NO: 641172 - DNA, 390 bp, Homo sapiens
  misc_feature (3)..(3): n is a, c, g, or t
  misc_feature (26)..(26): n is a, c, g, or t
  misc_feature (83)..(83): n is a, c, g, or t
  misc_feature (385)..(385): n is a, c, g, or t
canccaaaaatttttggccaattgtnccctttgggtcacacctaatcaccttctgctgtaatgtccctctgtagctttgccanagttctgttcaaatggcctcagtatgtagaggactggaagcatgcagcccaactaagcatggctacttcagtgtaaaattaacactgagttacaaactgaagtggtaatgttaaaatccatggttctgtggttaggggaacaagtacaaagcttacagtaccaacagcaattgcactgtcattttaatcacactcatatttgtgtaaccaacttagaatataaccaaagagtatccatgggaccttgtaaaagcccatttgcagggagcttccacatccaacatcacctttgacataggttnattac

SEQ ID NO: 641173 - DNA, 267 bp, Homo sapiens
caccgttagattggcatcataggaggcctcagtgcagtagatttcccctattctcaggctagaccctagaccaaacctagcgccaagagatccagtttcactatcatattcatcggcgtaaatctagagctgtttcttcccacaacactttctcgggcctatccggcaatgccccggacggttactcgggactaccccgcatgcatacaccacatggaaacatcctatcatctgtaggtctacctggccaggtagacctagcatcac

SEQ ID NO: 641174 - DNA, 1273 bp, Homo sapiens
ggccggggaatgacgtcaatccgagctcgtcccggcctcaccagcgccatgctgggctcgcgagccgcggggttcgcgcggggcctgcgggctttggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggcttgacatttaattggggagcgttacttggatggtctgctatcaagggttcctgtgatccatctgtttgcctgcctctttatttttctggagttatgtggacactaatatatgacactatttatgcccatcaggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagatttacactctagacatccacagacctgaggattgttggaataaatttatctccaaccgaacactgggactaatagtttttttagggattgtccttgggaatttgtggaaagaaaggagacggcaacaagaggtttgaaataactgcaactttgggtggcgttctctggattttaacactttttccaattattgttgggtccaactgtcattggataaacggagaggatagggatttcggggttttggaaaaccctggaaaaggcttttgggga

SEQ ID NO: 641175 - DNA, 426 bp, Homo sapiens
tttcgcaggagggtatataaagaggaatgatcatggacgagggatgatgcagggacactctggtgtccaaataacggaaatcctcaagttacatcaggggacaaaccaggatgggtgagtgtgcgttggagcatgtgcgaacgtgatcctgatgtgtgcaagcagggggtggagtgagctgcatgttagaccctctcgtcctaatgtcatgtcgagcacagccgaaaatgatatctccagatgggcagtgagtcaacttcttctctcatagggtaagtggctatggatgcggagaagggtgtggtgttgtcctgctgaaacctctaaggaaggtcagtcaacttaaaaatcagtctggagtggttctctgatcagctacaggcagctttctgtacccatggcttcttcatccatggattcaactaa

SEQ ID NO: 641176 - DNA, 1424 bp, Homo sapiens
atagaagagacttatcacctttcatgatacacgccctcataatcattttccttatctgcttcctagctcctgtatgcccttttcctaacactcacaacaaacactaacataatactaacatctcacgacgctcaggaaatagaacacgtctgcaactatcctgcccgcccatcatcctagctcctcatcgccctcccactccctacgcactcctttaccataacagcacgacgtcacacgatccctcccttaccactcactatcacactcgcgcacaccaacgcctactgcaacctaccacctacaccgcactacccccgcgcacctaactccttccaacctccctacactacctccccctcactcacttccctcgcacccccacgcgcgcacactcccgcacatcccttgcaccctccaccacctcgcagtactacctccccgacacgacacacccccactctccctactccctcacttaccctcacccccgcacccgtcatcgccaccctccatgcacccccgccccctcacccactccccgcctccccaccacaccctgcccactcccgcccccctctccccccacaaacccccctccacccgcctacacccaccacggcacccctattactcaccagctccacaccgctctgccacaatcactgtgcccacccaccccaccacttcccatctcctccctcgctccctctcactccactacccgctcacacccacctctctcgccaacataccgcaccccctcctttccccactaactccaccacccacccacaccacaaccccctcatcctcagagccccccctcctcacccctctcccccctccaccccccaacaccgcgcgccccgctcgacgcccacagccatacacactcccacgcgcccccccccccatcacactacatctacacaccctgccacccacagcgcgcaccacaccaccaccgacacagcccacaaacaccaccacccccacgcgccacaacactcacccactcctccctccccacacttgtacatacacacctaactcctggccactacccctctcacccccactactcccctcccctcaccatcataactccacccgcccacctccactctcccaccaatttccctctcactacccctcaccccttctctctccctatccccactccccactactccatccactcccaccctccttcctccctctctttcactctccacatccactccctaccccaccacctcaccacacccccaccccccacccacacaccaccaccccctcgcacacccactctcccacccaccctacacccctccccccccctcctcccccacaccacctcaccctcacacctcctccctcgcatcccccctacccatcccactctcccctccccctccccg

SEQ ID NO: 641177 - DNA, 1404 bp, Homo sapiens
ggccggggaatgacgtcaatccgagctcgtcccggcctcaccagcgccatgctgggctcgcgagccgcggggttcgcgcggggcctgcgggctttggcactggcgtggctgccgggctggcggggccgctccttcgccctggcgcgtgcggcaggcgcgccccacggtggtgacttgcagccccccgcctgtcccgagccgcgcgggcgccagctcagtttgtccgcggcggcggtggtggactctgcgccccgccccctgcagccgtacttgcgcctcatgcggttggacaagcccattggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggttacaagaacagccaatcgtccaatagccgctggagacatttcaacttttcagtcctttgtttttcttgggggacagctaaccctggcactgggtgttcttctgtgtctaaattactacagtatagctctgggagcaggatccttacttcttgtcatcacctacccactaatgaaaagaatttcatactggcctcaactagccttgggacaaaagagatgatgttttgattggtcttaagtcaacggctctgcggttcggagaaaataccaagccgtggctcagcggcttcagtgttgcaatgctgggggcactgagcctagtgggtgtgaacagtggacagactgctccctactacgctgccctgggtgctgtaggagcccatctgactcaccagatttacactctagacatccacagacctgaggattgttggaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatggga

SEQ ID NO: 641178 - DNA, 395 bp, Homo sapiens
caagataaactttgatgacaacgcaaaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggggtaaaggaagctcaaatatattaagcattaaaatgctcacagttgatcctaagttgaagccattcttgtaaatatattgggggggattcgcaactgtgccatcattgccaatgggatcaccaaagcctgccggcagctagaactcaaggtggcccttggt

SEQ ID NO: 641179 - DNA, 1305 bp, Homo sapiens
  misc_feature (324)..(324): n is a, c, g, or t
  misc_feature (412)..(412): n is a, c, g, or t
  misc_feature (427)..(427): n is a, c, g, or t
  misc_feature (433)..(433): n is a, c, g, or t
  misc_feature (440)..(440): n is a, c, g, or t
  misc_feature (447)..(447): n is a, c, g, or t
  misc_feature (978)..(978): n is a, c, g, or t
atccaactccaccttaatatcagacaaccttagctcaataccatttagccatagataaaggtatacggcgagtagaaattcgaaagcctggtgcatattagaatactaaggtactggcgcaagggcaagaggatgacattacatgagtaaccgaacgcatatctatagcagaggacttaatccccgtactaccgttctgcgataatgaatcttaacttagaagataacttatcgcataggtagagcgcgaagaggcttagggaccacccgaaatagctatgcacgcatgacttaacctagagtagaccagctgaataatggagncgatatccgtgctcattgtaagcaacattaagtcgggcaggaattctattagcgtcacgcagcgtccgtaccataaactcctatcgcngacggccattgcgtntgcttnatgctgnggtgatngttgccagagagactacgagacttcattgagtggttgccaacctgttcataactctctgcgcccatcaaggaaagcgcgcatcttaaatatccccactctgtgagaaactctctacaccgtggtgtaacgttcacacacagtagggtaccaccacgtcttacctattgcgtgaagcccacgtgatggtacatacaaatactcattggtttaaggaggaggcaggttacacaaatatatctttacgccacccaccaatagtatcggacctataaaaagcccaggcgcatgccaaatttaaagcaaaaagcaggtttacaaacggcttcccacatcatatcccgatcttaggcctttacagatacacatttccctctaaaaacggatttatttaaaactggaaattcttctcgtctcaataattcctaaatttggggtgaccctaaatcctggaatcgaagcccttcattctgaataggcaaacttaaattggtggcagctgataaggtctaaccacttgacaaaaccatttnctttccgtaccgggcagttaaggggaccgttgtgcgggttacgaaaaactttcaaaaataaccctaattgggaacaagctgtgcgaccctataattttaaacccgaggtgcccacaaattaatgttctctcaacccccacttgccaaaagcgcaaaacactagagtttcccttttaattttacacccccttacaaagttggttcgcaagagccccaaaattactcacgacacacatgtggtcttgcatactaaaactcaaacaacacataccaccaggatagaaacaaaacgtgacacccatacaggccatacacataacaaggtag

SEQ ID NO: 641180 - DNA, 850 bp, Homo sapiens
ggttacagaggattggcttgtccagaaccatcaggacccgtgtaaggtagaggaggtgtgcatagccaatgagccctgcacaagctttgcagagtgtgtgtgtgatgaagaatgtgagaaggaggctcggtataagtggcttctgagagaaagaaggaaaaggataaacacatgggatgcctgtggaacccaatacctgagcctgagtaaaagcgataaagattccctgaatatgtggctctgtcctagagaaaatgaagtacatagaacaaactaaagcaccaagaggcaatgactccttctagaattgctgattccttccaagtcataaagaacagcccttgtcggagtggcttatcaggcccccatacaaagaaggaagtcccagaggtaagtgcctggtactgaagacatgagctggcaaacaagaagtttagaagccccatgaatacttcctggttgttcctttaacaacagctgactgggtcctgtcaggaaagaagatgggcaaggctcagccagttatcttcgtggagagggacaagtggctgcttcgaaaagaaggcccagggaagtattacttaatgcacacctccctaccaggagggaaccataaacttccccccagaccattatggctccctgaagttggtgatctctttgcctgtatgcagcttaagttgatacaagagacagtggtttgatcgaactcctctagggattgttgacggcatggccagagtgagcagcttctgctgatttcaaccatcagagtggaggatgcggtggcaaaccttgggtacgggctgacaataggtaggatccctgcaaataaattaagaaatggtcc

SEQ ID NO: 641181 - DNA, 273 bp, Homo sapiens
agcctcgagtggcctggctgaccactaccgcacagaggccgtgtcgcgcctgggctgggcctgggtggcctctgattctttgccatctctgaagaaaggaagtcgggtgggtaacggttggggtcaggaagaattctgccaagtaatctttactgtcattctgaaccatagcctctttgttcccgcattcgaaacttttggttcttaactttgctgctcgtttagtccctggggatttcagaatcttaggctgttgtttcaccgtatgggaag

SEQ ID NO: 641182 - DNA, 131 bp, Homo sapiens
ttcctggagagagatgagagtgagcaagagagagggagggagagagacagagagagagagagagagagaggtatagagagcattgatatggggtctactatattccccccggggccccattcccatattat

SEQ ID NO: 641183 - DNA, 787 bp, Homo sapiens
ttacaattcggcctcctaaaatttggcggagaaaataagggtctcaattttaggggaggttttttccgggtgtggttagcgttcgtctcccaagaggtccccaattgtcactaatcaatgaatagtttctcagttctagtgaaagtgggcccatattcgtggtacgtcttaagcccaagatatttcttgtgcatagattgacacacggcgggtctcaaccagttatgtgcgtagcttgatagctctcacctaggctcataatctccattttatgcagggaatcagtgggctccggggtcatggttccccagcagtgtatgttaattagcacagtgttctcaggagttcattcatgcctctgtggccatcctagttgacaaatgcacgctcttcgggttggagtaactgtctctaatacattattgcacctgctagcagtgtgatctcgggtcccaaggcttcgccatagccgttcaagcgcgatgtgggtcttcccgccgcttttgaaaagcagggccactgggcttagtatagggagacctgctatggctagggaggtatgaagcttttttcaacgagacaaagtccgttcggagtatgcccccccatttaaaagcatccccgcattcctgttctttcgcccaggctgaagtgcagtcggaacgctctcggctctgttgcttagttttggtcggagtaaaaccgcctccccgttgaagcaacaggtttcagtgagctcagttcgcccatttatcctgcggcctgggcaatagagtggggctccatc

SEQ ID NO: 641184 - DNA, 1510 bp, Homo sapiens
  misc_feature (977)..(977): n is a, c, g, or t
actctgcaatactctgcttgtcgtttgatgggtgtgctctctctttctgtgatcttattctggtttctttctctctttctaagttgtttctccacattagtcaagaggggtcctcacgggggggcccacacgattgtgtggggcctacatttttagatatttagagagggacttgttctgttttgttctcgctggggtgaattttttgggggggtacccaatggattgtgtttccatgcctttttttgtagggggggttcttctctcctgtagtggcccttgttttggggtcccctctcgtgcccacgccttgttattgtccctctcgggggtatcagtggtccccgtggtggtctcgtggccccgtgtgctcccctcctaccgtttgtggttccccccccccgtttttctttcggggagcggatgcggcccaactgttaggggtctacatctgtgtttttgcgttggatatcctatctcctcggggttgtttgttggtgagcttgtccacatgggtggttccgcctttggcgttcccccccctctgcgcacaccagaggtttgttttggccccgcgcggtgttctccccttataggagggcttcttcagacacttttggtggccccccggtggtctcagtgagaacgcgacagtgcacatttgataattattgtgtttgggggtatgcccccctctattttgggggggtctcctgtctgtttttgtgtgagcgcacatttaggtcccccccaggcgcgtgttttgttttttgtgccagcctccccactgttctcctgtggtcgacagtgtcgtcactgtagattctcctctcgccacggtgtctctctatatagtcctcctattagtcgccctcgtggggacaccttttttgtgacccgcacaccctctctttgtgaaagagaacacacattagaggcgcaccgcacacaccggtgttacactctcacacactccnctgtgagagagatatctctgtgtggagacattagatctctgcgtccatactccccagagagagagtctcacactgtgcgacacactagagtgtctcacactctctagagatagactctctgtgtgcacacacactccccagagtcgcatattgtcttgtgtatcctctcttctctctctctgtgcccctgtgtgggttctctctgtgggataagactgtgttctgtcgtgtgtctcacacaccccaggagaccctaagagaaatggcaccccgctctttttgaaaaagttgacgaagaatagtatatctctttcttggcccctcggccacttcttcgcggaaagacttggtggccataccctcgtgaagagggtttatatactcccctttgtggagatcttggtggggaagaggaagaggtatatagaattgttatttaaaaaaacaacggtatataagccaaatatctataaataatatgaccccagaaattaatctatgagaaatctatctacccaaaaagaaaaaaaaaa

SEQ ID NO: 641185 - DNA, 174 bp, Homo sapiens
gacaccctgtattaaacaacaaaacaaaacaaacatgacacaccaaacatcatccacgtcgtgattataagcattctctgcccaatctattaccaagcataagcatcaacttcaacgttgcctctgctcaaagcagtaatccgtctaaagcggaagcgctctccttttcctttc

SEQ ID NO: 641186 - DNA, 214 bp, Homo sapiens
gccaggctgtccgcgccgccgctgtaggtcctttatcctgaacgggctcgcgggctgccggcggcgacagcagcagctcggggcccgggtgggcagtcggcttcctgctgcagggtgtggtgctgatcggcttgctctatgatcgttggtgcagttacggtgacgacgtctcaacctaagtctgtcgccagcgtccgggccgtgggtgactacg

SEQ ID NO: 641187 - DNA, 226 bp, Homo sapiens
  misc_feature (149)..(149): n is a, c, g, or t
gctaccctggatagacaacagttacagttttgagcctggagatgcttcttcctcttagcacaccactgcatccaacattttaacaaaaggccagaagaattctctgatcctgagtagctgggactataggcgcacgccaccatacccanactactttttttttttggaaagtgagttcccctcttgttggccacggccggaagttgaagtgggttttgaatttggg

SEQ ID NO: 641188 - DNA, 183 bp, Homo sapiens
cccgcaggcaccccgccgtgaggtgcgtccggaacattaagagcatgctgagtgctggcagatgagctcatcaatgctgccagggctacctcgaactcctatgccatttaagaagaaggacgagctgtatggtgtggcccagtccaagctgttgattttcccagctgctactgttgtgagtgg

SEQ ID NO: 641189 - DNA, 128 bp, Homo sapiens
  misc_feature (125)..(125): n is a, c, g, or t
atgagggccggcatgctgacccacgccgaggcttgcgttttcccggaggacgtggactgttgtgagacaagaggcggctccccagcctgggtttccatgtgacccccagtggggctggaccaggnccc

SEQ ID NO: 641190 - DNA, 379 bp, Homo sapiens
agccctgacagtaagtagaattatggtgagtataaagaggggggcagcacattggcagccctcatgagtgcagggcccgaaacttgtccagagtggccacgactggggatgtacttgaccccacagccatctgggatgagccgctattaagccaccatgtcttcaaatacatcagcattgaacttggtgaagccccacttctttgagatgtggatcttctggcggccaggaaacttgaacttggccctgcgcagggcctcaaatcacatgctccttgttctgcagcttggtcgcgctggacatgataccttggccattgtgaaccctggccacggtgccctggggcttgccaaaggcccctcgcatgcctatttgaagc

SEQ ID NO: 641191 - DNA, 369 bp, Homo sapiens
gacgttcgcaccactgcactccagacccggatgacagagcgaggctctgtctcaaataagtaagtaagtatgtacgtacatacatacatacatacatacatacatacatacatatatacatacagtacatacatacatcacagtgtacgtgaagcatagtgcctgtctcagaatcttccattactatgtttattcatttcctggggctgccataacaaagtaccacaaattcagtgacttaaacacaacagaaatgtattctctcacagttctggaagtatctagaagcctgaagtcagggtgtccacagggccatgcttctcctgaaggctctagagagtacctttcttggcctctcctagttaccta

SEQ ID NO: 641192 - DNA, 348 bp, Homo sapiens
ttgcccacgactcgatacattgctgtgagaatcgaatgaaatattagttctgaaaccacctggtgtggaccgggtgcagtggctcacagttctaatcccaagcactctgggaggccaaggcaggtggattgcttgagctcaggagatggagatcagcctgggcaacaacagcctgggtgacactctgtctctacaaaaaattagctgggtgtggcggtgtgtgcctgtagtcccagcgactcagtaggctgaggtgggaggatggcttgggtccaggcgcacaaggctgccgtgaaccttgatcacaccactgcacttcagcctgggtgagagaaagaccatgtctca

SEQ ID NO: 641193 - DNA, 507 bp, Homo sapiens
gatatgcgtctcatagtttacatgtattcttgcctattctacctgtatctcttcctcctctctcattcttacctggctctataactctcatcgaagcggacaagggttaggtatgttccccaaagagtgtagggcttctgagtaagaggttaacatggagctgcaattatagaacctgatagctctgtcctgagacctagccagtccctcacctgccttctctctagaaagtgaggttctgaagccagccatcccatcactgatcttagctgtttcctgaataggcagctttaatataagctcaataatgccacaatactaaccaaaactggtacttcgaaaaatctgcagctgggcgcggtggctcacgcccgtaatcccagcactttgggaggtcgaagtgggcagatcacctgaggtcaggagttccagacctgcctgaccaatatgatgaaacccctctctactaaaaacacaaaattagctaggcatggtgacaggtgcctg

SEQ ID NO: 641194 - DNA, 305 bp, Homo sapiens
tacctgattactcttcatagctacttgagaattggaaatcgcctgaacccagaggcggaggttgcagggagggagactgcaccactgcacttcagcctgggtgacagagggagactctgtcttaaaaaaaaaaaaaaatcttctgtaaaataaattccgggatagtcttttggttcaaggaaatgttttgtaatttgacctcaccctatttaatctttattgtccttatcctgaatgtataaataccagcaggttataattacaccaagacgctatagtttataaattattggcattgaagttga

SEQ ID NO: 641195 - DNA, 301 bp, Homo sapiens
  misc_feature (10)..(10): n is a, c, g, or t
gcttttcaantgctgggattaccaggcatcagccactatgccggctgggatcatatgttccacacatgtttgttcaataagcatggactgcaaccacctacatgaatattcatagctcctcctgtagcctgttgaatatgtatgtttagccaacctcttcagcataaagctcctgcccaaacccctcctgctcctaaatgtctgtctctggtgttaaccagaggctgctcttcccaggctgctggatggctaccttgcaggctgtcacccttaacaagaaataaagtgtcctttcaaatgc

SEQ ID NO: 641196 - DNA, 305 bp, Homo sapiens
cgtcgtacggaaatagtaaaagtacaatacttatcagtagactgtaataagtcgatgatacatgttgtaatctttatgacaatcactaccgacgactaagatgtcaggcgatatgaaacaatacaacccacttataagagatgtatcttaactgtaagaatacagaaatgttgaaagtcgaagaatacacaaatgctttagccacactagcactaatcaacagaaaactgatgtcagacaaactagattttaagaccagaagtatcagctgtggcgcagtggctcaccgccgtgtaatcccaaaa

SEQ ID NO: 641197 - DNA, 412 bp, Homo sapiens
ccgagacccgctccagctgatggcatggccactgtcttgcttatctccaagacgtacataaccaaatagcgcttgaaggaccgccagcagctctccaagctgatcattactcagctgctatatgaccgctacatgagaatctccgaggggcccatcaatgagatcaagccttagactgagtgtgctcactcggagcagactctgcatatcatcacactagggagagtgtgaacacaaatccatactgcccatgcggaggaatggcaaacgatgacaccatactctagtatgaatatggactatcagatactggagacattggctcagctaacgacctgctatgatccagatcgtcacactatgcactcagaggctattgagtacgcatactatgtacgtcacatgtaggcct

SEQ ID NO: 641198 - DNA, 992 bp, Homo sapiens
agaatgtaaatcagccctatccataatatagtttctctaaaactttatcttaaagagtcattttaaaataatataactattaaaaatgtaactgatatttaaatgttttgaaataaaacattttaaaatataaatactgtagtttaaaagaaagaaactgggggaaagaaaagtagagaaagaaataccaattccagtccaaagctttatttgccaggttttcttagaatgacttttaccagtttatgaattcttgtaaacagaatctataatggaaatactgaaagacttttgcctaaagtggcattattgaatgctgctgtgatgctactgtaatgtaataaattattaaattgttgcaaagtgctgtttttgccttaaaattttattttgtgtgtcttgaaaattatagtattaaaggtattgagattgtgcaaatgctgggcacgcttggcatgagataatctgtttttatttttacaaaattgtaatataactatgcaagtgtgtttattaaaagaacacaaactataaaaaaaaaaaacaaaaaaaaaaaaaaaactttttgggccgcccgggccccggaaaaaagtttctcaaaaccctccgtggggggccgggccccaagggtaggggacacgggcccaagcgggtcccaaggaaaacccgggccgaaccagggcgcggttctcccaccaataaaaaaagcccgcggggcgcaccacgaagggtctcggaccaatacgcagaaggggctaccgggagcgccccacggcgcgttctatccacggggagccccagcggagaacgaaaaaactgacgcggccgggcagagtaaaaacacccacaacacaacaacaccaacacagcacacaccacgaccaccacacgacacgacgacaacaacacaccacacacactaacacaccacacacaccgagacccacgaccacacacccacaacaaccagaacacaacccaccacacacaca

SEQ ID NO: 641199 - DNA, 279 bp, Homo sapiens
aattgtcgtgcacctcacagggaggctcaacaagtgtggggtgctccgccccaggatatgccgtgcacctcaaagagctggaaaaatggcagactcatctgcttccatcccgccagtaaggttacattgtactgacaacctcagctggcatcatggcccatgcaagcaagcaagcagaaaacacacaggagggaaaatcctgggcatctttaaatcaaggcatgtaatacatcatattaacaaatacaaatgcctccatcagagatagttgagtaccga

SEQ ID NO: 641200 - DNA, 579 bp, Homo sapiens
ctatatagcatacttgaggtgatcataatagacttcttcaatggcttgaaagtatataacgtcctatcactttagttatcatgctatgtatagcataataagagaatgtacgcttgttccgatcaagaacaaaacaacgttttttccacgattttaattattcccacccattgtgatgaggaatcctcggcaggtcttctctgtgattgatacatggtaacaggtgtcaatatagtggccagcagtctctacatggctccgcaaatcaaagtcttccttccggacaggcaggtagcgtgtcaaaggacgagcctgtgccctttgtctctcccttatttttacttccttttctattaacttctgcctctggctagtttcttccatgtaatcgttttaccaggatttcccggcgtcgtttttcttcttccagggctcgtttttaggcttccatttcccgttccctggattcgagcagccgcgtctttactgcatgagcctgctacaaaagtctctccatttcttctattctagcaatctttgaagtgctggcactagagatgttgtctggtgagcacgcag

SEQ ID NO: 641201 - DNA, 931 bp, Homo sapiens
tacagtaggcatcacagcagcattcaataatgccactttagggcaaaagtctttcagtatttccaattataaatactgtagtttaaaagaaagaaactgggggaaagaaaagtagagaaagaaataccaattccagtccaaagctttatttgccaggttttcttagaatgacttttaccagtttatgaattcttgtaaacagaatctataatggaaatactgaaagacttttgcctaaagtggcattattgaatgctgctgtgatgctactgtaatgtaataaattattaaattgttgcaaagtgctgtttttgccttaaaattttattttgtgtgtcttgaaaattatagtattaaaggtattgagattgtgcaaatgctgggcacgcttggcatgagataatctgtttttatttttacaaaattgtaatataactatgcaagtgtgtttattaaaagaacacaaactataaaaaaaaaaaacaaaaaaaaaaaaaaaactttttgggccgcccgggccccggaaaaaagtttctcaaaaccctccgtggggggccgggccccaagggtaggggacacgggcccaagcgggtcccaaggaaaacccgggccgaaccagggcgcggttctcccaccaataaaaaaagcccgcggggcgcaccacgaagggtctcggaccaatacgcagaaggggctaccgggagcgccccacggcgcgttctatccacggggagccccagcggagaacgaaaaaactgacgcggccgggcagagtaaaaacacccacaacacaacaacaccaacacagcacacaccacgaccaccacacgacacgacgacaacaacacaccacacacactaacacaccacacacaccgagacccacgaccacacacccacaacaaccagaacacaacccaccacacacaca

SEQ ID NO: 641202 - DNA, 423 bp, Homo sapiens
  misc_feature (183)..(183): n is a, c, g, or t
  misc_feature (331)..(331): n is a, c, g, or t
  misc_feature (384)..(384): n is a, c, g, or t
  misc_feature (406)..(406): n is a, c, g, or t
tgagaaggagtctcgctccttcgtctaggctggagtgcagtggtgtgatctcggctcactgcaacctccgcctcccgggttcaagcgattctcctgcctcagcctcctgtagctgcgattacaggcatgcaccaccacacctggctaatttttgtatttttagtagagatggggtttcaccangttggtcaggatggtctcaaactcctgactttgtgatccacccaccttagccttccaaagtgctgggattacaggcatgagccacttgcgcccagcctgtattgctcttaccttaacaaaagaaaccaaaagtgaaagaactaataanatgcctagaggttacaaaaaactgacagaagtcaaactgtgagtatagatcantctggttctcaccaaaaacgtnagccccagtagttcata

SEQ ID NO: 641203 - DNA, 1762 bp, Homo sapiens
ctgggacaccccgtgtgtggcagtgcggcgaagctgctctggagaataccgtgacatgccctgctccctgcagccagtgtgtagtattcgggatgccactgggtgccaaagtgatgacgtccatgctggtcttccatgctgctatggtgccactggctgtgctggcccctgtggagcacgatggtgcgatgctgacccctacttaccgctaaacgatgaacaggctggggctttgtgccttggccccttgccttacttgcgtgctggctcctgcccttggcgcaaccctgaccatggcgcttcgggcagccgaggccaagcgaatcttaccaactagctggcaagccatagcaatggggaactcgtaggctgtgcactgaacctacgcacacttgcgcgacacactatgccgccatgcgcttgcgcaaccccctacactgacactgcaccccaacgtctcaaccgaacttcggcgcacttcctctcatcccaggaaatccaaattctcagctgaatcttgtggccaaggcaccacggttcctaccgcttgcgcttgagcacggggcttagcaccggttgctctcatagcgttggatatcacccccccgacacgaccgaagacggctaaaggccatccgacccttcagtggggcccctatttcgcggcaccttgcagacactttccggcgaaccgcttgggcttctcacgagcaccacacggggaaaccccgatctggcggcgcttttatccactttacgcgcaaaactcaccttggcacaccgcaagacatacaactaatggaacctatacgagccagaaaagaaaaccagagcgaacttcttcaggccgtacctacctatggcataaccgtttcccaaatcttaattcttcggcggccacactccgcgcaagaccgcggccggtagggcccagcacgccggccaccatctctgagctttacctccctcgccccgcctaaacgatatgtcgcagaacaccttcactgtacgcagtactatctcacctcgattgagggcacgcaactttggtctccacaccgacttcctccccttatataaagaacacattacagccactctcatatcactggacccatcctcacaatccctattcggaccactggtactctatactccgatcacacctctcaactcggggcctactacaccgcctcgcaccatcgcacgcccccagcgccgcgctacacacgacactttcccaccattgtgcacgagctatccacaacgttctcacatcacccccccatactctaccctatcctccacagcctacatcttccgctacgccacatttagctaacccatcgtcaccatctcactatctcaacacactctggcgcataagacaccgcaccccttatgaccacgcgccactatatcttagccccaccatgcccacacaaaaacaccacactttccccagcctcatcacccagacacacaccctccccttgcaaccggctcttcctggcacaacacccacctatatacacaacatagctctatataccacgccccacacctgctgacacccacacacccctcccacccagccacccaacttttacccgcctcacctcctcacaccatcacaccatccaaatctacctaacaacctaaaccacgcaatcctcaccacaccacatctctctacccacacaccaactactcctcctccccattcgctctcctaacgaacaacctccttctcctacaccat

SEQ ID NO: 641204 - DNA, 89 bp, Homo sapiens
ggaatcatgtttgcttacttttagaatggaacggaaagtatcttaaagctgtctcaatagtgtgggtctttgtacatttcaaaaggatc

SEQ ID NO: 641205 - DNA, 128 bp, Homo sapiens
  misc_feature (27)..(27): n is a, c, g, or t
ttccccccccccggggggggggggggngggggttcccccgggggggggttttttccccccccccgggtttccccccctttttccggggctttttggaccccccttttttttttttttttcccccccga

SEQ ID NO: 641206 - DNA, 336 bp, Homo sapiens
  misc_feature (123)..(123): n is a, c, g, or t
cggcgggactgtctagtttacagattgctcttatgacgcgtcaaaggaaccagtgtcaggagtcgttctgaccactgatctctactacacaaggaaatagttaggagaacgctttactgtttntgaaaatacagtttcacctgtcagttacaagaatgctgtgccataaaaggtttctcccacttgaagtctactctgatgggatctcagatctttgtcactgctatagacttgtagctgctgtctctctttgtccctgcagagaatcacgtcctggaactgcatgttcttgcgactcttgggacttcatcttaacttctcgccgcccaaacacag

SEQ ID NO: 641207 - DNA, 921 bp, Homo sapiens
cagcgggaagacatagctgcgggtggctgtgctggtggcgtcaagatgtcgaccaagaatatccgagtcagtgacggggactggatttgccctgacaaaaaatgtggaaatgtaaacttggctagaagaaccagtgtaatcgatgtggtcgggagaaaaaaatgaggccaagatgatgaaagctgggggcactgaaataggaaagaaactttgcagaaaagagcgaggcctatttagtgctaatgatggaagtgtaaacacttgcagcactgtgactgtggccagaagatcagagtgtatatgtgtaatactccaaagtatgctaaattagaagaaagaccaggatatggtggtggtttacaatgacgagagcaaacctgtcgcaatatcttagcaaggagaagcaatctgatgggtgaatatgcatgagtttggaaaaacacaacacaagaaaaaaaacacaaaaatttgtgggagcgcttggcctccgaaaaacaggtttttagaacactttgttgtggagggggggacacaaatatggatacggaaaagtgggccacaaggggtgtcaaagaaaaccgtggacataaaaaagggttgggtttctccccaaaaaaaaaaccgccggaggaacacagggggttctggaaacaatcccagaggaggttcggaagggacttagccggccaccaaaacggggcccagggggccggaaaaaatacgcccgcgaggcgggagaagaacagaacaacacaccaaaacaacagaagcgagaaacccagaagaaggacatatcagcctaacagcagaccagaaccagccagagcatcatcaatacaaaacacagcaacgcaaatacaagaaacaaacaagaatcaaacgacaagcgaaacaacaaagaacacaacacacaaaagaaaa

SEQ ID NO: 641208 - DNA, 461 bp, Homo sapiens
aatagttgaatacacggtgagagaaacttgtaatacttgtaaaatagaccgctggggccggatgaaagatgaggcgtaaatagtactgatagatttgttaaagaacgaaataacggcagctaaggacttggtaaaaaatgacatagtgcgcggtgcgacggcagagctggcgttggggcgagggcgaccaacaaatatgaatggtataaagcacgcgtgtacggaaggaatggtaaccccgtgacgtgaaggagctactggtgccatgatccagcagggcattaatggtactacagacagtattgacgtttagacgcatacgtttacaaagtgtggctgggcggagctaaataacactgccttgtgaatgtacagcgaggatacgctagggcttgcctgtaaccttaacaagaggcagattactattttgaggatgtgggatgtgattttgcttattatgc

SEQ ID NO: 641209 - DNA, 221 bp, Homo sapiens
  misc_feature (9)..(9): n is a, c, g, or t
gaggagatngtttgaaccaggaggtggaggttgagggagctgagtgacactgcactccagcctagcaacagagtaagatccatcttaaaaaaaaaaaaaaatccgggtatttcttctagagtgtgcttgtgtgtgaatatctgtatatgcctaagtgtgtgtactgagtcaggactgagaaccgttgctcaaggccagccagggggggtaccgaggtcgaa

SEQ ID NO: 641210 - DNA, 303 bp, Homo sapiens
ttttaaaaggggggggttttttttttttccccccccccgggggaaaaaaaaaaaaagggggggcccccttttttttccccccccccgggtttttttttgaaaaggaaaaaaattttaagcccccccctttttttttgggggggccccgggggttttttggggggggggggttttttttaaacccccccggggggggcccggggggtttttttttgcggggttggggtttttcccccccccccccccttttttttttttttttcccctcccaaaggggggcaaaaaaaggggttttttttttta

SEQ ID NO: 641211 - DNA, 343 bp, Homo sapiens
tctttcctctagatggtggagtacagagaagatatcaggtgagcccttagccccagcctcctcacaccctgatcctggaattggtcaccattggaaatctgacaaagggagggggagtaacaatcattatagagtcacgaaaatcccaacagtggcacgccaaacacacagcttccacttcaggaacatcaaacatccgtagaaaatacctgcatgttccattgggcctttaagtgaggagacttacagtatgtatgctaagattccagtccagtctttcacaaaaatgtgggtgcccctttggaatggggagttcaaagctctgagggcgattagggttagt

SEQ ID NO: 641212 - DNA, 107 bp, Homo sapiens
gttaaatgcgcaggtacagggtgtgaagcatacaaccctacaaagctcactgccctcatggacgattacacgctaattgggtgagacaaatgacacacattaataca

SEQ ID NO: 641213 - DNA, 661 bp, Homo sapiens
  misc_feature (17)..(17): n is a, c, g, or t
  misc_feature (329)..(329): n is a, c, g, or t
  misc_feature (333)..(333): n is a, c, g, or t
  misc_feature (372)..(372): n is a, c, g, or t
  misc_feature (391)..(391): n is a, c, g, or t
  misc_feature (434)..(434): n is a, c, g, or t
  misc_feature (443)..(443): n is a, c, g, or t
  misc_feature (452)..(452): n is a, c, g, or t
  misc_feature (475)..(475): n is a, c, g, or t
  misc_feature (521)..(521): n is a, c, g, or t
  misc_feature (525)..(525): n is a, c, g, or t
  misc_feature (573)..(573): n is a, c, g, or t
  misc_feature (583)..(583): n is a, c, g, or t
  misc_feature (602)..(602): n is a, c, g, or t
  misc_feature (609)..(609): n is a, c, g, or t
  misc_feature (626)..(626): n is a, c, g, or t
gggtggaatctgttgcnctggatctttgaaatgtctccctaaactcggccttgtaggaggataggccattacattcagtggcaaaaactgcaattacttttgcaccaacctaataaatacattttctctctatctttccttccgtacagaaaacttcccctgccgaattgcactctgtcgacccatgggtcccaaggggccacaggaggggccctggaacctgcctccagggaggttctagaggacattatttatcacgcggctaaggcggggctcctggctgccagcaatagaagcctgttctggctgagctcaggtgaaaaggagcntctncagggatattgggtgggctttggtcttcagcccttacanaattctcggtcctggactnaccctcccacattaaacaaccataaaattggacaacatttatnagggaactnaattcaggngttaacaacagggagttcaaganttcaaggaagaggaggaggtgtgcgccccaaagttccctggctctnagcncgggttacagcttccctgttgcaccacaagcggaagttcaagggagcntggtggggtnccaccgacccaaagatggncccactnttctcggtcccacttanccgagggcgcaaagatcggaatttgggggaatgtt

SEQ ID NO: 641214 - DNA, 101 bp, Homo sapiens
gaagagttaaagtcggaggttcgaagacgatcagataccgtcgtagttccaaccatactccccccggaacccaaagactttggtttcccggaagcttaagc

SEQ ID NO: 641215 - DNA, 122 bp, Homo sapiens
gaagaggcagatactgtggggaacacatggaggtaaagtgtgcttggtccgcagcgccagccaggcctctctctgggcgtttatatgagggccccgccctcaggtccctgcgctactctgtg

SEQ ID NO: 641216 - DNA, 194 bp, Homo sapiens
actctgtatcttctatcagcatctaaaaaaactggcagacaaggatggtagattcttctcaggcagttaacctgtttcaaccacgatcttgacccccttcaaccctccctggtcttcactttcaaatctcacccagcccacgtccttcccatctgagtcaatggcctcaccatccatctcgtcgagagcgctct

SEQ ID NO: 641217 - DNA, 602 bp, Homo sapiens
  misc_feature (3)..(3): n is a, c, g, or t
  misc_feature (119)..(119): n is a, c, g, or t
  misc_feature (258)..(258): n is a, c, g, or t
  misc_feature (261)..(261): n is a, c, g, or t
  misc_feature (268)..(268): n is a, c, g, or t
  misc_feature (270)..(270): n is a, c, g, or t
  misc_feature (273)..(274): n is a, c, g, or t
  misc_feature (277)..(278): n is a, c, g, or t
  misc_feature (281)..(282): n is a, c, g, or t
  misc_feature (285)..(285): n is a, c, g, or t
  misc_feature (287)..(287): n is a, c, g, or t
  misc_feature (289)..(289): n is a, c, g, or t
  misc_feature (293)..(293): n is a, c, g, or t
  misc_feature (295)..(295): n is a, c, g, or t
  misc_feature (311)..(311): n is a, c, g, or t
  misc_feature (313)..(313): n is a, c, g, or t
  misc_feature (321)..(321): n is a, c, g, or t
  misc_feature (323)..(323): n is a, c, g, or t
  misc_feature (327)..(327): n is a, c, g, or t
  misc_feature (333)..(333): n is a, c, g, or t
  misc_feature (348)..(348): n is a, c, g, or t
  misc_feature (355)..(355): n is a, c, g, or t
  misc_feature (362)..(362): n is a, c, g, or t
  misc_feature (364)..(364): n is a, c, g, or t
  misc_feature (367)..(367): n is a, c, g, or t
  misc_feature (376)..(376): n is a, c, g, or t
  misc_feature (387)..(387): n is a, c, g, or t
  misc_feature (394)..(395): n is a, c, g, or t
  misc_feature (398)..(399): n is a, c, g, or t
  misc_feature (428)..(429): n is a, c, g, or t
  misc_feature (434)..(434): n is a, c, g, or t
  misc_feature (438)..(438): n is a, c, g, or t
  misc_feature (442)..(442): n is a, c, g, or t
  misc_feature (455)..(455): n is a, c, g, or t
  misc_feature (459)..(459): n is a, c, g, or t
  misc_feature (467)..(467): n is a, c, g, or t
  misc_feature (472)..(472): n is a, c, g, or t
  misc_feature (476)..(476): n is a, c, g, or t
  misc_feature (481)..(481): n is a, c, g, or t
  misc_feature (498)..(498): n is a, c, g, or t
  misc_feature (535)..(535): n is a, c, g, or t
  misc_feature (577)..(577): n is a, c, g, or t
ttngccaagagtgcatgagctcccaatagcaccttggaaacctctgggagcacataggaggctgcaggaatcagcaggtaggaggctgggacaccagcatggactagagaacgtagtgngtgccttccttccagccatggccggctgtccaccactaccacccgaaaccgccggccctctgtccaagcctcctgaagaattcgtgataccagagatgagcatccatataccaggatcacatctccattactgatcttntgngtaagcnangcnngannttnnctnancngctngnacaatcttctcttgcncntaccgatnantggntgctcntttttctgacttggnctcctcntcccgcntnganctgcccccnctggtgatttncttgttnnggnncttgatggcgtagtgcatgctcgctgacnnggganggcnctangtcaggaagctcntgtngggttttngtttnttcnctagntccctggagagtcttcnttaggcggtgttgtgtaatcctgaatcacctgctgcnaggcacgaagcagggcaatacaccgggcattggagcactgancaggcctgggagtctgcaggcgagt

SEQ ID NO: 641218 - DNA, 450 bp, Homo sapiens
cactcttaagaaaggtttaaaacattttgagctgtgatgcaaataaaagccactttacatctctaactttgtgcagacatatatatgagccaaacaaaatttgtgcagaacaatacttcccctggaaagtaaagagaagggatgctatatttgagtgaatattttatgcctatcatattcataggaatgccacatacttggatttctgtgagtcttgcatgaagtctataatatgtcctcattttaaagatgaagaaatcatattaattacctgtttgggaaactctactctcacaccacaacaatcaacataggaagatctctgttgccaaatagtgtgggggtttttccctgcacaccaagtaatgtacaccagctaggtgtcctccagttcagtttccacactatttactgggagataagcatcagatttccccaagggacgtggat

SEQ ID NO: 641219 - DNA, 385 bp, Homo sapiens
tcggtttcgtccatgtttcccaccattggccctgtgatggcaccccctactctcaccctgggaacggaagacttaccgggccttctctggatcccccactcaccttgctctcttctctctcccagtccattttgctgactaggaagctggagtaacatttgtgagtcgcataaagagggaactcctcggtggggtcatggaatttgatattcgtggggagtctcttaggcatgttccaccatgcctggctgattttgtatatttatagtcgagacgggattcactatgttggccaggctggtctcggactcctgaccccagatgatccacccgctttggcctcccaaagtgctgggattacaggcatgagccaccgcgcctggcc

SEQ ID NO: 641220 - DNA, 652 bp, Homo sapiens
ctgcctctgtctctttaacgcgagaggaagcgatgcagaggggtggaaaatggcagagctgcagatgttactagaggaggagatcccgtctggcaagagggcgctgatcgagagttaccagaacctgactcgggtggcagactactgtgaaaacaactacatacaggctacagacaagagaaaagctttagcaggagacactagaagcactatacaacccaatctctagctagtgttgcttatcaaataaatgcattggccaacaatgtactccagttgctggatatccaagcctctcagcttcggagactggacgctcttccactacgaaactccaataattccttcaaacaaaggaaacctgggctggcgcaacttaattgtcccaatttacaacgcggaagcaccacacgtgggacacgcaagagagatcggtatttcgaccaacaacataagaatacatcaagaactcacacaaataatagcacctgcgaatatggagcgccctgtaaggtatattcggaaacctatcgattacacagttctggatgatgtgggccatggtgtcaagcatggacataacagcctgcaaagaactggcacactgtccgagaacaaatcctcctactcagaaaccggcaaaggttcctcc

SEQ ID NO: 641221 - DNA, 644 bp, Homo sapiens
tggtattttaagtaaaggcagagtttcaccatgttggccaggatgttctcgatctcctgaccttgtgatccgcccacctcggcctcccaaagtgctgggataacagggtgtgagctaccggacccgtgccaattataaactattcttagctcagtgggctatgcaaagccttaggctgaccccgtgactccagacgtgtcttctgagacaagcatttctgtgagctgccccagtgtgataactgagttgtgcagtagctgatggtggttaaatggcctctcccattctacgtgcatttgctcagaccagacgtgacgtgcacaggagcagtgtggaggggggctgcaatatgccaaccatttactcttcaatagaggtgtccttcagtgagcctcctctctctctctcattactgactaccctcagctgtagaacaccctcattttttcccccagacctatccttgttccccaattgtgcctctgctccccgtgggttggggataaccttggaaggcagagaatttctgagttctctaacttatttggtcccctaattctccctcatatctgggttggagactcccacccttgtccacccttttcctgactcatactagtatccagagtagggctgcccctgga

SEQ ID NO: 641222 - DNA, 993 bp, Homo sapiens
actatgcaagaagtcaccatcagaacgcgtgttaggaaagttatttctgatggtgacttctgcatagtaccaacggaaataaagaaaagcggtgcgtgggttgaatgattactaggggtcatcatgcggcgataacacaggttgcaatgtgggccgaggtctaggattaacgaaggggaaggaaagtaaagcaactactgctggaatcccttgccacacgtttctcacttgctcttgaactaatggtacaaacgtgaggacagctggcagaagagactgcataaggaaactgcacaagcacaagaagcaaacagagcgaacgcctataccaacatgcacatgacagcaacttaacgaaactctcccactatgggaggaccggccatcatgaacaacggcctacaccgccgattcattgacagcacgagtccacgaatgctgaacgaacgccatgcgcgagggaacagagcaacgaatacacctagcaacgaaaccggcgccgtactgcaaactcgctaccataaccaataggccgacatgccgcccccatcccagcgagccgaaaccagcacgaagcacaacccataacaatggccacacaagccgcaaaaacactgccagccaagcccaagtgaaacactataaacccaagacagcgcacaaacccacaagcaaaagacgacaacaacggaaaccgacggaaccaacagaaacgaagagcaaaccacgaccaggaccaccaaaaccagcacagtcaccagcgaccacgacacgacacacaccccagcgccgagacgccgcacgcggcgacccccagcacgatcgcgcgaagacgggcccggctcgacagcagaggagcgacgcacgcggaagacgcgagatccaagcggcgaggcacagcgggcgccgagaccgacatacagccagaagagccccggagcggcgagcgaactgcgagacacgaaaactagaaatggagacgaagccacaccg

SEQ ID NO: 641223 - DNA, 118 bp, Homo sapiens
gctctctgcggtgactctaagaggatccgactcatccaacgccgctgtgactgtcacgccgctgactgcattcaacgccgctgactgcatcaacgccgccgactgtattcaacgctgc

SEQ ID NO: 641224 - DNA, 292 bp, Homo sapiens
ctcacgacacaccaacacacaccacacccacaccacacataaaccacacccacacccaacacacataccacatgcacacatcccaacacaccacacacccacaccaacacaccccatcatcatcaccatcagcatcagcatcatcaacaccgatattttcatcatcactatcatcaccatcataaacaccatcatcaccatcaccatcatcattatcacatcagcagcagcatagtcattatcatcaccatcatcaccatcgtcatgatcatcaccatcatcatcatcatca

SEQ ID NO: 641225 - DNA, 1048 bp, Homo sapiens
atcttaatcatattctaaatctctctctcaatagaagtaaacctatttcctcactctctcagagtacttagtacctaatacatgatgcgagccagtaagaagatgagtgttaagacacgacgacccaagctgaaagtaaaaaatcgtgagactattacatccatctatacttattccagcgatgagagcattgaaatcaaatagccaattatgtcaaacaggaacagactttttaaagagtaacccaaatatgtgtatagtttgtgatccgatcattagaatcttatcacttaacataattggcagtcattctcattaccattaaagtctggttgtgagactcgccagcatcggtgcagcccgtgtctttacgtgaacctacgcgagctcgcggaacgagacgtcgttaacaatggattttagacccattcacctttaaattcaccctcacgaccacacctccttactccacttgagtgatagtcgtcgacgcctcgaggaaataatcacaggccttattttaagggctcgcaaaactagagagcctattttaatcgagagtgaaatatcgtcgcaagtaagacactaaatatgatttcgaatcgtttgcgcaccaacaatcatattgcacaaacaatcaacctcctcacattggataccatctaacttgatacacattgggctcttatatctacttctcaagctcgtcaagtcataaacttacttcccctggaattttagcaccgggcataagtaggaagtgatcgacgtttggaccgtggcttaaaaacggatgggcagtatagtcgtttcacaaatcgggcgctcaggctcgtaaacgaaaggctaggtacacgtcaactgtattgtcccccctggttagcactttctttaatctttatggatgtcaactttgattattgagcaaaaaaatcagagaatcattaggggtgggccaggcatttgtggttccgcggggaagattgtgtcaacaaaaaggtgtttgggaacccaggcgccaggggacgaggcccccagtggggcaagg

SEQ ID NO: 641226 - DNA, 116 bp, Homo sapiens
ctcttcacgtgcgaacgtgatacaccggcaactccatcacgaacggcgacgcttcgccgcgcataagtggtatgcttcagcatcagtccggtcgcaatcgccatcacgatccccag

SEQ ID NO: 641227 - DNA, 830 bp, Homo sapiens
tggaaaaagtcttggaggccatggggtgggcttgaaaccagcttgggggggttcgatccctccctttttggtctaaattataattgtatacgggttcttcgaatgtgtggaaggggtggggggcactccattatagtcaccccaggtgttaatgggagggtgttctctctactattagagacttttcgcttcagaagcagaaaggttctctcaaattcatgagaaatttattaatattacttgctgttagaaaaagtgaatgaccctacagatgatatggatgtcacatgtggtgtatggcatcgggggtaagctccagagtaactgtcggggcatcccgggataggcgccagaagaaatgttgttgtgttggcggcgaaagaaatgttaagatttaccgccgatagaatatggatatgtagaaatgggattttgggcgtagtgtatgggtcaagggtggtagccgtgagaatcgggggaacactcagtgaattgagagcctccttatgatgggcaatatcacaggctcccttattggtatagcgcacatacttgggaatgtagagctacaagtgtaatttaacgtgtccgttgtagatccggatgccaaggtgacagagttggcgtatctaacaagtgcccagtcataggcccaccttacggggtcaacacgaaaggagtgaacccaagggccacaagagcccgtggggcagaacattcacaaatagctccccgagaaagttgggcagggcaaggaaaaatagaacccggggagggaaacgaaaaaaaggaacgcggggaaaaggccgggtgtacagaaatcactggaa

SEQ ID NO: 641228 - DNA, 282 bp, Homo sapiens
atcatctctactggaccagattctgtggtgaagctggagatttggacagatgcctcacgggtggatggcgttgtctcagaaaaagtgcaggaggatgagtaccgcctatcgaatgtaccagactcaggctctcagacgcacggctggtaccgctgcatggtgacagcctggtctcctgctcagggtgcgcctttggcgataagccgcacccagtcactccaagtccatattgagatagacttccatgcctcagggtcctatatttaatgcttctgtggattc

SEQ ID NO: 641229 - DNA, 123 bp, Homo sapiens
atgtccctagcgcgaggactctaaaagtgagattacttggggcatagaggtatgatgggttttcagatatctttgtatctgacaccacgctccccgggtgtgccccggtacgcgtgacttatg

SEQ ID NO: 641230 - DNA, 326 bp, Homo sapiens
atatcaacagataccaattagaggaactggacattctactttgatttagcagaattaaggcaatgtcccttgtgaaacacttggtgcattttcacaggagtcttgttaaaacataagatccagcgtctttcaatgtttgttatcaaatgctaaaaatggcattgaaatccaaagaatcaggaagaactgagaaaagacaagggaatccaacattgaaatggaacgcctctcacacctatttggcaaagactttaatgcagtcatttaaatgcttcatcaagcaattatgaacatgttggaaatgattgaagaaaagtgtttcatga

SEQ ID NO: 641231 - DNA, 556 bp, Homo sapiens
  misc_feature (76)..(76): n is a, c, g, or t
  misc_feature (116)..(116): n is a, c, g, or t
  misc_feature (139)..(139): n is a, c, g, or t
  misc_feature (143)..(143): n is a, c, g, or t
  misc_feature (163)..(163): n is a, c, g, or t
  misc_feature (170)..(170): n is a, c, g, or t
  misc_feature (491)..(491): n is a, c, g, or t
  misc_feature (534)..(534): n is a, c, g, or t
atggcagctaccatgttccgggctacgctgcggggatggagaaccggtgtccagcggggctgcgggctacggctgntgagccagacccagggccctccagattaccccaggtttgnggagtctgtggatgaatatcagnttgnggagcgcctgtaccggctancaggatnccagatcccccaaagcatgaacattatcctacccctagtggctggcagctcccagagaccccccacccaacctgccttactttgtacgacgctctcggatgcacaacatccccgtctacaaggacatcacgcatggcaaccggcagatgactgtgatccggaaagttggaaggggacatctgggccctgcagaaagacgtggaagattttctgagcccgctgctggggaagacacctgtcacccagggtcaatgaggtgacaggtaccctacggattcaagggctactttgaccaggagctttaaagccttggcttcttgngagaaaggctttcttgaaggcccagccgaagcagcctgctttngttcagcatgcccttgttggat

SEQ ID NO: 641232 - DNA, 279 bp, Homo sapiens
ttagaggacgctgacgtaatatgtaacttatatctactgagtctcaccaatttcccgtctgtccaggtttaggaatgctaatagaagtttggtctccatttctatgtgcttcctagtgtcccctctctttccaactatatgcctgtaacataaagtaattaaaagaagattaagccaaaatgtaccaaaataaagaacctcattatgtttaaatcctttgtgacaagagatactcccttacagaaaagtagttcagtaaaagctcaatatttgcggaag

SEQ ID NO: 641233 - DNA, 496 bp, Homo sapiens
  misc_feature (179)..(179): n is a, c, g, or t
caaggcttggtgcatcattggcgcgaccctccattgtagtgtgaggatgaatatgaggagggatgcttccgcattgagcatgcacagctctttccccatggaccctgatcatgtagaggttgtgaaaagcacgatggcttgagtaagcctgcctgctccaggggttccatgcctggggncgggatgatctagacacgctcagtgggaagatgtggtacagaaagccctccaagcccggcaggcatcccctgcctggaagtgaccagagagcaagccgccttacctccctacattccaagtcaggaccagcacaggactaacaactctggtcttaacagcctcctccttcccatgtccctttcacaccaaggcgactcagacctctcagagacccactttattcagttctgtacatatggggacatcggcccaagcccagcccaccttagcatgtatcactctgtggagaataaagcaccctgtgtacacagccaga

SEQ ID NO: 641234 - DNA, 834 bp, Homo sapiens
tttgacagcgccagacccctttaatgactggccccccgccaatgggtcccccaccaagctggaagacacttccccccacgtgtggcacctcgaaattgggcgcccacgcttcaattacatctctactgaaacagtgagaatacacaaaagagggtaaaaaatcttcttctcgttacaacgcccactctaaactctcttctcaaaataaatcgtaataggctatcactctccctcgaaaagagatctatggccaaacagatatatgtcggttggtgccagccctctatgtatcaagcctagccaagatcgagagagatcctcacatgatttcaaaaaaggggacatcttgtccacaagaggaagagtcagtttctcaaacagcgcgaggtcacaataacaaatatacatctcggtggcgatttcttcaccacacacgggcggagttgtctacaccactggtctgtgagaccgcacacttataacgatgcgagattagacgcactgctggtggatcgccacccccatcgatgacaggagagagagtaggggcactccctactagctcctttatacacaagacttggtcgtaactcgagattacggaggcccaacccacaggtggttcgcagggcccctcacagtgtgagatagtatgattggtgacccaagaattcttgctccccgcccctcccccgagagatgggaactattgtatagattcatcccaccctgcgggtaggcccggttagatatgaaaaacaaaagggcgataagtgttcatgtaccgttacaacactcttgaaaaaaaaagggttaaacaatccacaaaacaca

SEQ ID NO: 641235 - DNA, 319 bp, Homo sapiens
ttttgcctttttttttttgcaaatggttttttttttccgtttttgggggaactttttttggggtttgggggcccgattccccattggttttttttgggggtgccgggggttcccttgggtgggttttttgggtttttccctggttccggaagttttgggccccgaaagggttgaccccgggccccgggttttccccccccttccggtttgcctcccccccccggttttgggtttccccccccccccttttgtttttccgggaatttttttttactttttctgtttaaaaaaaggttttttggtcctttccccagagaga

SEQ ID NO: 641236 - DNA, 443 bp, Homo sapiens
cacccgagtgatgccacatcaccgcccatcacctagagatctgacaaactgatagatcgacatgcaccaagtcgtgcactctgagctcttatcgcaccagcgaggtattgctgctgagaataaagtctccctaaccccagtggtctctttacgttgtctcagagtggattgccacgtgttcctgatggcttaactctctataaatgcctcttctggacattattttaatggcttctaataggatggcatattttaatacacacagtatattaaaggcctgaaggaaaccgtagaagaaaacacctcgttctgtctagaagtcaaagcgacacctgaacttgttctaatatctatatttttattttttttaatcctcatgggtcactgaggctttttattttgagcacaaaaccaccgggaatctagcctgtggtcaaaacggg

SEQ ID NO: 641237 - DNA, 557 bp, Homo sapiens
ggagcggagagcggatcccagagagaccctgagcagccccacctgcgccgccgtggctagttaacatcacaccccgggaggagccgcagctgccgcaggccggtcccagtcaccatcaccgcaaacatgagcagcgatggcctgagacccagcagctgcgtgtgccacaggcgactttcgtagtaatagctgacggtccgatggactaaaagagtgtgaaactagggggtgacagagatgcaagtgcagcgagttgacactgagtcagtgtgctgacaattcgtgaagagcagtgacacgtacgtaatgatagagtaatggattattagtgacaccgcaagggatgaatgcaggcgaaactacgattaatagcgagatactaggatgttacaggaaaacgagtctacaggggttgacttgaagacagggaacccttgaatacgagagagtggcaaggcagcttgggtggaattatgaaatgatgggttatgtaccagagaactgccgctgggaatcctgagtagagatgcggttataggctgaataagctgtttgag

SEQ ID NO: 641238 - DNA, 457 bp, Homo sapiens
gagcaagacaaagtgattaacacaataatttactcattgattatttgttaaacatctacttcaagctacaggccactctaggccttggagggtaaggaaacagcacctttgccctcagagggtttgcaatctagcagggaggggaacataataaagtgtataaaaccaggctctggctctgaagttccagcactttgggcaggtcacttgaacccaggagtttgagaccagcctgggcagcatagtgaaaacccatctctactgggggatataaaagttagcggggcgtggtggtgcatgcctgtggtccctgctacttgagaggctgaggcgggaggatagcttaggcctgagaggcatagttcgcagtgagccgagatagcacctctgcactgcggcgtgggtggcagagcaagaccctgtctaaaaacaacaacaaaaactgatcttaagtcca

SEQ ID NO: 641239 - DNA, 583 bp, Homo sapiens
  misc_feature (558)..(558): n is a, c, g, or t
gcgtggcagcatgcttatatgggggtgtactcccatgatgccctttggcctttatcccggttacccgaagccccctgggaacacaccgtttccctgtgtctttgggggggggcccccccccgaaaaaaaacccccccccgccccgattttttccgccagaaaaaaaaaaaaatagggccccccccgggggaaaaaacccccccccccccttttttttgtgaaaacacccgggaaaaaaaacaccccccgtagaaaaaaccccccctggttgatggtgggggaaacaaaaagagggctggtttctttagaataaaaaaaaaaaaaattcccccccccgtccaagaaagagggggggggggaaaacctggggttttttaccggggccacccccaaaaataccccccctccaaaaaaccccccccaaaaaaaaagggggggcaaaaaccccccacacccccccccaaaaaaaaagaaaaagaggggggcggaaaaaatacaaaaagggccccccctttttttttccccccaaaagaatgaaaagaaaaaaaagggggggcncaaaattctaggggggggccccaaa

SEQ ID NO: 641240 - DNA, 705 bp, Homo sapiens
caatatccatactggccttgaacaggtctcatttctaggaatactagatataacaactcatacaatgcgaatatcctcccggtactatgtccatagagagagtaatactatcagatgcttcatgataagctgaacatctcataacgctcatcaaccatgccctcttactcatcatagtgcctgttgccaaactaagactaaggcgtctgctgaacctacaaggtgagcctagcacgctatctatatctgcgagtactacacacactagctctagttggacaaggatgtaaggtgacttaaacctagaatgcgtatttccaagtgtctaaggacatagatcagtcgccagaaagagttaacatgtatccaagcctgtgacatgcacctcttccagagaaaacgacttcattggagtcacacaaagagcaacggcacaaggcctgaatctattaaagacaatacgcgctcctcctgaacttgattcgctcttgatcgccaaatgtgcaaggcaacgtacactgatgttaagttagttacactcagatcacatttgcagggaacaagagtccacttaggacatagcacacgatctaccatacgtaattaaacgtacctttgaaatactgacagtacgaaaaagcaaaaccatggtgacacacctcagaccagcagacaacttggcacaatcaaaacacaacctgctag

SEQ ID NO: 641241 - DNA, 286 bp, Homo sapiens
agtaacaatgttatattgaagacttgtagtagcgcttttacctgatcaagtactaagttttgcaatctctttgggctcttgttgatgtccaagtgtctttgttctccagtctccttccttacttcagtttcctccttgttccccttctgtgtttcccttcaatttactaagaagcttgatattcatgcttttaaagatggttcgttaggacatgggtccagtatcttcctgacttgctgtctctccaaataaagattcttttcttgttctaaaaaaaaaataaaaa

SEQ ID NO: 641242 - DNA, 735 bp, Homo sapiens
ggctgaggcccaggcccagctacaggagtcctctcagaaactggacctcctgcgcctggccttgtgagcatgctgctggatgcaactgcctcctgcccaccctttgctgcatgcagagtgaccctgatgatgtttgctggtgcttgctgtgtgccttggatacccccatgccttcatgtggacacactgtgaagtgcccacctgcccttaacaggtggacacttgcaagtgtcctgccatcctgtgtgcttgttgaagcatgtttgcttgagcatgcctgttgccattggtgctggctctcccatggctgggcctgcaacttggccaagcgaggcgcccctcccggacgtgggccttgtgcctatccggggaacccgagaatgtggccaatggccacacaatgcctggttggggccccgactgtggcgacacggacattattggctcacaatgtcctgaacggaggttgagccttttgctggcattaggcttgggccttaacacactggggcgtcggggacaccaagaaaccccaggaatggactacgagatcggagcgcgcggccaaagcaaacagatggggccatcgcgaagcgagagccaaagggatagagggcaccggaaaacaaacgataaccacatggagggcgagcgcccagggcaacaccctataatgcgaccaaagctcgcccccaagccatgtgccgaacggccggcagcgagccccccctggtg

SEQ ID NO: 641243 - DNA, 2642 bp, Homo sapiens
gccacagcgagcctctgcgggagcgcccggtacccgccgcgcccgcctgcctggccctacccgggttgctgggcgcgggttggggcgcctgccggcccgccttgtacggccccagcctctgcgctccgccttcgcttcgcgggtcagcagaggacggagggcgctccgggagctgcacgaggctgccccgggcccagcctccgctgcgctggcagcccgcgggcagctccgagcaggaggctcagggtggctggagtgtggggcccggcctcggtgagcgacaccacggaccccggccccgggccatctggacggcgagcgcgagcgcgtttgaagtggtgggggggctctttgttcgccaggccgctctggctctgggcctggaggtggtttttacggctttgatgcctttgaacctattcccaggtgacccgggctcaattaggcccgggcctgagccgggctgtcaggcaagccgcgtgatcaagggcgggctgggcccttttattgaagttgaacccgagaccggggagtgctcggcctccgctgctcctccggccggccaggcgggccgcgaggtggggcccgcgggccacgaccaccgcgttgggaaacccgaggacggcaaagagcgggcccttcgcgcccctgtccgagggccctggctccggccgttctaggggacgttttaccaacaatccgtccaggaaggcagaacgcctaggagcgggccctcgcatgcatgtgagtcggtagcagcgccctgcgcagtgtccgcgcaccggacccgcggcttcagttcggtgcctaaaggttctgcagagccaccgcacccagccccacccggcctgaccgccctccttcctccgcgctgggaaggcccacggcccctctagcccaacaaaatagctttccaggtccctttctttaaaattctcaaataaaaatttaaggaacgagagagagagagagagagagagagaagccaggtccccagccgtcctgccggtgctgggctgcagcccttcctggggcttcacgtcagatggaaagggcctgtttttcccgaactggcctttccctggtttctttgctcagagcagtgacagtagcgatttgctgcccttttaccaaccctgtgtgggtccaaggacccagatccagggacatcttccctttcccagatgcggagggcttttactgaggagaggacctgcctggtagcctgcttcgccatcctcgtctccctgtctgcgtgcccctgtgtcactctggctctgtcggcgtgtctctttctctgtcctttctgtctctttctccagcagagagagttcatagtttagtttgaaagaaaaacagctcagctttggtcctgagcagcccagggctcagcccagccctgaagaccagaggccccggggacgccctggaagggcagcgcaagctggattgcaggctcacctctgcctggggagatggacctggaggatttcacctgcgaccccccggggcgccctggagctatcataaccagcagcccagttcaaccgtctggatgcactttcttcatggcgtgtcttgtctattttaaaatgctttaacaatgattatagtactggaggctgtgatactgacggctgcctgcggaaaaccttgcttaacagaatttggagtgactttcttatgctgtattgccagcccctcagagtcattacctgggcagtgaccccttgcatacataggagaagctaaggcacagtggcatttagcagcgtttccaatgtcacctgtatgttggctggggaagtgacagcattcccctcttttgaggaggggaatttgctgaattaaaacccaaatgaaaatgtcatcaatttgggaaataatactcaggttattgatttagtttgagtttttctttcaaaaattaagtcagtgataaggctaataaagccaatttattaatagcataagtaatacaatatatctctgtgtgaatactctttgcaggaccacccaggctcacttggacttcagtaaaatatcacgcaacaaagattcacagaagtaaatacagttcttggggtacttattcattactgagtatggaaaatcctgtgaatgcttcctttcatatatgtaaaaaagtgtgctttgtttcatgtgactttgtgttttttaaaaaaaaatgaactggtgttctgaaagattcttctattgcacattttccttagggcagcaagtaacagaaggtgatatgttttcacagcaaatttgccagctattagattggctttaatcttgctgcagtagaatgacactgcagggattgtcacctggggatagtcttcaagaatagcagccaggcacggtggctcgcgcctgtaatcccccaactctttgggaggccaaggcaggtggatcacctgaggttgggaggtcgagaccagcctggccaacatagtgaaagcccatttgtactaaaaatacaaaaattagctgggtgtggtggtgcatgcctgtaatttcagctactcgggaggctgaggcaggataatcgcttgaacccaggaggcggaggttgcagtgagccaagatcatgccactgcactccagcctggacgatagagcaagactgtgtc

SEQ ID NO: 641244 - DNA, 1052 bp, Homo sapiens
cggacgcgtgggtcgacccacgcgtcgaaaaaaaaaaaaaaaaacaaaaaaaaaaaaaaaaaaaaaaaaaaaaaaaaaaaaaaaaaaaaaaaggggggggcgcccaaaaatcccccgcaggggggcacaaaaataagacaaccaattttttgtgaaaggggggccccaaaagggggggaataatataacagcaaacagagcggcgctgactgtatattacacacactgttgtaatgtggaacacaacagcctaacagcgcgaacaactatcgtgggaacacacaccccaccacctctcattgggagagcggcagacaaaattattgggacaacaaaaatcgccaacacaacaacaatcataacaacgaccaccaacggagacgaataatttaaaaacgagcagacagaaggataaaaaaagggtggaacacacaacgcagactcaacaaatacatctgaagaaccacctaagagaaaacctatcgggcaccctacgaacaactatacaataagcaggagaaaacaacttaatcaacacgaccagggcaagacaaaatcaagaacaaagcacccaacaacacaaaacaaaaaaacaactaaacaacagaccaccaataacaacacaacaacacaacacaacacaaaacgaaaaaaaacacaacaaaccctcacaacacacacgaaacaccacaacaccccaaacgccacaccccaacacaaaaaaccgaaacaccaaccagcaaccccgcaagagacagcggctgagggacaaacacgaaagagacacaaacgaaaggccaaaagacgaaggaggcaggcagaagaggggaggagcagcacaaaacaacgaaagggacgaaagaagcagggagaaagcaaaggaagagaaaggacgggaggaggaggagagggagaggcgagagagtaaacaggaccagcagaaaacagaaaaggagaagcgcaacaggcgaaacaaaaacacaaggagcccaacgaacagaaaagcagaacgaagcggcgaacaacgagagaacaaagaaaagacgaagcaa

SEQ ID NO: 641245 - DNA, 372 bp, Homo sapiens
gttgtcaacaaaacctgaataatgactatttcctctttcatttcaacatgtacatcctaattctgcccagattttgaaaatactaataaactggactgaaacattcaagtctacctacttaatgacttttgttaagtgcaaattatgttcatggcactatacttggcctattggacctataaaaatgaatgagatgggcttggtggctcacacatgtaatcccagcactttgtgaggctgaagcaggcacgaatcatgaggtcaggagtttgagaccagcttggccaacatagtgaaaccctgtctctactaaaaatccaaaaattagccgtgcatggtggcgcgcacctgtagtcccagctactcagcagg

SEQ ID NO: 641246 - DNA, 850 bp, Homo sapiens
gccttgtttggagcgtctgctctgagtggtggtgtggtcacgtctcgaaaagcggtatggcatggcgaagggttgagtcaactgggctgtgagtagcagaattgcatcattttgaaaggaatctttctgcactgatttgaccaagagcatggtgcatgggaacgtagtaatgaaccagagaggcccttggtgacctagtgaatgtagtatctctttgggcagcaatcccattagcatggatgagttcccagggaccatgtattttatcgccagtatgatgcgtggtggtaatgtggcctgatgtgacttccctgggagtttctttacatgtgtttggggaggaaaaaaaattggtgagagcatgagaactagtgcacgtaagaaatggagtagatacagcatggcgcggggtgttggatgagatgcatggtgaatggctattattgagttgatcgcgtaactttctgccatgtgcattggacaggatctgtgggaagagcaatgtgaccttcattgatgaaagttgggtggaagggcatctagggaagcacgatatttgagtgcctgagtgtgtcacgttaaggcctactgacccacgttttgtccacagttgactgacctgatttatgtgaccgtgcgttgtgcagaaattgtcgtcacaccttcttgtaccaacccgtcgttcatttgccttgactttgttggtaagcttatctgcacaaggtttctccatactgtcaaaaaattttggtgtctgtcatctaggacatcacttcctccatgttctccctaacctactgtattgtctaaaactgtttggcaactcgtcagtacatggcgacgtgatatc

SEQ ID NO: 641247 - DNA, 410 bp, Homo sapiens
gcttttcatcggcaccagacttgtcgctattcatcggcaccggggcttggtgtaaaatagggtataattgctctgggtcgcctacgaggctctggtgagcaatagtgttaaatgttccttaacggagagaaggaagagaagtaacgccgaggcgcgtctttgatttgtgtacctacgggtggaagagtgattttatcgtgaatgggatgcgtgattcctactggggtcgtttgatcccgtcttcgtgctagattaggaggtggagtgctgttagggctgccataatttaagggcatacgatgaagtgaaacggtaaagaatcgtgtgagggttggactgtctactgagtagcctcctcagattcattgaactaggtctgtccccatgtatgggatggtggatcgtaggtt

SEQ ID NO: 641248 - DNA, 156 bp, Homo sapiens
tgggcactgtactactgttcacttctgtaactgcttcagtggcttcttctggagaggagaaatatacaaaaccaaaccgctttgctgagagcaacctccatcataacctttgtcactagatgattgtagccaaatggagaaaactctttccggaga

SEQ ID NO: 641249 - DNA, 1035 bp, Homo sapiens
ttcagtgggcagcattaccccctctgctgcctcccgcccgcgcttatccaggcgtgcaccatgcagcgagctgcctgtgccctatcaggcctaccgccagctacatctcgcagtgatcactacatcctgcaaccggaccacgtgtacagaatgctgggtgcgcgtcagtctacgcccctcctgcgtaggcgtatcgtctacgacctgagtccgaccgtggtgcatcctattgcacgcacgtggcggagatcgcccaaatccacggcctacctcggcaactcttcacccttcgcggttgtccgagcgacatttcttgaaacaaaacatgaacagactgcggccatactgggcgtcgcacaccctacagcacggaacagtgctgcatgtacaaccgaagacctcccaggtcggcatcaaccattgccctcgtcgacttcccatggttgcttttttcctctagctaccaccgagtactgatcctcagttcactgtgcctatcgcaccacaattgctggaactccccggggggcaattgccgcaccaatcgcaccaactcttaacagcggtaaagacaacccattttaggcaccggagtataagtcccgcgatcttgccgtaaaaagtactgctacctggtgggaccaatgcgtcgtgtcaccgtgctcacatggtccctgacgctaatgggggccccccccaaaacataacattattgtccgcctgcgccattctagtcgtcgcacagtcggctgacccattgtcgacaaccgttctctaaacacaggcccacgcggcctcgcggccgcacctaggcgtagtgggaaccggccccgcactagccatgccacggcccgacgggggcaaccagccgacctcacatggggcaccccccaccacaggaacgcaggggcacgggagcataatgacgggtggcacccacgacactccaagacacggggcacaaccgcctccaggcgactgacaggggtaccccccaagtggttgcacacgcgcgcgaccaatggccgtcccgcc

SEQ ID NO: 641250 - DNA, 1126 bp, Homo sapiens
acgcaggagctgtcgaggaagatcagaaaccagtcatggattatcatcgcgagcttatctccagacaatgagcaattgcccatgctggaggcggcgccctggggccccggatatcaaatgcaggtactgcggagccctgtacgactagggcggtttgccatccctggatgactcgtgctcgctcgttggcgctaggcacatcaccggcgtagattccatgtaccagcgatgtctagggcactggcatggacggatagcttgagagtcactcttcccgatgaataccgtgctggcttggtagggaaatcatggggcatggacagcgttccccagaaagccatccgcaaagactgtgaacagagatgcgcatgtgccaccccggcgttgtcgtgaattctaggggcttgcctgacccattgagggcagtcccttgccccctggggggctccgatgcaagaaatggccaaccaaggtaattggtgccatgagtgatcggagatggatccatgtgatggcctcctgcgttcctggagatgctgacccccttaaggtgtacccgacacactgaaagggtgcatgctttcccggaagaatcgctttgatgacgaccttaatgatatcgatccatggagacactatagatctggaaaggtctttggagcacgctggatgcagcattggctcctgtgtgatcttgagccatgcactccttgttaggcaaaagcacagtgacgctccgcgtgagagtcctggtactggaggaccctgtctatctgggctgggttgtatgcatagcagtgatctgcgcccaggtctcccagatgagtaagcggcagaagccggatcaaaattcgtggcaggagcagacatgcaccgctttcatgctcacctttgaccgctcggatcccgtccgaactttcagactgtttggtatccataataccctggccctggcactagcgaacacagtgcagacacccaggaagcaggtggcgcgcaggctccggcgccaccacttccaccgttgttacgcgccattgaactacgatgcacggtcaccggccacgtgcggtctagcgactcgttccgacacccataacacaccagtacaagcgctgtcatatag

SEQ ID NO: 641251 - DNA, 279 bp, Homo sapiens
gcgacttcttacaagaaacacttatcagcgtaacaatcacggtgaaaccccggaggcggattgttgcggtgagcggggattgcgccattgcactccagcctgggtaacgagagaaactgtctcaaaacaaaaaaaagaaaaaaagagatagaatctccctctgtcttctaggcggaattgcagtggccttgttcattggattcactgtaccctttgaccttcctgtgggcaacaagttgatctctctttgccttcaagccttcccagaagttaacttgc

SEQ ID NO: 641252 - DNA, 406 bp, Homo sapiens
  misc_feature (9)..(9): n is a, c, g, or t
tggcttccnttgcccaaccaggggtaccaagtttttgcgcagggaggccccgcgctgggacgccccttttagggacccagcctttagacagctgctgtgagggacagtactgaagactttgcagccctcgggacccccctcggagggtgccctttgctcaggcctccctagcccctccccctaaccaaattttccctggacccccttttgagctccccctccccatgggaggtggggcctccatttaaggccttccctgtcaaaagggggttgtggcaaaaaccccatttcaagctgccctcccctccccgtttcagtggaccctgtggccaggtgcttttccctatccccaggggggtttgtgtgtgggggggtgtgcgtttcaataaagtttgtaccctttcca

SEQ ID NO: 641253 - DNA, 1025 bp, Homo sapiens
ctttctcgtactctgtcgtgtgtggcgagctcactctgtgtggtggctcgtcctagggcgttgtcgtggtgtctctcttcccatagtgggcgggcccagccccgcgctcctgtgtagctcctttgctcaggggcttgcacatgtgatttagggtttccgacaggggtgtacagcgtttacacgcctgtagttctgaggattttctagtgaactgacccgttaatttcagtcccacgtccgaaatccgagtagccacagctagaactctttgctgcggtttctagagtggtctttctcgaagtcatgggacccctaaggtaatgaccagagtctacccctggtggtcataaaatagggcaggcctatgaagaaagccctttactcgtccatctgcgtcccagccccgatgtgacccccgttgctgctcctcacaccatggtgatccaggtctcgtactgtgggcacaggcctgggtacctcatctttttagtgcctctctcctcttccacaggatggggtcccacagctgcagcagctggccccgtaattgagcacacgtgtggttatcccgtagagcttttcccacagaagggtgtttgaacttagagttcttaataaaatctttaccacaatacaactctttgaggtagaataactcgtctttggcaaatggacacttttaacaaactttcacacaccacttctctcttttgtatataaagacccgtgactgggcacccgtggctcatgcctgtaatccccgcaatttgggaggcccgaggcgggcgggtttcttgaggcccacggggttcgagaccagcctgggcatcatagggagaccttcatctttaccaaaaataccaaaattagctgggcactggtggtgcaagcctgcaatcccagctaaacttggaaggcctgaaggtgaggtgggaagatcacttgagccccggagtttgaggctgcagtgagctatgattgcggcactgcaactgcagacctgggacaatgagactgtgtctcta

SEQ ID NO: 641254 - DNA, 603 bp, Homo sapiens
tcctgtattactttcagttcagttagtggttcatgtccatacaaaggtgctatcctagggatctgatgaatgcctgaaaggacagtagaatatggatcaatttccttgaccctgtggaagagtgcaggaactgtggtgtgtgttgtccttggacttctgtaaaatgtgaccgtgtgagatcttgtggtagattgaacggaatatcgaagtgctgagtttactccataggtttcaaaccttttttatttgaagaaattcttgaaaaagcctatgttccatgggaacataagagttattatagtgcctcctaaggggttaactataagatcaaggaggaagtttatatttaaggaagaattggagtgacgtatcttagaagaaggaaaggctgagtgtttccatatagctgcttctccaccaggcctatcattgtttctttttagagacaaacgtgacaaggctagatctgtgtactctctcatatgctaggtagcaaactggggtgactattttgatacgaaggtgggcaaaaattattttctgcaagtttaactgagtaggcacacgaagacaagttcccgataggctgatgggttattgcta

SEQ ID NO: 641255 - DNA, 813 bp, Homo sapiens
tgcggcggttgggccgaggtcggtcggctcagtggcctgagtgtggctggacgcgtaccaggtgtgacggagggagtggatgccggaggtctgctgacccagccgccatgaagccccccgcagcctgtgcaggagacatggcggacgcagcatctccgtgctctgtggtaaacgactctgcggtgggtacctgtgtgccctagcagatggagggagtggcaccagtggagctcatcgagcattaccaacgcgcgtgtatgatcaggttggcacccaggagtttgatggacgttgtcctacgagagcacgctcaaggcgctggctcgatgtggaggtcacctacacagttcagatggaatatccttgacttcccccagcatgtttccccctccaaggacatccggacagtcaagcacatgagggccgacaagaagctctctgagttctgactgtggagatgacgcatgacggggaggacgtgtaccatgatggatctgtgtggctccaggagaaagttcagaaggactcactgaggcccgaggctgctgcggtacctggagcggctaatcaagctgggccggagaaatgggcttcacctccccagagagactcaggaaaacatcaaacgcatcaagaagaagctgagccttctgtgcatcgacttcaacaagaacctgaacgaggacacgaccttcctgcccttcacgctcaggggagctaggagggctccccgaggaatttctgaactcctggagaagatggggacggagttgaggtccctaagtaccccattatttcccctctgaagaatgc

SEQ ID NO: 641256 - DNA, 428 bp, Homo sapiens
atacacggactccccagcttgcacttcgtaatatgtttttgtgcttctgcaccttacacagagaagcatcagactatgtggaagctttgtaacacttccagaggaattacgaagctagcacttatgtggattttatcccatatttatcttccctccttttagagttactctcaggctgatcaaagccttaacttgaggataacgctgcaaaaagggatacttacttttcaattttctgcttctagttgctaagggtgtgaggtgagtctgcatgttgtaaggtgaatggcggaggggattattaagataaagaactgttgtgacttttaagatcttttcctttgaattcccattgtgtgtcacagaggaattaagaaaaagttgatgactgatcttctgaaggaatgcatgcagagaagtaagaacaa

SEQ ID NO: 641257 - DNA, 777 bp, Homo sapiens
  misc_feature (46)..(46): n is a, c, g, or t
  misc_feature (72)..(72): n is a, c, g, or t
  misc_feature (85)..(85): n is a, c, g, or t
  misc_feature (90)..(90): n is a, c, g, or t
  misc_feature (158)..(159): n is a, c, g, or t
  misc_feature (167)..(167): n is a, c, g, or t
  misc_feature (217)..(217): n is a, c, g, or t
  misc_feature (245)..(245): n is a, c, g, or t
  misc_feature (333)..(333): n is a, c, g, or t
  misc_feature (366)..(366): n is a, c, g, or t
  misc_feature (380)..(380): n is a, c, g, or t
  misc_feature (386)..(386): n is a, c, g, or t
  misc_feature (388)..(388): n is a, c, g, or t
  misc_feature (390)..(390): n is a, c, g, or t
  misc_feature (399)..(399): n is a, c, g, or t
  misc_feature (401)..(401): n is a, c, g, or t
  misc_feature (405)..(405): n is a, c, g, or t
  misc_feature (436)..(436): n is a, c, g, or t
  misc_feature (438)..(438): n is a, c, g, or t
  misc_feature (442)..(442): n is a, c, g, or t
  misc_feature (448)..(448): n is a, c, g, or t
  misc_feature (451)..(451): n is a, c, g, or t
  misc_feature (458)..(458): n is a, c, g, or t
  misc_feature (468)..(468): n is a, c, g, or t
  misc_feature (487)..(487): n is a, c, g, or t
  misc_feature (495)..(495): n is a, c, g, or t
  misc_feature (505)..(505): n is a, c, g, or t
  misc_feature (522)..(522): n is a, c, g, or t
  misc_feature (592)..(592): n is a, c, g, or t
  misc_feature (594)..(594): n is a, c, g, or t
  misc_feature (761)..(761): n is a, c, g, or t
tcctccactcccctcctcctacaatcagtcctatcccaagtcaggnactgagaacctgctgaaaaggctgangaggggctgaaanaagtngggaagggttcataggacctttacctcagagcagattaccctgagctataaccacatctcaaggattnnggggcgtntagatctcatctaagggagacacaacttttctggtcctcagatggaaagntgggggaaggtaacagtatttacccttncataaaaactttggaggtctttaggaggatacccctcaggagggctaggagaggaatgacaaatacagaggatagaaggttccgtggnctggttgtgccctcacacagggtatgggttgtncaggactgccactnccgttntnanaccaccatntntatnctcgatgggtttggttcgaagtagatgcccnangtgnttgttnatnaagagtnttttttcctnccttacatagaccccaaanatgcccanctcttaaatncactggaccactcgggnagggctgccaggccgtagcaggcaattataaaaaagctcaggttcgatcttctccatgaggatgtaggangncctctcctcactgtccttcagctgtttcagggcctgtaccatttcctccccatataggttgttacctccaccctctctctggggctttagcacaaaccggctaggggcagcaagggcctcggcgatggcctggtcccttcttcacccacatccagtgagtagaggcnagcaaaggtggcgcgg

SEQ ID NO: 641258 - DNA, 174 bp, Homo sapiens
  misc_feature (7)..(7): n is a, c, g, or t
  misc_feature (12)..(12): n is a, c, g, or t
  misc_feature (53)..(53): n is a, c, g, or t
  misc_feature (84)..(84): n is a, c, g, or t
cgaattntgaanggaatctcgtctgaagatacccccgagccccccgtccgcgngacctctcgcacaccacaatccccacccctnctattcctcccttgccatcagctagctgcaggccccccacccgaagcccaccgcacctgaggtgtgataagcggagacccggcgaggcgc

SEQ ID NO: 641259 - DNA, 526 bp, Homo sapiens
  misc_feature (54)..(54): n is a, c, g, or t
  misc_feature (268)..(268): n is a, c, g, or t
  misc_feature (385)..(385): n is a, c, g, or t
cgatggagtgcagttttatttgtttgagaatatgttttgttttcttcctttttntcgttcttgcttaccctcaaaacatgggaagaaaagctgtctgactcaaacagccagcagtctggtccgggccccctaagatggagaggcgccatttcccagcaggccaagaaatgccccgggagctccaagggttctgtgggtcccgggatgagaggctgacacagccaagaagacccagggtgaggctgagcggaggctgaggcggcatgcntggccgcccacactgccatccgtcctagcgctctgtgcagagcacggctgaaaactccccaggtatctttggaaatgaagaacactgggttggcacccggcaatttgggacagcagnttttctggagcgcacagcttgggaataagcctgaagaaatctttcattcctagagcgttggtggataaatggtacttatttgtttaacctcaaatcaagccgcagcccccatttctggggctgctttgcgagggttgtttt

SEQ ID NO: 641260 - DNA, 992 bp, Homo sapiens
  misc_feature (77)..(77): n is a, c, g, or t
  misc_feature (225)..(225): n is a, c, g, or t
  misc_feature (228)..(228): n is a, c, g, or t
  misc_feature (277)..(277): n is a, c, g, or t
  misc_feature (313)..(313): n is a, c, g, or t
  misc_feature (519)..(519): n is a, c, g, or t
ggactcgatctacgatacatgtgtgagattacaggtcacgagccatcgagcaacgcaggctggcagagtagatcatntgttaccatgctcatctttggaccttcgattctgagctcgttgcttaggacatgcaccaatgggcaagctgtgcatgtgcgaccatcagatttccttcactctttcaacgtgtgtctaatccgaaccaacagctttgtcgacattccngtngtcctcggttcattgcttgtgatcccacgtagcgtggccttaagtgacnacgcttaagggcaccgatgatacttgagatatcagngcgtacatatttcctcaagtagtggtatccccgtaggttaatttacaatctaacgattgatatgtcaacacgctctaacaacaccttcctctatacctgacttttcactcctagaacgcaacttacttttctcgggcaccgagtccacttctctaggcagtaggtacgcgcattatcgatggacacacgaaatagattacaaaacntatatgacagcacttgtttcgcagacattcatgcacgcttgcaatgttactgatgtcctatgggcctgtagtgtacgtggaaggccccacgacgtaaggcatacccatcatgtgtagagtgttcatggccgtgcgataaaatgttccgtgggttagtccccgaggggtcacgtcatgaagcaatttatatagatcgtaactataatccttccatagaattgcagtcaaacaagggtaaaaggatattcttgacaaggtgtagaaaaaggttgagggctggtatagaatattccgttaccaagagagaatggtgtaatgatccacccaaattaatactcaatcaggggcggttggctgaaaaaattttgactaaatgagaaagagagtaaataccggaataaactataaggtagatattaggttagagattgaggatggtaatggtgggtttaaggatttggggttaccagttt

SEQ ID NO: 641261 - DNA, 231 bp, Homo sapiens
  misc_feature (16)..(16): n is a, c, g, or t
gacggatctcaggatntcgcagatcccctaacaaagtgagagagcatgcgagcagttggagaaccatgtgtacatgggccgggatcgattagatgctctgtgatagagcgtgtatcctctcgatcacatacagaagaggatatgcacggaaaagctctttgacttcttgcatgcgagagaccattgcgtgacccacaaactctttaacaacttgaaatacatgtgtggact

SEQ ID NO: 641262 - DNA, 120 bp, Homo sapiens
acgggagccttaacctaccgatatctgtgtagcgataggggctggaggcttatattatggggtagggggcgctggtaggcgaagattgtccgagggagagtgggaggatgaatgcagtgc

SEQ ID NO: 641263 - DNA, 408 bp, Homo sapiens
gcctgcagccttttcactacgaattaaaataaggaccatgtgggtgtctttggaccctatccaaaccccttagggtctggccagggggcgatagtaacttttttaaggattgaataaattgagctttttttttggcccagagggaatgagtggtaagtaactttttccccgccttagattcctcaggagaaaaggccacctgcctccagcctggaatacataaagcctcctttttagactgtaagtccctgctgcccgggttctaaagagcaaggggctttttttcccccagtgctgaggagaaaagttctgaacggaaacggggttgtttttggacttttgagttggcccctttttttccccttggcctgagtttttataaaatttccattaattggggcagtgtga

SEQ ID NO: 641264 - DNA, 151 bp, Homo sapiens
ttataaagcaaccacaatcaggacaaataaagtggattactggacctagaggagagagccgaactgagagtctagaaactgagctgtgactatactgaacttcaatattaccccaagcaagacgtcagatacacggagaaaaagtacatct

SEQ ID NO: 641265 - DNA, 183 bp, Homo sapiens
gtcatgcgtatgcgactcagaaatctagccgacgccacagggaggtacgacaatgacgacggggaccggcaatatctgcataatctgcaagaaatggctaaagaccataagacacacggcatttttacttgagtcctaaaatgaacatccggtgatattggaccttcccaatcctaaacaaat

SEQ ID NO: 641266 - DNA, 809 bp, Homo sapiens
  misc_feature (741)..(741): n is a, c, g, or t
gctcacttgaaaggggtcccatgcatggagtgtgaacgatcccccaggaaatgacgaagctgggccatcgagctgatgctgtgtgcgccagtatgtaccagtgagctcctcaagggctgtgcctgccgcccagtaagcagcttacacttcatggaccagttgtcgtcgatatccgatccggatgcctggaccgaattagggatgcgtccatgattgcatccgtagccgtgacatggagctactttcggaaggaacacgcaggggaagaaagtaaccgaaggcctttgacttcgcggggagcttcgttcatcgttagtgccccaacgcttgacagaatcgctcccatgaaatccgagcagttgctggaccccggtggccctcttggaccactgcgagcgcccgtctcctcatatctaaaggctatgacgctagtaattgcaccttggggctagatggcgagcccaggattgctcgttcctgtccaaatgctcccgtatggcaggcaaggatgacatgctcgtgcctgtgtaaggcttggaccgaggtcgacgtcgtggcagtgaagaagcttgcgtgcctaacttgcaacgtcgctctatacaccggagatacctttgcacaagtatgacgctaaaggggctagcttgcgaggtgcagctatgcgcaggacattcaaggatgcctaagaccaggatagctgcgtctgggtgcactatccgacttccaaccaggcttaatctntggctttgtctccagagtctaacgacgacgagctgggcgagtgcttgccacgcgcccatgccctgaac

SEQ ID NO: 641267 - DNA, 690 bp, Homo sapiens
tgggggcgggggactggccccaaggggacaaaacaggttatttggggcagaacgtggggaaaatcaggggtgggatcttggccacaccccccagctcgtcctttctttcttaatgggctataggatttcagaaggacgcctcttggcagctttgatagagctcatctgccaggcactcagcaatgggtctaaatgtcccgagaaggcagcctcacaagctgcctgtgcacacgaagccaaatggcctgtgtctcacacggcgcagggggagacacatccacagcctgtcgtctcacagtcccggcgccgcccaatgcgtgtggagtccccccggggcacccactgtcggatgagggcgtccacccaggacctgaagagagtgttctcgcctgtgagcagtgttgtttgatctcgaaggctatgcttgagcgatgcgcacagcctatgagcttcttgccgttgtggcggccgtgccttcatccatggagttagtgaggcgccccacatggggaccttgagcttgcgcgggaagctgttgggcgggattaaccgccctgctctgtgaggcaggtcctgggcatacttctccttcattgcattgtagccctgcggggaaatgtccttgctctgccatcatcgggctccattcccaagagctgatgttggggttctgcccgtggtgtgtgtccc

SEQ ID NO: 641268 - DNA, 534 bp, Homo sapiens
cagctatcggttcatgttagtgtatgctaggttgaatctatgtctttgctattgtgaatagtgccatggtaaacatacaagtgcaggtatcattttagtagaactatttattttcctttgggtatatacccagtaatgagattgctgcattgaatgatagttctgctttaagttctttgagaaatctccaaactgctttccccaggggctgaactaatttgcattcccactgacagtgtataagtattcccttttctctccagcctcaccaacgtctgtttttgttattgtttttgttgttgttgttttactctttagtaatagccattctgacaattttgagaaggtatctcattgtgattttgatttgcatttctctgacgattagtgatgctgagcattttttcacatgtttgtcggccactggtatgtcttcttttgagaaggatctgttcatgtcctttgcccactttttaatagggttgttttcttcctgttgatttgtttaaattccttattgaaccggatagcttg

SEQ ID NO: 641269 - DNA, 407 bp, Homo sapiens
  misc_feature (14)..(14): n is a, c, g, or t
  misc_feature (39)..(39): n is a, c, g, or t
  misc_feature (57)..(57): n is a, c, g, or t
  misc_feature (61)..(61): n is a, c, g, or t
  misc_feature (65)..(66): n is a, c, g, or t
  misc_feature (111)..(111): n is a, c, g, or t
  misc_feature (130)..(130): n is a, c, g, or t
  misc_feature (144)..(144): n is a, c, g, or t
  misc_feature (176)..(176): n is a, c, g, or t
  misc_feature (180)..(180): n is a, c, g, or t
  misc_feature (284)..(284): n is a, c, g, or t
cccctaaaagtaanaatccctaaggcccacatctgaaanaaaacctgtcaccccagncctncccnntcttcacgttgaggattcaaactggcccaatcacaggacaggtgncccggcctttccttccctnaggtctcctagggnaggggcatgggtaagggtgtttccctcagcancccncccggggtggggattatgtctgctgtcatgtctgggtctttagggtaggacaggctgtggtatgagaggcaggagtctccacaaggcttcatgtggccccttantaggcaggccctgccctctggtaaggtcccttcatgctggaggcacacagctttaaggaagtaggttgaagtaggactccttcgtcctctcactggctttggctccctcaataaactgtgtgg

SEQ ID NO: 641270 - DNA, 474 bp, Homo sapiens
tggtatgcattgactttcttcaccaagtgcatatattagtcgatgtcttgttgtgtagtctttaccgttacagttgatgtacggggatcgatgtgctcagccagatgtcctgtgcgaaatatcatgttagattatacttaatttatctcttaccaaaaaccatgttgcgttcaaagaggttaacattaaaactatagatgacaggacatgaatgtgttcttttctcctttaccagtcctatttttcaatgggaagactcaggagtctgtcacttgtcaaagaaggtgctgatcctaaaaatttttcattctcagaattcgttgtgctgccaacttgatgttccacctgccacaaaccaccaggactgaaataagaaaacagtacagaaggcatagtttacagatgtttttaattctagtatcttatctggaacaacttgtagcagctatatatttccccttggtcccaagcctg

SEQ ID NO: 641271 - DNA, 641 bp, Homo sapiens
gagagccttaaccctcaccaccctcagctgttgacgtcgtctccactccccgctaacccctaacagtccttcctcctcctctccgtgctccagatttggaccgcctttaaacgtccgtcagcacttctattctctcacttaagtgtctgctgatcccccccttagatctgccctgggagaatcgtagtaatgcaggaacagtctgcagggattctctcctgctgcctcagttgctaggggaagagactgggccttagcaggtgggtgacttgaccaggtcaccggctttgtgggtagagctgctcatagtagaacccaggagacttatctcccaggccagtgttctttctcccgtatcctagttttcttaatagaagattattaggtgcagcaataaccaagttcagttagataatttagaaacaaaaccatattttatacacattcatttcatttctgagagttcacatactcaattcctatggcttattttattttaagcagtttaaagagacaataagaaaatgcgggcgggatgcagtggctcacacctgtaatccgagcacttggcggggctagggcaagagtatctcttgagaccaggagttagagaccagcctagacaacgtggggtaggaggt

SEQ ID NO: 641272 - DNA, 292 bp, Homo sapiens
  misc_feature (22)..(22): n is a, c, g, or t
  misc_feature (36)..(36): n is a, c, g, or t
  misc_feature (71)..(71): n is a, c, g, or t
  misc_feature (198)..(199): n is a, c, g, or t
  misc_feature (203)..(203): n is a, c, g, or t
  misc_feature (245)..(245): n is a, c, g, or t
  misc_feature (265)..(265): n is a, c, g, or t
cccttgtcccccctgcttttcncctcccccatgccnaacccctgtggccgccgcccctcccctgcccccgntggtgtgattatttcatctgttagatgtggctgttttgcgtagcatcgtgtgccacccctgcccctccccgatccctgtgtgcgcgccccctctgcaatgtatgccccttgccccttccccacactnntganttatatatataaatatctatatgacgctcttaaaaaaacatncattccaaaaccaaccaaantaaaaacatcctcacaactccccaaaa

SEQ ID NO: 641273 - DNA, 148 bp, Homo sapiens
aggtgaacaatcacttagcggggacatacttcgcgggaagtgattgttccgcgggaagtgattgtttcccgcgaagtgatgtgtccctgtgaagtgattgtcccctgtaagtgatggtcccctgtgaactgatgtgtcccctgtgttc

SEQ ID NO: 641274 - DNA, 519 bp, Homo sapiens
agggcaggtgtcaagactggctgaagtcacatgaaaaaaaaaaaaattgtcagttgttcatgtgaccgcctgcacacctgaaaaatcaattatttccaaaacactcatccatttaccattttaaaacagcaaaaaaaaaaattcaaccacctttgacaatgcttttctccaattggtttggacccttttttttggtctctaaacctttattttaaattcgaaagttacaattttaaaacattattttccagtttatttttccagataaacttactcagattagcttataactttacagaaggaccccaagaagattgacagggggttgaccaagaatttagtgactttggacatttgggcgtgcagaaaacccaagggttccatttttgtctgtggagttgaggccttttagaccaaaaggggcaaagcccaaaggttcccttatttctcgccaccacccagaaggattcttgggccacccccccaaaacctttagtgattctttctaccgaggacact

SEQ ID NO: 641275 - DNA, 501 bp, Homo sapiens
  misc_feature (119)..(119): n is a, c, g, or t
  misc_feature (132)..(132): n is a, c, g, or t
  misc_feature (135)..(135): n is a, c, g, or t
tcaactgctgaccatttaaaagcagcctatgattgttctttttgtaaagcaagcaacctccctccactttgctgttttgactatttgaattttacatattgggcttacccaaaccaacnggaaaaaggtttnggngggaaaaaggccacacccctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataataaaaa

SEQ ID NO: 641276 - DNA, 390 bp, Homo sapiens
tattttgccccccacggggcgcccccgggtgtggggtttttttattttatggggaaagccccccccccccccaaccaattttttttggggggcggccaaaaaaaaaagggccccagggggttttggtttttggcgggacaagggggccccccccaattttttcccccccctttttggggggccccccccccccccccggggcttgggggccaaagggtttcccccagccccccccctttttttttttggggggttttttttttaaaaaaaaacccccccccccccgggggggggggggggcccacccccccctttttttaaaaagggggtttttttaaaggggggccccccccccccccgggtttttttttttttaaaggttttggagga

SEQ ID NO: 641277 - DNA, 1117 bp, Homo sapiens
agcggctgaggcaagagaatcgcttgaaacctgggaggtagaagttgcagtgagccaaaatcacgccactgcactccagcctgggcaacagagtgagactccgtctcaaaaataaaaaaaaaaaaaaaaccggatgtctaggccaaggatattttttttggatgcaggggggattagtcctttgggtaaaaccccatgtgatttgggggaaagtgagtgccagacgggggaaaaactggagttgttggggacgtgaaacacagtggagccttcacgtgcttattattctccggggtatccatagtaaagaactggtggcaagctattcgaaaaaacagcaaaaagtgcttcacctattaacaattgtgacaacaagagtcgatggaaggtgcgaaaacaacattaattttgcagagcgaaaaagaggaactatatacttatagtgcatagtgcaatcatacaagattataaaggggacgccgatgtggtggaaaccaatataatctatatggactagagatttataataaaagcggcgggttaaaagataacggttaacatttgggtagtacaaaacgaaaggcattatggtgatggtgagtgatgacccatgggtggtaaaaatcaaacacttggaaacaatttgcgtgaagtgccatgtaaaggcacagctggggaacccggaggcactattgggtaatcaaaaagctttggggctgtgcactatttataagggaagggagggccgtgatttatcaaaccctcagggtataagacaaataacaggacggcaagttgtgaaaacaacacaccactcacaatcgatagggcgaaactccgggggggaccgaggacaccgataagggaaacacgcggggcgacaagggactcagcgacgatgtacagccacaagctgcaagcacgtcaggaacttggaaatatatagaggcagaacccgtgcgaacagtgcagtaaaccctgaaccagtacaacatccaaagaattcccaacaaaacgctggggagaccaacaggacgacgatgacaactacatagcagcatagaaccaggacagaagaactgcagagccgcaaacagacaacaggcacagagcgccc

SEQ ID NO: 641278 - DNA, 727 bp, Homo sapiens
atgggtagatttataaggtttccaactccaagcccaggctcctgtacagcatctctggatttgcctggggccaaggggaacttgtcaccctgaaaggaaggacacaaggttggctggtttcaccacctcctgattgtagaaccctaggacctttagcaaatataggtggtaacaaggaaatgcttaccttgggccttggccaagacccagtgctatgctgtcttcaggtctgacccaggacagtcctagtggtagtggcctcagggagtttttgtcatcccatcactagctacaagcagctcagaacagagagaaagactccatttgtttgggagaaaataaagaaaaaaaacaagagtctctgcctgctggtccaaataatttttccagatcttatccaagaccaccaaggcagtctgcaagaactacagcattactatgtttggaggccccctaatgcagatgtggttgcagtgatcaaaaacttagatcacaacactcaagcccctttgaatacctgaaaagtctacccaagaaggacgagtatgagcaaagcccagactgtgaaaaccacaatgaatatctaacgtttaaatgcccaggcaccaaaaaagcatccacaaacatcaagaccatctaggaaaatcatgacttcactaaacaaaataaataagggtacccagggaccaatatttggagagacagattattgtgacctttcagatag

SEQ ID NO: 641279 - DNA, 637 bp, Homo sapiens
  misc_feature (165)..(165): n is a, c, g, or t
  misc_feature (218)..(218): n is a, c, g, or t
  misc_feature (348)..(348): n is a, c, g, or t
  misc_feature (350)..(350): n is a, c, g, or t
  misc_feature (369)..(370): n is a, c, g, or t
  misc_feature (375)..(375): n is a, c, g, or t
  misc_feature (381)..(381): n is a, c, g, or t
  misc_feature (492)..(492): n is a, c, g, or t
  misc_feature (587)..(587): n is a, c, g, or t
  misc_feature (595)..(595): n is a, c, g, or t
cgtgctccaacccaagctcccacagacctggtgttatttcacaagggccggggggccctccccaggcttccctgaaggaggcggaagtttgaacccttatgtggggttcattgggctagggtagtggtatgaggtttaaaactatttaaggattaggaggagaangagtcttcaggaaactcttgtttcactggactctgcagcctgcagaactgggngcaagggtaggagttccagtaggggaaggagcaggtagactcttcagctggcctcagctgggactgaagacctaaggctgattctcttttcttcttccatccttaagaaggccatttttctgtttccttntncttccaccaacttttttanntttcntggctnatctcccattctcccgcttcccttccaatttccctttctagaaaaaccctggtatttagctcaggccaaaactgcctcagcagaaaggtggccttggacaaaactggtccnaagaatttgaagtggcagtacttgcggattggctctgtccagcaaggcctcagctgcttgttgcgtctgctttttccccttcgaattcccggctntatctctnaagggtatctcgcaaggctcgcgaatttcgttaattctcggg

SEQ ID NO: 641280 - DNA, 400 bp, Homo sapiens
gattacaggtgcacaccaccatgcctggctaatgttttgtttttggttttggttttgtttttgttgtggtgtttggagcagagtttcactctttttgcccaggctggagtgcgatggcatgatctcagctcaccgcaatgtccgcctcccaggttcaagttattctccttcctcagtctccctagtagctgagattagaggcatgtgccaccacgcccggctaatttggtatttttagtagagagaggttttctccatgttggtcaggctggtctcgaactcccagcctcaggtaatccgtcctcctctgcctcccaaagtgctgggattacaggcatgagccaacacacccgggctatatccacttctaattggaatggaagggaatgcactcaccaga

SEQ ID NO: 641281 - DNA, 2246 bp, Homo sapiens
aagttatagccatttatttcagttgcatagttcttaaaatcacattattttctaaaatgactgcattaggtaataagaaacttgagacaactgtgtgagtatcctgagaaatagattcccaagttactaaagatgatttattaaattaatattaaatggtcttgcacttaacattgttttgatttaattggtatttttaaataactagactcaaagatgaagtgtctgaaatgttgattatgtatcttcagtgggtcatcgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaagtaagtagaagaactcattaagagattgtttgggggttatgttgtttagtctttgtgggtgctgaggttttctgcttgtaaaatctggttttcctaaaggatagtaaaacttctaaaaaatacatttcttaaaattataaaagcaatgcctgcttagagaatttagagagttcagaaaagtataacaaagtaaacatcactataattggtcatccatagctggtagcactggtaacatatggatgtgtattgcgttaaggttttttcttttcggtgaatatttatctacttaaagcataagatactataaactgtacaagggcaggggcttcactcatgcttactactgtctgtaatcctatctcctgcctaaatttttgacaaataacctgtctcaaatatgtagaagaaataagtaaaacaaatttgtgttttataataatgaggacattcttgtttgaaatctttgtttagctaaatgtttaaaatatgtcttggtaagaagccacaaacattattattcataattaacatgttttcttttttctccagtgtgttgtaattggtctgcagtctacaggagaagctagaacattagaagctttggaagagggcgggggagaattgaatgattttgtttcaactgccaagtaatgtttttgttcttttaatgtttttgtttctttttgagttcttccttaccttagttccaatgtgggcatttcctggagacaaaacttttgtttcacctgcatcatctttaagttttcttgatctgagttttctgcttttctgtaacagtgtatctattggaaaacaataacagaaatctcataatcctaaaatgttaagcattttgctaatattacacagagtatgtgaactaacagaagggctagactttgtttatcttgtacatcttggaaatctgtgacagcttggcttagattcagttttagtgtactgtatttgaaattaccgttatccacaggaacagtaactatagtttgtcctaatataacgaagtctactttataggttggctgagcatggtggctcacagctgtaatctcagcactttgggaggccaacatgggcacatcacttgaggtcagtagtttgagaccagcctggccaaaatggtgaaaccccatctcaactaaaaataaaaaaaattagttgggcatggtggcacacgtcctgtagtcccacctacctgggaggctgaggcaggagaatccattgaacccgtgaggtggaggttgcagtgagccaagatcgcaccactccactccactcccctctgggcggcagagtgagaccctgtctcaaaaaaaaaaataaaataaaataaagtctactttaaaagttgaaaataagcatgagatcttcagaaatagattttaaaatgttttaggcattgtttttagtttgcctaacctccacattcaaactctggtagtaaactgagcaaaataaacttgctgctctactattttgtgcctcgggatgcattcagatgctcctttcaaaagcaatacatggggctcacgcctgtaatccaggcactttgggaggctgagtctggtggatcacgagagctcaggagtttgagaccagcctggccaacacggtgaaacctcgtctctactaaaaatacaaaaactagccaggcgtggtggcgggcacctgtaatcccagctactggagaggctgaggcaggagaattgcttgaacccaggcggcggaggttgcagtgagctgagatggcaccattgcactccagcctgggtgacagagagactcggtctc

SEQ ID NO: 641282 - DNA, 156 bp, Homo sapiens
catctacgcgctatccacgctgaacgacagctacggaatggagcccctggaggccatgtcgcaccggcctgccggtggtcgtcagttcgccggcgtactgcggcttatgcgcagtatctttccgccggcaaggacgcgctgatcctgcaagatccg

SEQ ID NO: 641283 - DNA, 2343 bp, Homo sapiens
agcgggatggcggcggggaggtaggcagagcaggacgccgctgctgccgccgccaccgccgcctccgctccagtcgcctctggtccttcaaactcacacctcccgggaggagctgtcctggcgccgggtcccgcggggaaaatggtggagccagggcaagatttactgcttgctgctttgagtgagagtggaattagtccgaatgacctctttgatattgatggtggagatgcagggcttgcaactccaatgcctaccccgtcagttcagcagtcagtgccacttagtgcattagaactaggtttggagaccgaagcagcagttcctgttaaacaagaaccagagactgtacctactccagcactattaaatgtgaggcagcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctactgatgtaagcaatggtacagtaaagaaagagtcttctaataaagaaggagctagaatgtggataaacgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtgggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtgatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcattgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcgccaagagatagtctgtaagaaataaataagaagcggaaggggggaaaaaatcggaaagcaaaggaaagagtgcttcggtggtgaaaggaggaattgcccttaaaagagtgtacatttgggga

SEQ ID NO: 641284 - DNA, 610 bp, Homo sapiens
  misc_feature (12)..(12): n is a, c, g, or t
  misc_feature (26)..(26): n is a, c, g, or t
  misc_feature (31)..(31): n is a, c, g, or t
  misc_feature (36)..(36): n is a, c, g, or t
  misc_feature (39)..(39): n is a, c, g, or t
  misc_feature (42)..(42): n is a, c, g, or t
  misc_feature (47)..(47): n is a, c, g, or t
  misc_feature (49)..(49): n is a, c, g, or t
  misc_feature (53)..(53): n is a, c, g, or t
  misc_feature (55)..(55): n is a, c, g, or t
  misc_feature (65)..(65): n is a, c, g, or t
  misc_feature (67)..(67): n is a, c, g, or t
  misc_feature (73)..(73): n is a, c, g, or t
  misc_feature (80)..(80): n is a, c, g, or t
  misc_feature (92)..(92): n is a, c, g, or t
  misc_feature (94)..(94): n is a, c, g, or t
  misc_feature (113)..(113): n is a, c, g, or t
  misc_feature (137)..(137): n is a, c, g, or t
  misc_feature (151)..(151): n is a, c, g, or t
  misc_feature (234)..(234): n is a, c, g, or t
  misc_feature (279)..(279): n is a, c, g, or t
  misc_feature (295)..(295): n is a, c, g, or t
  misc_feature (385)..(385): n is a, c, g, or t
  misc_feature (407)..(407): n is a, c, g, or t
  misc_feature (421)..(421): n is a, c, g, or t
  misc_feature (437)..(437): n is a, c, g, or t
  misc_feature (444)..(444): n is a, c, g, or t
  misc_feature (456)..(456): n is a, c, g, or t
  misc_feature (474)..(474): n is a, c, g, or t
  misc_feature (534)..(534): n is a, c, g, or t
  misc_feature (597)..(597): n is a, c, g, or t
gatcaccgagcncaagagttcaaganaatcntggcnaanggngaaantntgtntntaaaaaaaananaaaggngtgtaanaatgtgaatgtnanaaaagattattgggaagangaggaaaaagaattgaatgaaaanatgaataaaaagtnaaagaaattataatgaataagaataaaaggtagatgggaaaaaaggtgtgtgaaaaaaagaaaagataatttttgtatttttnagtagagaaagggtttaaaaatgttggaaaggatggtataaaaanaaaaaaataaaatganaaggaaaaattggaataaaaaaatgatggaattaaaggagtgagaaaaaaaaaggattaaatgaattttttataaaaaaaaaatgaaaanatgtaaaaaatgaaaaagaganaaaaattaaaaaanaaaaaaagaaaatggnaaaaaanatttaaatttanttatgaatttaaattaanatgagtgggataaaaaaagagttgtaattttgtgtttagaattattaattagaaagaaanaaaatgatagaaaagtaaatggggaaaataattttagaaaagtgtaataaagaaaagaaaganatggagggtaagg

SEQ ID NO: 641285 - DNA, 3277 bp, Homo sapiens
agcgggatggcggcggggaggtaggcagagcaggacgccgctgctgccgccgccaccgccgcctccgctccagtcgcctctggtccttcaaactcacacctcccgggaggagctgtcctggcgccgggtcccgcggggaaaatggtggagccagggcaagatttactgcttgctgctttgagtgagagtggaattagtccgaatgacctctttgatattgatggtggagatgcagggcttgcaactccaatgcctaccccgtcagttcagcagtcagtgccacttagtgcattagaactaggtttggagaccgaagcagcagttcctgttaaacaagaaccagagactgtacctactccagcactattaaatgtgaggcagcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctactgatgtaagcaatggtacagtaaagaaagagtcttctaataaagaaggagctagaatgtggataaacgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtgggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtgatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcattgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaagtaatgtttttgttcttttaatgtttttgtttctttttgagttcttccttaccttagttccaatgtgggcatttcctggagacaaaacttttgtttcacctgcatcatctttaagttttcttgatctgagttttctgcttttctgtaacagtgtatctattggaaaacaataacagaaatctcataatcctaaaatgttaagcattttgctaatattacacagagtatgtgaactaacagaagggctagactttgtttatcttgtacatcttggaaatctgtgacagcttggcttagattcagttttagtgtactgtatttgaaattaccgttatccacaggaacagtaactatagtttgtcctaatataacgaagtctactttataggttggctgagcatggtggctcacagctgtaatctcagcactttgggaggccaacatgggcacatcacttgaggtcagtagtttgagaccagcctggccaaaatggtgaaaccccatctcaactaaaaataaaaaaaattagttgggcatggtggcacacgtcctgtagtcccacctacctgggaggctgaggcaggagaatccattgaacccgtgaggtggaggttgcagtgagccaagatcgcaccactccactccactcccctctgggcggcagagtgagaccctgtctcaaaaaaaaaaataaaataaaataaagtctactttaaaagttgaaaataagcatgagatcttcagaaatagattttaaaatgttttaggcattgtttttagtttgcctaacctccacattcaaactctggtagtaaactgagcaaaataaacttgctgctctactattttgtgcctcgggatgcattcagatgctcctttcaaaagcaatacatggggctcacgcctgtaatccaggcactttgggaggctgagtctggtggatcacgagagctcaggagtttgagaccagcctggccaacacggtgaaacctcgtctctactaaaaatacaaaaactagccaggcgtggtggcgggcacctgtaatcccagctactggagaggctgaggcaggagaattgcttgaacccaggcggcggaggttgcagtgagctgagatggcaccattgcactccagcctgggtgacagagagactcggtctc

SEQ ID NO: 641286 - DNA, 853 bp, Homo sapiens
gttatcgatcaagtgtcatttctgttcggggcccatctatcctggtactacggacgatgaatgttcgttccgtatacgaatagcaacggtgttcatgattctatgcaaactctataatgtctataaaaaacttgtaataaagaagcgcaatcctcgcaaagttaggtggacctaaagcattccaggaaagcaagctggtaaagagcgtatacagtggtagtaattatatttgaatgttgataaataccgtagaaatgatacgtataaaataccagagagatcttatggaataaaagtatagatgcgatgaagagagttgaagaaatcaatacagaggcgccaagttaaatttgataaatgaagcagattgcaggaataacataagaggagctacagaaagttcaggatatcaaagaagtcaagcaaaacatccatcgttgatcctgagcccctcttgcaggcgaacgggcaaacagttggaagagaaaatggtacagcagttacatagaggatgtggacatggaagatgctccttaaataatctctgtaaccatttctgtttatgtacatttgacaatgccctttggatacttggaactgctaaatttatgttatttgaacataaggtcacttagatgaaaagcgattatcagacatctttcctgcattgcatctacataatatcagatattacggctgttagatttgtctcagtgttacatctttactgatagatgtacttaagtaaatcatgaaattctattgtactatagaagtgaattgtggacgtaaatggttgtggtatttggataatggactaggaggttttgtatagtaatactgggaaaattcg

SEQ ID NO: 641287 - DNA, 2506 bp, Homo sapiens
agcgggatggcggcggggaggtaggcagagcaggacgccgctgctgccgccgccaccgccgcctccgctccagtcgcctctggtccttcaaactcacacctcccgggaggagctgtcctggcgccgggtcccgcggggaaaactgtcttgctctgtcaccaggctggagtgcagtggggtgatctgagctcactgcaacctcccgctccttggttcaagtgattctcctgcctcagcctcctgagtagctgggattacaggttttgcagtgggggttactttaccaagcaaggtcctatgaaggatggtggagccagggcaagatttactgcttgctgctttgagtgagagtggaattagtccgaatgacctctttgatattgatggtggagatgcagggcttgcaactccaatgcctaccccgtcagttcagcagtcagtgccacttagtgcattagaactaggtttggagaccgaagcagcagttcctgttaaacaagaaccagagactgtacctactccagcactattaaatgtgaggcagcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctactgatgtaagcaatggtacagtaaagaaagagtcttctaataaagaaggagctagaatgtggataaacgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtgggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtgatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcattgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcgccaagagatagtctgtaagaaataaataagaagcggaaggggggaaaaaatcggaaagcaaaggaaagagtgcttcggtggtgaaaggaggaattgcccttaaaagagtgtacatttgggga

SEQ ID NO: 641288 - DNA, 115 bp, Homo sapiens
ctgtagcaagagtttgaaaagcactaggcatggagacagagttctgggttccaatcatggcactatgcaggcgcaaatgggcagcacagcacttggcctgttttcttcacgggag

SEQ ID NO: 641289 - DNA, 867 bp, Homo sapiens
cacaacgtgccggggtgacggagaatggctggcagctggctgcttctaggctgtgcccagtgctgtgctggtggagtgatggagaagtgagtgagtggtgtgctgtgcctggtgcttgtgcttcgtgctccttgcaggagtttgtgctgtgctggctgctgaccctggtggaaccggcattgatgtccagctcgccgctgtccaatgaaactgtcgctgtgtcctgggcctgatccaaatgccgggttctaacttgctcccctgacccagtcctgtgtttgtcctgaatgtgccctcgtgtgccaaccagacggaatggccaatgaactggcagttgaagcagacatacgacgagtggcctttactccctgtgcagcttgtatgttgttgggccatgagtgcaatgaatgcgtgctccagacatccatgtgtcctggtatcagtgcctgcgtgggccttgggctgtggacgatctgctaacgaacatcatcctctggtgacggtcaacggctgttaccctacatgaccagcggcactgcccagtgggctgatctttcctcccagttctacctgcgggaggacgacatcggtacccaccgggccgcggtatcacagccccgcctcgctgagctcaacagcctatgtgcctgtcactcctacactgggacccctcgctgaggacttccttacgggtaacacggctgggcgcgccccacaacaccccccaggcgggacacgctgccaagtgcgctcacctcctgccgcccaacgctgcccccccagcccgccgtggtccaacacgcgtggcccgcacggcccacacacccggccctcccaccgcaaccacatccccaattccagggcaca

SEQ ID NO: 641290 - DNA, 311 bp, Homo sapiens
aagtccactctataggatcccttccggctctttgggtgaagaatggaaaggttatgtggtcccaatcaatggtgggaaccacaaacaagggtttcccatgaagcaaggtgtcttgacccatgggcgtgttcgcctggttctgagtaaggggcctttctgtttccaacccaggggaactggagaaagaaagaaaaaatcaattcctggttgcattgtggatgccaatctgaacggtctcaacttgggtattgtaaaaaaaggagagaaagatatttctggactggctgatactacagtggcttcccgcctgg

SEQ ID NO: 641291 - DNA, 122 bp, Homo sapiens
  misc_feature (42)..(42): n is a, c, g, or t
atcactcacagaccaactcccacgggaactctgccacaccgnccattgtgggtacctatgcgttttcagattcctccaaaacgcaccaagtcttcccagcaccccgaccgtcgcgtacggcg

SEQ ID NO: 641292 - DNA, 912 bp, Homo sapiens
catggtggcagcctgtaattccagaacttagggaggctgaggtgggcagatcacttgaggccaggagtatgagaccagcctgggtgaacatggtaagaatcccatcactacagaaaaatataaaaattagccaaggccatggtggcgatacacctgtaattttcagctactcaggaggctgagatgcagcagaatcacttgtgccctgggaggtcagggctgcagtgaactgtgatggcatcattgcactgcggctgagagacagagcaagcccctatctagaaaaaaaagaatgtctgtcgaagcaatgtggcggaattggaacccacttactttactggcggaacataaccaatccgtgtacccatttttgtccgggtattccttttcgtggtcattatctagtggggatttttaacagaaactcgagacgggctttcactatcttgccccagggttggtcttgaagttcatggctcaaagccatcctcctaggtgagcgtcctgagatagctgggatgacccggtgtgagccatgtgtcccaactgttgtgaccctgtgttagaaaagcagtctggcagttcctcaaaaggctaactggtcgagccggtcttatgatgcgacacatttcagtcctagggaatttcccggaagaataaagatgtttgtcgccccaagattgtcaacatctccgtgcagagttattcataagggcacacttgctactgtggacagccaattcccatgggtgccataacaggcgggtccccggaagccgcggcgtgtatgggcccgtctagagcgtgaacggtgtgtggaaacacagacttgttgtctttgcacagacctctgcacaaaagtgggcgggtccctgacacaggaagccaggaggcgccatggttggtcgcacg

SEQ ID NO: 641293 - DNA, 607 bp, Homo sapiens
gtgcaaaattaggcttcgattggcacttttggaaagatatgcaacaaatatgggatgtaatccggatgggccgcatctctgtagctctagaatgtggaaatattgagactcacctgtcattcgaacacatgtgaacacgtttctttgagactaaggactgtctagtaaggtatgggtactatctatctattccgttatgatcatgtacagttgctctgtactactaaatcctgtgggattcttgcttgtatctgtcacactaagatgtggtacaaggtactggatgaaagatgctctagatggagtacatcatacatcactctccggtcactatgttcctcctttcacgcttgaacagcgtttggttccgaacacaggacaaggataccataatgcgctgctggtaccaccgcttcttcaagttgctcatctagtctgaacaggcaccacgtatggtgcttctaggactctcgatgtgcccgtgttttcacggggcaaactcacgggaacagcgagttctcagcttctgcagtggtttacagcacataacatgatcccaaacgtgtcatagaccagttgtaatcttgaacaacactggggtggttca

SEQ ID NO: 641294 - DNA, 869 bp, Homo sapiens
  misc_feature (454)..(454): n is a, c, g, or t
attatcccgaataacaaaaccaaagacatcacaagaaaactacaaaccaatatccctatatagagatgcaaaaatcttcaagaaaatactagcaaactgaatctagcaatatattaaaaggtttatacaccatgactaagtaggatttattccaggaatgaaaggttagtttaatatacaaaaatccaataatgtaatgcaccaccatattaataggatgaaggaccaatagcacgtgatcatctcaatagacggagcagaaacatttgacaaaattcaacatccttttatgataaaaccactagaaaaactaagaatagaggagaacttcctcaacctaataaaggccatctacaaaaaaccacagtaccataatactcaatggtaaaagattgaaagctttccttctaaaatcaggagcaagacaaagatatttactctggccacttgtatntaacatgtactagggattttagccagggcacttaggccagacataaaccaggcacccttgtttttgcgatgatgtgatctggtatatagaaaatcctgatactgactaaaacattcctagaactgttaaccagttccatccgagtgcgggataccagatcattatttcacaactaaacttatttcaatacaggagccaatgaacattctgtaatggattagacaccacctctcttaaaaaggtctcaacacacaaatcttttgctaatttacccagaaggggatttttccaaggcacaaaatcgcgaaataacagaaacacggggccgggcggcgcatggggggaacaccccgaacagttaacctcaaccagccatggcaggagcatatttaacacgacaacaacgccatagacg

SEQ ID NO: 641295 - DNA, 831 bp, Homo sapiens
tggacagggtctcactctgtcatccaggctggagtgcagtggtgcgatctccttactcagtcccctagtgtcattttcaggggcactttcctacctgccccaagtcccagtttgttggttggtttctggctttctctgggtggcttgcttgacagggtctcgctctgtcatccaggctggagtgcagtggcttgatctcggctcactgcaacctctgcctcccgggttcaggcaattatcccgccgtgggcctcctgagtagctgggactacaggcgtatggtagtttggtgttttttgggtagagacggggttccaccgtgttgcccaggcggtctcgatctcctgacctcaagtgatccacctacctcggttcccagagtgctgggatcacaggcgtgagccattgtgcccagccccatttcttttgaagaggtactgagactgtgctatgttcttttgccacgcactgcctgggaagtcagctgtccccaatagatactaggccataagcagccgtgtgcttatggactcagtgggcaaaatctcctgatggttttacctttatacgcggatttattcctaggtggactagagcagggaaagcttgttagggaaggctcatacctttggtgggtgacagactgggaattcctctggtattccgcaattaattttgggggcttggttggatctggcccctgtttgtgtggcccctgtttcccatgccatgcccgttgtgttcaaccgtgtgcccttcgggttggcccgccacttcgggccccgccggtaacccgttgttctccaaaaaagggcgcatgcggggttttgg

SEQ ID NO: 641296 - DNA, 373 bp, Homo sapiens
tttccccccttttgttggttttttcccctttcccccccccaaaagcccgggccccggggttttttttggggggaagggagagggcccccaattgccaaacccctttttccccccgttttgcggtttttttttttcccttgccccccccgtttttcccttttgaaaggggccctttgggccccccccctttttttgggttggccccccctttgggcccccccgggtttccctttttttttcccccctttttttttttttggaattttggggggttaccatttttcccccggaaaaactttttccttttttcggattttttttggccccccttttggggtttttcccctggggccccaaattttgcccgggggga

SEQ ID NO: 641297 - DNA, 1354 bp, Homo sapiens
taaaacagtttacatgaaggggaatttattaacaggaaaattatttgggagggaatctggtgtgtcacaggacgggcggaccacgggggaccccccttcctggcggatgtggctggtcagagggggatggggggtggactatctctcaatccggcccgatcttcatacccgaggcgggcagagggctcgtggagggccgagcggggccccgagggctccgaggggtcgggggcccaatttcctcgcggggtgccgcggaagattggagtggtgtagggcgcggggatacccagactccgtgggcacccttctggggccaacattcgcgtgggacagtccaaacatatagacgagcaatatgtgggtgagggaactacactcttgcggagtcgtgccttatacccttacaatcccaaccagttcaacagcgggcacgaagggtttctcctgtggccaaggaaacgatctcagcgggacctgggagcaaaaggtgtgctcactgtgaaggggatgtgcaaaagaattgtggcaagaacaccaaatataacatttcctcctcctttcgagccaccgtgaggggtccagaggctgtgtgtgacctggtgacattacactatctttctccttcaccctttacgagggtggccatttctctggcagccgtcggtctcacagttcttcggccaccatggcgcggccctaaaccggggggtctatttcccaagtccggagggcctgtgcgcggggccctgcagacatgcgtgcgtggcacagactcaaggggccagaagtcgggcaaggacgacaaggtggtgacccggtggaacactgtcgtgcacgagaaggggccacacaaaaagaccctcgtgacaaaaacagcggcaaagacccacacaagatcccacgggagggggagacacacacaccccgtgatacccaggtgccaaaaaacccacccccgggcgaccagccgtggggagcaggacccttagggcggccgatttgcgggaagggggccccacaacgaggacaggacagacctccgggtgcgacactgagtccgtcaacacaaacgggcagggggaagcgaacacccgcgggagcaaacagaagagtcgcccccgatcataaccacacaaactagggcggggcgagagcgaaacaatatatacagacgcggcctgcacaataaactttgtcaatcacagtcggtcgtcaaaccacgaggcgagcgaacctctcggggggcaacacaacttctgtcaaaacgcagagacggacaacatgacaacataacgagcaactgacgtccaaaatatagatagagcagaaccaccctcatccaaacgagcat

SEQ ID NO: 641298 - DNA, 175 bp, Homo sapiens
cctgttactagaataaaatgctagagaaataaaggataaaggtggcagactagggaatatccactagaaaacatttaatatagatatcacagcaaagcatacatttctggaaaattttaaaaaacttacatagtacctaaccactactaagactaaacaaataactataccacaa

SEQ ID NO: 641299 - DNA, 111 bp, Homo sapiens
tgacttgaatgctaggctttgctgaaactttaccttgtttggtccaatatatttatgtattcctgatacatttacttcagctcattcgggaaatatagttctatcgagata

SEQ ID NO: 641300 - DNA, 327 bp, Homo sapiens
aaaaaatgacccgatattggcttagggctccctaggggacatgcccatggaagctcccctttaaaaaaggggtgggcagatgggtttattttttcccccctgtgaatatgtaaaacaaaccccttttttttgagggggttttttataccaatgccaaaacaaaaatttgtgggctctttttaaaagccagagccatataagctttttgggaaagcaagttttaaccccctgctggggtaatgtccagttatatttgtctataaatggggctgtttatggccatttaaaccccttttttttgtaaagggaataaatttttttttttta

SEQ ID NO: 641301 - DNA, 804 bp, Homo sapiens
  misc_feature (10)..(10): n is a, c, g, or t
  misc_feature (126)..(126): n is a, c, g, or t
  misc_feature (214)..(214): n is a, c, g, or t
gcggggcggngggtgggaaatggcggagtatctggcctccatcttcggcaccgagaaagacaaagtcaactgttcattttatttcaaaattggagcatgtcgtcatggagacaggtgctctcggtngcacaataaaccgacgtttagccagaccatcttgattcaaaacatctatcgtaatccccaaaacagtgcacagacggctgacggctcncactgtgccgtgagcgatgtggagatgcaggacacactatgatgagttcatatgacgcgaggttttgtacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggtacagccgatccacgccgagctgtacacccgtgacggacttcagagaagcctgctgccgtcagtatgagatgggagaatgcacacgaggcggcttctgcaacttcatgcatttgaagcccatttccagatgagctgcggcgggagctgtatggccgccgtcgcaagaagcatagatcaagatcccgatcccgggagcgtcgttctcggtctaaaagaccgtggtcgtggcggtggcggtggcggtggtggaggtggccggcggacgggagcgtgacaggaggcggtcgaaagatcgtgaaagatctgggcgattctgagccatgccatttttaccttatgtctgctaaaagtggtgagttgattgaacca

SEQ ID NO: 641302 - DNA, 868 bp, Homo sapiens
  misc_feature (10)..(10): n is a, c, g, or t
  misc_feature (126)..(126): n is a, c, g, or t
  misc_feature (214)..(214): n is a, c, g, or t
gcggggcggngggtgggaaatggcggagtatctggcctccatcttcggcaccgagaaagacaaagtcaactgttcattttatttcaaaattggagcatgtcgtcatggagacaggtgctctcggtngcacaataaaccgacgtttagccagaccatcttgattcaaaacatctatcgtaatccccaaaacagtgcacagacggctgacggctcncactaccattgccctcttgaacatttaccgtaaccctcaaaactcttcccagtctgctgacgggttgggccgggtgcgcgagagcgatgtggatgatgcgaggaccatgatgagtgagtggggagggaggttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggtacagccgatccacgccgagctgtacacccgtgacggacttcagagaagcctgctgccgtcagtatgagatgggagaatgcacacgaggcggcttctgcaacttcatgcatttgaagcccatttccagatgagctgcggcgggagctgtatggccgccgtcgcaagaagcatagatcaagatcccgatcccgggagcgtcgttctcggtctaaaagaccgtggtcgtggcggtggcggtggcggtggtggaggtggccggcggacgggagcgtgacaggaggcggtcgaaagatcgtgaaagatctgggcgattctgagccatgccatttttaccttatgtctgctaaaagtggtgagttgattgaacca

SEQ ID NO: 641303 - DNA, 338 bp, Homo sapiens
  misc_feature (292)..(292): n is a, c, g, or t
gtctcgatctcctgacctcgttatcctcctgcctctgcctcccaaagtgctgggattacaggcgtgcaactgcgctcggcccaataacacagttgtcatcaagtatttcccatgtctctcctcctgtctccgttgctggtgcaggtgcatgctgctcttttgctggctttggcaaagggcacactgctgcactgatcattcttgtagtggcgactgtttttggcctgttgcagattttttgcactgtgtggggggtgtgatgtggtgtagtgtcagtgtgtgtgtgggtgcntgggggggccgctgtgcgcggggggtggtggccctctgcttgtttc

SEQ ID NO: 641304 - DNA, 119 bp, Homo sapiens
ttggctctgagctgcacagcatcggcagatcggcggcgcgcagaacgctcctacatgcagatgctgtgcggctgctgcctgagcgcgtgcgcatcagcccggacaggtctacatcaact

SEQ ID NO: 641305 - DNA, 524 bp, Homo sapiens
gggctagaggatcctgtgctcatttcagttctatggggctggtgagaggtactgaatcatgagggcaggtctttcccatgctgttcttgtgatggtgaataagtctcatgagatctgatagttttaaaaaatgcaattcccatggacaactctcttctcttgtctgctgccatgtgagatgtgcctttcaacttccaccatgattgtggggcctccctagccacatagaactgtaagtccattaaacctctttcttttttaaattgcccaggcttgtgtatgtctttatcagcagcatgaaaatggactaatacagtaaattgataccagtagaatggggcgctgctgaaaacatatccaaaaatgtggaagtgactttggaactgggtaataggcagaggttggaatagtttggagggctctaaagaaggcagggaaatgtgggaacgtttggaacttcctagagacttattgagtggctttgatcaaaatgttgatagcgatatggacaataaagtccaggc

SEQ ID NO: 641306 - DNA, 574 bp, Homo sapiens
tctcacccaccccgatacagccacttataataagtttttagaggaggttttaacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggtacagccgatccacgccgagctgtacacccgtgacggacttcagagaagcctgctgccgtcagtatgagatgggagaatgcacacgaggcggcttctgcaacttcatgcatttgaagcccatttccagatgagctgcggcgggagctgtatggccgccgtcgcaagaagcatagatcaagatcccgatcccgggagcgtcgttctcggtctaaaagaccgtggtcgtggcggtggcggtggcggtggtggaggtggccggcggacgggagcgtgacaggaggcggtcgaaagatcgtgaaagatctgggcgattctgagccatgccatttttaccttatgtctgctaaaagtggtgagttgattgaacca

SEQ ID NO: 641307 - DNA, 472 bp, Homo sapiens
  misc_feature (333)..(333): n is a, c, g, or t
  misc_feature (368)..(368): n is a, c, g, or t
  misc_feature (382)..(382): n is a, c, g, or t
  misc_feature (414)..(414): n is a, c, g, or t
  misc_feature (433)..(433): n is a, c, g, or t
tgagatggagtctcgctctgtcacctaggctgcagtgcagtgggtgcaatctcggctcactgcaagcttcacctcccgggttcacgccattctcctgcctcagcctcccgagtagctgggactacaggcgcctgcccccatgcctggctaattttttgtatttttagtagagatgggatttcaccgtgttagccaggatggtctcgatatcctgaccttgtgatccgcccgccttgtcctaccaaagtgctgggattacaggcatgagctgtcatgcctgggccgggattaattctttatccatgttatctggcattatttttgattttctgnctatattagggaatattggtaagacccatttcccnttctgggctgtttncccaaaggaaggagaattcttaaaaagttagnacaggggcagcatggcttnatttgatccatgaggataggatattatttttaaaaattt

SEQ ID NO: 641308 - DNA, 893 bp, Homo sapiens
  misc_feature (139)..(139): n is a, c, g, or t
agcgagggagacagcgccgtagtgccggtacatcggggattctggctcttcctcttcgccttaagatacgggtgtctgtatatgaataatcaatagcagtcaacgagccaacggctaatcaggaccagcgttgtgaacnaactagaaaaagacgatgacacacgagatgacgcgctttgagcccgtagctcaggtgttcaagcgactgtattacttgcaaggcgttaaactgaaaccggtactgatttggaagcagtagctgagagtctctcgttgatggcttctgtgagtcataaagaacgtatggatgtaccgtgcgagtaatgtcagaagagaacaccttcgtgttggaccacttgcgtgtgtgggctgggtcggcaatgctggcaccccaggtggctatcgactgggcagcaatgatcatgagtagcggtatcgacgaatgtcgtagcgatgttttgcaggcccaagaagatctacgagaccatgcagatgcatttgctcaggttttatacatcaacgttaatcgacggcggctacaaatacctggagaaaggtcttgaagatgaagtgataaagagcatagctggcgtgttcttgagaaagggttaatcagagtcggaggaggaacaatgctagctatgtgtgactgtgggttcttctgggctaattggagacacgttaatgcgatcctatgtcttaatagccttttgataatgaaaattgggttaaagaaggagttacaatcagcatgtagctggtgaaagctctttacatcattggatacatgacataaagatatcaaatgcacgtaagctgcaatgtcttcggaaaagtcagcatgggataacaggactggatggaactcctttcctggcaaattagcgaagggt

SEQ ID NO: 641309 - DNA, 925 bp, Homo sapiens
  misc_feature (578)..(578): n is a, c, g, or t
gcacccaaaaaggggcgccctccaaaagggggatttttattacccagcgttttgagagaaattgttattacccccacagaaaggggcgcccccaaacaaaaatggccgcccccaaatagttcaacgcacaatctggttgtgattatagacgccccctttggagagtgtaacagcgcatacctccttttggggcgcgtgatgaccatcagtttatagagcaccaccccgtttatcttcctcccatgtggggaaatacacaccactgtgtggcggcaaatagatattatcaatagggggtatatagaagatactgccttatatagggatatctttctcttttgaaaaaaacataatccgtggtgtatatctctgggtgcctgtgtgaggtgttttctcactattttaacatattggcgcccctttacagagaggaatagcccacgccgattttttatatctcagagatacatctctgcccaataggcctttattatcttttagagaggcgcattgcttcgcgctcccatttttggtcctgttatatatggaaatattttttggtctccccccagagagangagccaaggggatatacatctttttttttttttttacgccagtttgagttggtgtagtgtatttttggttatccagaataactcataatagctttggggttttgaattggtgaaataatatccatgatagtgtgaaaaatcccatgataccatactgtcaccagtctccagtccccataaaattggatgttgtgccctacacacacaaccaccggatttagaagaatatgtccaactataaaactgcttgtgattgtgaatgactttgttttttgcttgtgtttttccatttcctataaagcacatactaactttttaaaaattaaggttatttttaaagcccgtta

SEQ ID NO: 641310 - DNA, 232 bp, Homo sapiens
  misc_feature (208)..(208): n is a, c, g, or t
ttttacaagatacacatatataaccaaatgtttaatttcaaatactgaacatcaaagcaccttcttttttgcttctgacagttaaactacgttttaacatagtctggaaattggcttacagacttttcttatagccaaagacatgaaaacggagattcaggccatgtggctgcctcgagctatagcccttggcctggccacatatatnaaccaaatgtttaatttcaaatac

SEQ ID NO: 641311 - DNA, 102 bp, Homo sapiens
ctattagccatggtaaacaaaccgagttcttcgacaataccgtcgactgatcccttggcccgcgtctcctttgagcagttatgcagacaaggccaaagacag

SEQ ID NO: 641312 - DNA, 109 bp, Homo sapiens
cccctcgcatgacctggcaaaggaaaaaggcagcccccctccagtccaaggccagttatttttccaaaacccgacccccacgaggacctcgcattaaagtattttcgga

SEQ ID NO: 641313 - DNA, 479 bp, Homo sapiens
  misc_feature (396)..(396): n is a, c, g, or t
  misc_feature (398)..(398): n is a, c, g, or t
cctggaatcccagcactttgggaggctgaggtgggcaaatcacttgaggttaggagttcaagaccagcctggccaacatggtaaaaccttgtctctactaaaaatacaaaaattagccggctggccaggcgcagtggctcacgcctgtaatcccagcactttgggaggccgagtcgggcggatcgcaaggtcaggagatcgagaccatcctggctaacacggtgaaaccccgtctttactaaaaatacaattagccaggcgtggtgatgggagcctgtattcccagctacatggaaggctgaggcaggagaatggtgtgaacctgggaggcagagcttgtagtgagccgagattgcgccactgcactccagcctgggtgacagagcgagactcccnanaatcgaccaagtttatgcttgcggccggaatttcagcttacttggccaattcgccttataatgaagccgtattacttcctg

SEQ ID NO: 641314 - DNA, 433 bp, Homo sapiens
  misc_feature (287)..(287): n is a, c, g, or t
aaatggggtatcgctctgttgtccaggctcgaatgcagtggtgtgatctcggctcactgcaacctccgcctctggagttcaagcaattttcctgcctcagtctcctgagtagctgggattacaggtgcccaccaccacacctggctaatttttttgtatttttagtagagatgggggtttcaccatgtaggccacactggtctcgaactcctgaccttgtgatccacctgcctcagcctcccaaagtgctgggattacaggttgagccaccgtgcccggcctgaaangtaattcttaacgacctgggaacaaatggctgaaggatgcagaacacaagtctcttgatctccccctccctcagcccatgcagagactatctgggctcatgaagcttcttgcagtttctccaggcctgaaactcaaagctgtagct

SEQ ID NO: 641315 - DNA, 882 bp, Homo sapiens
ctcccatccctacgcatgctttacataacagacgaggtcaaccgatcacctcccttacctatctaaattcatattgtgccatgcaattggttacctgataccctacgcagtgtacaccgcactagcggcggtactacctcttcaactccttatcatacttcccccatttattcctagtaaccaggctgaccctgtagactccttgacgttgactaatcgagtaggtactcccgattgataagcccccattcgtcactacataagttacatcacaagatcgtcttgctacgtcatgagctgtccccatattaggcttaaaaacagatgctgattcccgggacgtctaatatccatatcattttcaccggtacgacgaccgggggtattacttactggtcaattgcttctgaaatctctgtgagagcataagcatcagtttcatgcccatcgtccatagaacttaatttcccctaaaaaatctttgatacactaggggccccgatatttacctctagtagtacacctcccgtcatatcccctctagagtccaagatacctctttacggactccagcttatgactcactaaagcccatgtcgaaagaccccctttcgctgggtcaatagtacttgacgcatgtacctctccgaaactagggggctatggtactaatacgcctcacaatcatttgctcaaagccccgtgaccaaagagagcattagtgcatagcaccatgtacctggtacgtattcccctatgaggaataatttagcccgagaggctcagtcgtgccgtacgaaaaacagaccctagaagcgctccatggcattcatcggggaatcttcccacagaagccctcgtagaaccggcattataacacgg

SEQ ID NO: 641316 - DNA, 420 bp, Homo sapiens
ggttagagggtgtgggcccagtgcacagttcagtggtggtggcctggggcaggagtcaggataggaggacaggaccccaggcggcgacagtgtgctggccctcagggaaggcagggtctgggctccaccagagctctggcactgacctcccggctggctctcctcactggaagtggacttgactgaggccccagcaaggcctgcctgctctgggtggatcctgggcccacgcggtgctgtccccagccagatctggctggagcccagcctcagccatgtttagtcctgtgccagcgacccgccgacgacagatcaagactccaagacagcgaggcgggtgtgaacagccaccgaactcctccaacaggactttccttcccggtgcctaaagcccctcccgggggtggggctgcacaacca

SEQ ID NO: 641317 - DNA, 744 bp, Homo sapiens
  misc_feature (18)..(18): n is a, c, g, or t
  misc_feature (21)..(21): n is a, c, g, or t
  misc_feature (29)..(30): n is a, c, g, or t
  misc_feature (41)..(41): n is a, c, g, or t
  misc_feature (46)..(46): n is a, c, g, or t
  misc_feature (50)..(50): n is a, c, g, or t
  misc_feature (60)..(60): n is a, c, g, or t
  misc_feature (65)..(65): n is a, c, g, or t
  misc_feature (72)..(72): n is a, c, g, or t
  misc_feature (93)..(93): n is a, c, g, or t
  misc_feature (744)..(744): n is a, c, g, or t
acaccgtctcgacctctncanactaccannaaaaatctaanctccncatntgtcccgtcncactnctccacntttctaaccttcctccacgcnctctcccagagtggagaacatcgagatattacctcacagcactgatgagagcaagatgggaaaccagcagatgtactgaagccacccgcgaaaaaagagacaagggtctcaaacacgacgaaaccgtacaaacaggaacggtcagaaacggaaataaggcataaagatgagccgccagaggttcacgtagtacgcgaaggaaatcagtttaattaagaagaactaaaagctctttcttgaaaggagaatagggggaatcaacgcaatgaaaaaacaggaaaagtgtgagaatataaaataaacatttgaaaaaaccaaaaaaaaaaaaaaaatataagaaaccgggaacaaaaatgcggccgtagtgagagctaaattgagaaattggccgtaaagaaaagacggattaaaatgaaaagaccggggtttaaacaaagatgaaaaggggaaaaaccatggcgtcaaccaaactaaaattggcttagaaagaaaattacgcctttgagcaaagctgacgtaaaaaaacaagaaagggcccaacacaatagcggcaatgtcaaaaaagttggcgcaaaactagaatggaaaaaaggcacaaaggaaaagcgtaaataaaatggataaaaaatgcgggacaaaaaatgggcgggn

SEQ ID NO: 641318 - DNA, 223 bp, Homo sapiens
ccttggatgttgagctgcgtctcccggtgggggctcatggactttggtgacctggattggggggattgcagccgctcgctgcttcagctgcttcagtgtccagtggcttctggggtgaggcattgtgcccgggggtcgccagtcggggtgaggaggttgggccttggggacagcagccggttcttgtcgccgccctcggcctcatccaccccgtcgggtggag

SEQ ID NO: 641319 - DNA, 185 bp, Homo sapiens
  misc_feature (131)..(131): n is a, c, g, or t
  misc_feature (145)..(145): n is a, c, g, or t
  misc_feature (158)..(158): n is a, c, g, or t
  misc_feature (173)..(173): n is a, c, g, or t
  misc_feature (185)..(185): n is a, c, g, or t
gatcaggacacgaggaagagtaaatgtgagacagtcaaatgtgacttctgcgataaacagatttttaaaccccggaaattttgcaaaattttgggtgaacctggaaccttcttcggttgcatatacctggnactatctgtacccntcatccaactgtntcaccattaaggctntttttctggggn

SEQ ID NO: 641320 - DNA, 1184 bp, Homo sapiens
  misc_feature (378)..(378): n is a, c, g, or t
gggtgggtgcggcatcgctctgatccctgatgtgaccttcgggaccccgcatggtcctcacgcgcaatggcgggtgtgagggccctggtggccgtcgaggctcgctgcggctatcgtgcattacacagattgcctgtacccaccgtggctggtcggagcgcctttcgcgcaggcgactgcgaggcccgttcaccttctcctgttgtccgtgacccacgcggccacgtggggtctggagctggtgtcgtagtccttggaatgcagtgatctctacagaatgggaccgcgagtaagtccagcgagagtcctcaggccgatctctgagtagcacctgacgcctgtggaaggggttgacatgtcgcacgcaatcatatcagncttcgctcgtacagttcgcccttcgagattgctacgttgcatgttgagtcaagctatcacctaacggggctaggcacgtcccgcaagagcagagcaagcgacggaagaatgtctgtgtgaccagaagttcttgcagaacggatcagtcgcccgttggactaagaagtcaccaagaactcgtggccgcaagccttcgaattgtgccaaggccatatcgcactgatagactgccatacttttccatgtgatgggctcatgtgacgcgtggtctaaaaaaacctagaagccacgtttatgccgtgagacctgggaccaaagattgcatagggtgtagctacaagacacgtgggcagacgtgctctccttggaaggtgaggtgaccccaccttgaggagcacttgcggtacaaggcacaaccacttacagggactcttgttatggcttgggccatttagggcatcggctagtgcggttcaggggggaattccccaaagcgggttgggcattgcacgaaaaagggtgctcaccgtagggggcagaacgtgaggttggggcgccactagcccgtagggccaaagaggaaaccgaaactcggattgcgccccacaccgttggaattcctttctttacttagctctgggggagcaccccgccaaaagaagggtgggcaaactttcttaagcggcacacgtggaacgcatagggccatagaagcacagctagcttgcttgcgatataggtggacaggttattgcccacgacgaagcgtccagcggttagcgagccacagtgtaggttccactagg

SEQ ID NO: 641321 - DNA, 923 bp, Homo sapiens
agcgggtctctctccgctgcggggagcgcatcgcggccccggcgtctctctccgctgcgggaagcccatcgccggcccggcgtgtctctccgttgggggaagcccatcgctcgggccgggatgtctcttgggtgggaggaacggacagtctgtgtcgggacttgcggagtgccatcttggggtaggggaggaagtgatcagtcggagtggcttaggaatttcgtttgagatagtgaagatgtgtcttctacgtggcttaggatttagttgtgagataggaatatatgtatctattacagagccttagattatagttgtgaggtgagattagtaactacctttatacaagcctaagtgcatcgagtgggggtgatgcttgtgaggaactgtatataaagacatcagtgtactctggggcgatgatacatggagaaatgtaatttcaagcatcggtgtgttaggggcaagaaacggcgcacgaacatcgctatttccgcacgggagtgcggtcgctcctaataagcagcgcgaagtaaagggggcccccgaatgcaattcggagggggaggagcgggtgatccgtgaaccggggcggggtaaaagggcacgcggatgaaaatagccgagggggggtcactggtgctgaaccatggggcgtaaacggggccccgagcaatatccaagcgaaccagtgggcgagaaacacggggggaataccgggcccgagggaaaaattccccgcggggagaccagtggggggacgccacctcgggcgaacaaccggggccagcggaaaaatacccaccggggaaaccattgggggaagagcaaaggggtaagacccggccacggcaaaaatacccaagggcacgatagcggaaaaaagggacaagcacaccaaaaccgccggacaaagaggaacg

SEQ ID NO: 641322 - DNA, 93 bp, Homo sapiens
ttgtggtgtgaatttggaaggccggaagaagatgtttgatgccgccaagtctccgacctcacaatagaggccagcttgctgtgctgcgctctg

SEQ ID NO: 641323 - DNA, 1039 bp, Homo sapiens
ccctttgtcgtttctctagcctcttctcatcacgacccatctaccctcatgctccagtgcgccagacgcctctagcaagacgcgctcacgtcctctggtccattccggcggatttccctgaatgggagctgggatcagcatgcttgtcgggggtaccccctggagtagacgacgcgcaccaaggggggacccttgggctttgttttgaagaccatcgcttggtcatcattcacctgcacgaccaatcggcctctgatgtccattgccgtattcgtctccgaggcggctgcctcccggtctctggcggtttggaattcgggctcgaccttacgccggtcggtgtccggagatgccttgcccttggccttctggccaggtcatatcgctcccggcggtgacccatcgacgctggccagctccctggacctgctgcctagccctggcatgccctggctggggccccatcttgccgcaatgtgcaccctgtggatggcttgagacctcagccgcgctgctgctgggcacaggcaagagccctcggtcagtctctctttcttctacccgtcctacccagacgacggtccgtggggtttttgcatgtgcggagtggaaagtacaaggctcacttcgttcaccccagggctctgcccacagtgataccacttgcagaccctgccgtgccacgcctccagctctctgactgctcatgagcccccgctagctctatgacctgtccaaggaccatggtgagaacttatcaacgctgcatgtgggggatgtaggtgccggggccaccccagaggtgactgcaatgccgtgaaacagcttacagctgctcaaggcaccagttagacgcagcgtgtagaccttcggcctccagccaggtggccacggggcgaggaccccagccactgcagatctagcatgtcatacctggcatgcacccccacgcccagcatggctgccattgcccagatccctatgcctgagggcccctcaggtctggcctgggcatgtgatggctcctcacggggagtat

SEQ ID NO: 641324 - DNA, 1489 bp, Homo sapiens
  misc_feature (677)..(677): n is a, c, g, or t
  misc_feature (718)..(718): n is a, c, g, or t
  misc_feature (779)..(779): n is a, c, g, or t
  misc_feature (869)..(869): n is a, c, g, or t
  misc_feature (1172)..(1172): n is a, c, g, or t
gcccccgccttttgtcttgtgcgtcagtggctgatgttttacattgtgtctccccttgtgggggattctgtatcgccccgtttctctcccccgtgtgttgtgcacgcctcgttggagccccatgtgcctatttgttaaaggtctcctcccccggtggccctctctttttcttctctgcccaaggatttttcacccgggggttaacacaaccctgtcttttcaccggtggactcccttctcccgcaggttaacccttttcgtttctcaagggggcccccgccccccctttttggggtgtgtgcaccttataagatgggtgaccccccagaccccaacctgtggaaatgttgtgggtgggacccttggtaaggatttacccccatggattttttgaaaggcccttttttcgtaattataattataaaaaaaggaagggggtgtctttgaaacaccactgtaatttttggggggaaaccccacaagaagaaaattttttccaacctctttttttccacagaagttctcaataaccccactctcctggttaaacaaatcctctttgttttgctttttaaaatttaaaataggttcccccctttatttttaacccccccctcggagtgggtctacattcttgaaatgacgcttaactgtttcgcccgcagtgtctccctcgncctctccgcgggcctctggtttttgccgctcgtctttgggnccttcgtggctataactaaaagttagataagatgttgggagatgttttataacaaaatggnctccgtctttgtagacctcgtctggggcgttatcttttataactcttcgtcgcttctcccccgcctcccaccgctataaacctgtccccncacacggagtttctctttttctgtttcttttgttggctctctatggtaaatccacataattgtggcgctctttcttttctcggtgagatcctctcgagggccgccgctctcttatcatatatggagatccacatcgcgtgtatagattgtatagacgcgctcttgtatatgaccaccccacatctgtttgttgtgttcttttggctcggggttctctcactctctcttctggctaattatagctctatttacccccccactcggctgtccccgcgaccactcggcccctcttttagactcgcncccgagagaactcgggaatattagactcgttgtcgacccctcttgggatagactcgcttgtttctcggttctcggccccgcgggactgtgaataggcacctcggatagtcacgaatttaagagtttctttcctcggggagttacaccacggctatgaaatgtactttggctttctataaaccctcccccacagtgagattctaattcttcacaactacccacgttgtaagtatttctgaaaattggggaaccactttattttaaaagccatcccggtagtgttgctttttaccagcataatacaatatatgtatcca

SEQ ID NO: 641325 - DNA, 958 bp, Homo sapiens
  misc_feature (13)..(13): n is a, c, g, or t
ttttctttctttnaagagaggtagagatagacgacgaagcggaggagggaggaggcggggaaagagaggaagtgatctctctggttctttgtgggcggctcgtgaacacatcggtgtggtccagtctcttgctttgtgggaaagaaggtgcaaaccccaagagtggggcgtcctcccaacctaaggggggcgcacacctcattccggccgcccaactggttcaaaaccccctctgtgtgaaacaacattctgggtcaccccccacggcatgttgcgttgaacgagtccttgtttggccagggaacgccccacccagtgcttggtctgggggacccaaaccctgttttttcccgcggtttatcttaatgaccacatcttgttcgtgaatcccgcgcaagccagtcgagtgtggacccccattcctcggtgtaaggactctcctgagggttctttgactcgccacagactcgctgttcactctggccgtctccaccacagggttgtgccccctcgcccacaatgcgcgggcgccgggacgaacgaggtttttacgggggagatggtcgcgcctgctgtgttcctgccggacgtgtctcccccgatccgtcggttcatataactcctactgcgtggataggtcgtctcttcaaaccaataacagggtgaacgatgctctctgcaacgaagccactgacgcacatgatcacttttgtctttcatttttaaatgtttggctgtatgtaagtcccacccgccggctcctcattcaaatggagcatcttaggcataaagggagcgcttatcccacagactctttgacgtcttagaaattggactgccccgcagatctctctccctgttttgtcactgctatctgcgctccaacgcccaaagtagggggtggcccctttttgtgcaagggcaaacaaaatatttgattttggcggccacacatgca

SEQ ID NO: 641326 - DNA, 150 bp, Homo sapiens
ttcaatgccctgtcatcggcaaaatcctttatgtgcaaaactccatatggaatataagcaggtcatggcagacctgtctacattggagaatgagaacaccgaagccttggataaattcaaggagcttgacaaggagtcactcttctattg

SEQ ID NO: 641327 - DNA, 112 bp, Homo sapiens
ggtcgagttctatgaggatccccagtccagacagaagtcatttcccagcgtatgtctggtatctaatctgtattcgaatcccccccattgtctcccaagaccacgctagcat

SEQ ID NO: 641328 - DNA, 823 bp, Homo sapiens
acgaagtacagccgcccgttttatcatcatcggtcgcgtcattatacttactggccctggtcccccatccatggtctccagccggacgtcgcagtcgtcccgaggcatagaagaactcttgactgacagaaacggaggtgtgtccaaagtagaggacggcagacgggctccaaaacccgtacctacacagcctcgccccgtatcgcctcagctaacaacaaatcatcgtacaacctgtataccacctatcttccagtctggtaagcaaaaaggggtgtctcagaatctaaccggcctagtagaaactagtagaggggatatcggccaagacgtcctcttaccctctagcctcccacccaggccactactatcacctccaccatagagcctaggacataccagagcctaggacatccagtagtagaggagctagagcgacgctaaagatagggccgagctcctacccctctagctaccagcagtagccaagtaggtcaggctggacgacttgtggcctcacggaagcacggtagcaaggacatcagctctagcatttcgagtcaaccctgcactaggcagagctcaacctagcgcagcaacgagctgggcgatgtcggcgtgcattgcgtgctccagaggcctagagaaccccctcctgccaagatccagaagctagagcctaccagaactagcttgctagacgggggcggctgcggggtcctggtccagcacactacggcacctgcccacccttacaggagctggcctcagagaaactcttgggggatgcaggctgcagtgtcctggaagatcctgaccccag

SEQ ID NO: 641329 - DNA, 355 bp, Homo sapiens
cagacaggctaacagcacagaatctcacatatcaaatagagcacagctgttgcatacacgcacgttaatgacttcagttaatacttccagtgtttagacttcagagctgctaataacactaaactcaataccgtgtatgttgcgtctgtcaatcacctttgtcttggacaaagctgctccaggtgtgaagaacccgaccgcctaaggcaagatgagaagcatcacttagaagagtcatgactgcctgaaccatagctatagtgggtagccacatagccagcctctggtcctttcacctgagtacaaattttgatcataggtattgttcttatctgtaccagtagccttggctgta

SEQ ID NO: 641330 - DNA, 265 bp, Homo sapiens
acagttccgctagatcacaaccaaccaaatccagagcccaacactgccacagttccactagatcacagccaaaccccaacagagcccaacaccgccactgttctgctagatcacagtcaaccaaaccccaacagagcccaacaccgccacagttctgctagatcacagtcaaccaaaccccaacagagcccaacaccgccacagttccgctagatcacaaccaaaccccaacagagcccaacaccgccacagttccgctagatca

SEQ ID NO: 641331 - DNA, 352 bp, Homo sapiens
ctgacatacgcgggtcgagaagacactatggagctactaatttattagctgcacactgtacctaacaaacccacattcctaaaggccatacctgcattaataaattaaagctccatagggtcttctcgtcttgctgcagccgcatagattgatgcacccgactagtcagatcgcgccgcattggcataccgagccacagtgatagatactgccgcgcggtacgagcgcgccattgagtctgatcgctccgacatacacagtactggcgagctaccacattgcgtgcacacccgtcgccggccttcgcgatgctgtgacataattaaacagtcggactcctctggtccgcacc

SEQ ID NO: 641332 - DNA, 119 bp, Homo sapiens
ttattcactcttgcagattttcatcccattctactgcattgataggccatcaacatccatcctatcgagatttattataagaatgacgaacatacttttctgctcattccgtactcccc

SEQ ID NO: 641333 - DNA, 754 bp, Homo sapiens
  misc_feature (69)..(69): n is a, c, g, or t
  misc_feature (101)..(101): n is a, c, g, or t
  misc_feature (110)..(110): n is a, c, g, or t
  misc_feature (115)..(115): n is a, c, g, or t
  misc_feature (118)..(118): n is a, c, g, or t
  misc_feature (120)..(120): n is a, c, g, or t
  misc_feature (123)..(123): n is a, c, g, or t
  misc_feature (126)..(126): n is a, c, g, or t
  misc_feature (128)..(128): n is a, c, g, or t
  misc_feature (139)..(139): n is a, c, g, or t
  misc_feature (158)..(158): n is a, c, g, or t
  misc_feature (189)..(189): n is a, c, g, or t
  misc_feature (220)..(221): n is a, c, g, or t
  misc_feature (225)..(225): n is a, c, g, or t
  misc_feature (240)..(240): n is a, c, g, or t
  misc_feature (244)..(244): n is a, c, g, or t
  misc_feature (246)..(246): n is a, c, g, or t
  misc_feature (248)..(248): n is a, c, g, or t
  misc_feature (251)..(251): n is a, c, g, or t
  misc_feature (258)..(258): n is a, c, g, or t
  misc_feature (261)..(261): n is a, c, g, or t
  misc_feature (263)..(265): n is a, c, g, or t
  misc_feature (292)..(292): n is a, c, g, or t
  misc_feature (304)..(304): n is a, c, g, or t
  misc_feature (319)..(319): n is a, c, g, or t
  misc_feature (331)..(332): n is a, c, g, or t
  misc_feature (358)..(359): n is a, c, g, or t
  misc_feature (388)..(388): n is a, c, g, or t
  misc_feature (395)..(395): n is a, c, g, or t
  misc_feature (397)..(397): n is a, c, g, or t
  misc_feature (403)..(403): n is a, c, g, or t
  misc_feature (406)..(406): n is a, c, g, or t
  misc_feature (410)..(410): n is a, c, g, or t
  misc_feature (433)..(433): n is a, c, g, or t
  misc_feature (456)..(456): n is a, c, g, or t
  misc_feature (467)..(467): n is a, c, g, or t
gcgcgggctggccctcggctggtgctgaacgaggaggcggttcgggcgaagagcggcttagggcctcancgcgacctggctgagcttcagtcattgtctantcctggaanttaanaananaanatnanccacctggganattctctgatgagtttaanaggtctgaaatctttggatctctcgcgcaantccttggttagtctggagggcattcaataannaaangaatatggaaaaaanaaanananaanaaaaaanaanannntcgttggcaaaagtgtttcggctccangccttaaacganctcgtggatgtgganttccggctgaannccgtggtgaaagttgagcctgactanngcctttttgttgtgcacctgctccccaanctccaananctgganganagcnccgtgagaacaagcgagcggaangcttcccgaatgcattttgcatnaaaggactcantcgactccaaaaaaagcgtcccagcttctttgaaaaaaggaaaacaaaacacaacccaaaaccaagtgcaccgaggccttggccaagcagagcctggtcatggatgcggatgacgaggcagtcctgaacctcattgcagagtgcgagtgggacctcggcaggcctcccgggagcacgagcttcagccagaaggggcgtgaggccgactctcgtggttcccaagaatccagacatctgttgagcccgcagttggtacagtaccagtgtggggactctgggaagcaggg

SEQ ID NO: 641334 - DNA, 873 bp, Homo sapiens
gcggacccgaagcctgcacagggctgccccgactcccgcccgccatgcccgcagccccgatgccccgcgcgctctggctggcgcacgcgccctgcgtccgggaaggccaagctgacgcacccggggaatggcgatcctggcagtgctggacatggctgggtggcatcgagatctgcatcaccttccccaacgagtacgtgaagacgcagctgcagctggacgagcgctctgcacccgcctgcggtacctggggcatcggggactgcgtgcggcagacggttcgcagaccatggacgtcctggtgcctgtaccgcaggccattagcatcacctgcatctacgtgttccatccccaatggactggacgtacaggttaggaatgttcagagttcctcaggcaaacacatgcggagatgcccagtggacggctggacagcactgcgtgggactgctgtgctggactgggcagctggactgtggccagaggaccggtggtggtctgtgtgaccccatggagaccatcaaggtgaaagtacatccacgaccagacctccccaaaagcaccaagtacagaggatacttccacggggataagggagactgtgcagggaacaagggctgaaggggacagtaacagggacacaacacaagaacacgggacaaggaagacaagggatacgaacgaaggcacatccagaaaaaaaagcgaagacctccactgagacaactaggaaccagaagaggaaaacagacgaagaaaagagaaggaaaaagagctgaatacatgaggagcgaccaggaagaagaggaggagagagacaaggaggcaagggaatcgacaccagatggatgacagagagaccagagggaacag

SEQ ID NO: 641335 - DNA, 137 bp, Homo sapiens
tgagcacacatgtctaaaacctataagacagaactctcccactatgagagccactgggtccgggaatgaatgggtctgcactaacttgtgtcttccacctctgtgagcatgttagtggagtgaataacatttattaa

SEQ ID NO: 641336 - DNA, 1997 bp, Homo sapiens
tttacttctcctgaaatgtgacagatattacattaatcagtagagaaagagtgaactcattaataaatgacactgggtcatacctggttaaatggaaaaaaattcattccataacacataattcacagaaagtactcaacagattaaaaatctaaaaatgaagagtagaacttcaaaagaaaatataggagaacatatttatgactttgacataggaaggtttgttaacacatagagtaaaccagaaaggaagagattaagttttaaaacttctgttcaagaaaagacaccatagttataagggaagcacaaatgaatgaagttggaaccatgtaccatatccgaaaattaactcaaaatggatcaaagacaatgtaagatctaaagctataaaactcttggaagaaaacaggtctgaatcttcaatttggcaaaggatgcttagataatgccaaaagcacaagctataaaagaaaaagtagataatttggacttcttcaaaattaaaaaccgtgtttcaaaggacaccatcaagaaagcaaaagacagcctacagaaagggaaaaaatatttgcaaatgatatttctgataagagtagtattcagtgtatataacaaaaagataacccaatttaaaaatgggcaaaggatttgaatagatatttctccaatgaagatatataaatggccaacatggtacattaaaaaatgctcaacatcattagaaattagagaaatgcaaatcaaaacctctatgaagcctgagcaacatagtgagaccctgtctttacaaaaattagaaaatttgcccaggatggtggtgtgcacctgtggtctcagctactcgggggctgaggtgggaggattgcttgagcccaggaggttggggctgcagtgagccataatcacatgattgcactccagcctgggtgacaaggttagactccatctctaaaagaaaaaacattatgcagtaccacttcacatctactaagatggctaaaatttaaataaagggaaagtaacaagtgttcatgaagatgtggagaatttgagaccctcgtattttgctgatagaaatataaaacagagcaactgcttggcagacagtttgctggtttctcaaaaagttaaacagaattaccatatgatccagaaatttcactcctaggtatatacccaaaagaacaaaaagcagagattcaatcctatacttgtatgccaacatttatagcagcattattcacaatagccaaaagctgggaacaactcgcatgtccatcaacagatgaatggttaaattaaatgtatatggtaaatacattacagtagaatatacagtggaatataattcagcttaaaaatggataaaattccaatacatgctacaacatggatgaaccttggaaacgttatgctaataaaataagccaaacacaaaaggacaatattgtatgtttccactaatatgaggtaactggagtagtcaaattcatagagacagaaaatagaagttaccaagggttacggggaagaggcaatgatcagttactgtttaatggatacagagtttcagtttgggatgatagaatagttcagatctggaaatggaccgttgcacattgtctattaatgccacttaattgtacacgtaaaaatggctaaaatggaaattttcatgtgtatattttaccacaatataaaaaaaattaggccggacacagtggctcacgcctgtaatcgcagcactttgggaggccgaggcaggcggatcacaaggtcaggagatcgagaccatcctggctaacacagtgaaaccccatctctactaaacaaaatacaaaaaattagccaggcgtggtggtgggcgcctgtagtcccagctacccgggaggctgaggcaggagaatggcatgaacctgggaggcggagcttgcagtgaggccgagatcgcaccactgcactccagcctgggcgacagagcgagactccgtctc

SEQ ID NO: 641337 - DNA, 440 bp, Homo sapiens
  misc_feature (13)..(13): n is a, c, g, or t
  misc_feature (47)..(47): n is a, c, g, or t
  misc_feature (419)..(419): n is a, c, g, or t
  misc_feature (438)..(438): n is a, c, g, or t
  misc_feature (440)..(440): n is a, c, g, or t
aatttaaataggncctcacctaataggggaaatttggcccctcgagncccaagaattcggcacgaggggaaaactggatatcccatatgcagaagaatgaaactagaccccctacctcctcactgtagacaaaagtcaaatcaaggcctaggcatggtggcttacaccctgtaatctcagcactttgggaggctgaggcaggcgtatcacgaggtgaagagattgagaccatcctgaccaacatggtgaaactcacccccccccacccactaaaaatacaaaaattagctgggcgtgatggcatgtgcctgcagtcctagctactcaggaggctggggcaggagaatcgcttgaacccaggaggtggaggttgcagtgagctgagattgtgccactgcactccagcctggcgacagagnaagactccatctcaaaatnan

SEQ ID NO: 641338 - DNA, 115 bp, Homo sapiens
caagaggccgggtgccgctagaggccgggtgccgctagaggccgggtgccgctagaggcccgggtgccgctagaggccccgggggagggggtttgtgggtgggggtaccgagctc

SEQ ID NO: 641339 - DNA, 157 bp, Homo sapiens
ctgcttctgctttgggcgttctttgtcctttcgactcttcttctggtcccctctcgtcgtgtgtgggaagcctctcgcgctgcgtggatggtgaggctgaccggcttctcctcccagagatgaaaccactgccacctccccccgtggtcccacctct

SEQ ID NO: 641340 - DNA, 316 bp, Homo sapiens
agttacaacagctattgaaagctatgatgggttttatttttgaaatgactcaatatgtatgaggagccgccctagtctgtgtgataacgagtggttataacagagtgaatagccggattctctcctacgtggcacccctggacctgaacttcatggacctgctgaagtaactctcctgtagtacacatctgctgaggactgaatgtcgacgtcgccccaaattcatatgttgacatcccaagccccacagtgatggaatcaggaggtgacgcctctggaggcgatgagttcatggagacagagtcgccacacatga

SEQ ID NO: 641341 - DNA, 152 bp, Homo sapiens
gggcataaggtagcgttgatttactttgctgatacggcagcttatctgcacgctaagcggcgggacggtgtggcccaagagatgcttgagagaaccccgagttttacgccgcctttgccgctgcatcaagaagtcaggtaaaagttggaagt

SEQ ID NO: 641342 - DNA, 188 bp, Homo sapiens
tcgttgtgcagccgagtttatcatcagggcggttctgttagtagtcgtccagtgagggctgcgagctcggtagaggccgaggtatacggacgtcttggtggtcagaaccctggtgtcatagatgccctttcctcagaggactgagatcatggtttttagaatgaaagagttaaagaaaccttgctgtt

SEQ ID NO: 641343 - DNA, 182 bp, Homo sapiens
cgacctggtgtttaccgttcggacagcatgggccgcggtgcttcgtgcgacggtgtcggcggtgtagccggtaccgttgcgcttgttgatcaggaggccagaccggccttgccggaatacgggagggacattggagaaacctcttggttagtgtcgcgcaatgaaaactaaactggccctag

SEQ ID NO: 641344 - DNA, 307 bp, Homo sapiens
  misc_feature (12)..(12): n is a, c, g, or t
  misc_feature (91)..(91): n is a, c, g, or t
  misc_feature (108)..(108): n is a, c, g, or t
  misc_feature (134)..(135): n is a, c, g, or t
  misc_feature (182)..(182): n is a, c, g, or t
  misc_feature (242)..(242): n is a, c, g, or t
tggacttactgncacgtaaaaatgaatggatacaatttaatcatccatataccgaaaaaccaaggttatggcacacagcttgtgccagcgnatgaaggagaagtaatnctgtttttggtggatgtgccaacaanncttgcttgtccccatcacagagctgcacacagtaagtgaaatactanatattttcagcttcaacacaaaatctcttgtacgcgctaagctatagaaagcagtcattntcgctttaaaagaaattgttagccaaactccatggaaactgcccttcacaaaaacacttacttca

SEQ ID NO: 641345 - DNA, 159 bp, Homo sapiens
cacgaggggaagtcgaggcacacttgcccgaaaaggtggactacgtcatcaggtgcgacatgtctgcactgcaccgactgctctaccgccacatgcaggccaagggcgagctgctgactgatggctccgataacgacaagaagggcacaggcggcacca

SEQ ID NO: 641346 - DNA, 130 bp, Homo sapiens
catctactggagaagcgttgtgaaaacggacattcagatagcgctccctatctggtgttatggaagagtggctccacggtcaggctaggtgcaaaacactttattgatgtaggagctggtgtcatagatg

SEQ ID NO: 641347 - DNA, 403 bp, Homo sapiens
  misc_feature (1)..(1): n is a, c, g, or t
  misc_feature (234)..(234): n is a, c, g, or t
ntccggcggcagagctccaccgctgaggccacgaggccaacctttttaacattttgaacaggggcaactattactgaactggggatggctaaacttaagtgggggcagatgggtatagtgcagtgtaatgccatcactgagcactgcaaatgcaagactgaagaactaacagccacatctcagacgctggaccaggggcaggggcaactctttctggatgggggggggaaaaanagtacagccatcttctaactgcatgcctgcaaagatgagcctctgctgggcggggaggatgccttccttatcctggatattgggctccacattttcgatggggtcactgggctccacttcaagggggatgggcttgccagtcaggggcttcacaaagatctgcattttg

SEQ ID NO: 641348 - DNA, 393 bp, Homo sapiens
cttgacaaatggtataacattacagcacacaagatacagcagaggtgatcaaagtggacatcaccagtgataagtcatgctgatagtatgtacccttgatacgatgtaataaatatggtattttacctctgtcctctccctccccaaacccatcatcccaatctaatcctgagaaaaacatcataaaaatcccaactgagggacattctacagaatacctaaccagtacccctcaaaactatcaaggtcatcaaaaacaaggaaagtctgagcaaccatgataaccaagggagcccaaggagacacaactatgaaatgcagcatggtatcctgggcaagatactgcaatagaaaaaggacatgggagaacatctaaataaatacaggttttac

SEQ ID NO: 641349 - DNA, 158 bp, Homo sapiens
ttcgacggaagcaaacaaaacaaaacaaaacaaaacaaaacaaaaccaaacctgaacttgagaccattctcatcacctgtcttgaaattttactttagcctcatgagcgacagagcctactatagaccccctcgtcgctgcctcggacaagacatacc

SEQ ID NO: 641350 - DNA, 101 bp, Homo sapiens
ctctagagtatccccttcattacgcaatttaaacgtagaactaagattctatctggacaaccagctatcaccaggctcggtaggctttgtcgccatctatc

SEQ ID NO: 641351 - DNA, 132 bp, Homo sapiens
tcatcgaacaccctgctgatgggctcttcttgcagagctacaaagggcaaggggtgtgagcagtgtgctggggagggaaaagtgatagattcacattcctataatcgtgcctattttgtatgtaatggacat

SEQ ID NO: 641352 - DNA, 595 bp, Homo sapiens
  misc_feature (542)..(542): n is a, c, g, or t
aggatctagaggtcgtataagcataccaaagcctgtctttggagcacttgagggagcttgaatgaaaggtgcagatagagcagtaccttgatcttatctttctgagtgtcctgcttgttgcatcctgcatggatgagtgaatgcttctatgcacgaggagactcaagccaactcagagtctgctttttccaacgctcttcccaggtttcttttgcaaaggcttggtcatttggcccaggtcttcctggaaagtggagtacatgtcactgactagggtggcgtggtgtctttacccttaacattaagtcttgttacctcagtgatgtgaagccaatggttggaattataaaaagcatccttgctggttcttcacaggacactggaacccaccctgtcaattcagctagcatgtccacacagtcttgatgatccctctctgtaacaggcagctaacattaagagaagggggaaagagaagaagagagcaatagcttatgggagagctgagatcttacttcgttgacccatatttttcccctgancaagttacctgtaaactggaatttgcaaggggatgctgtgatgataagccctt

SEQ ID NO: 641353 - DNA, 253 bp, Homo sapiens
  misc_feature (239)..(239): n is a, c, g, or t
tgtgcgaatatcatgctgaactgtagtcggtggtggccaggtggttgatcagcgcgcggtagaactcggatttgccgtgcttgtagaaaccgatggaggtgtacaactcggcaatgtgcttgcccggcaggatgcgcttgagaaagccgatgaattccgctggcacgggtacatcgaccatgaaataggaacgggtgaacgagaagatgatcgacacgtcggcttcgtcagtgatcaangcatcgatctggat

SEQ ID NO: 641354 - DNA, 842 bp, Homo sapiens
tctccacgaggtcgcgctgggctgtacgagtgctgggccggccagaggctgtcgggtagcagccggggttatgctgggcacggattgcatgctggccatcattctggtcaactgcgatgatgacttgtgggggtgaccacaggtctggaggtggaaggctgtgccttgccatccatggccatgtgacggagagaatcacactgagtgctgacaggatactttagctacgtggtcaatgtacgccacgcggttagcgaccacaagtggtcaagacgccgcaacctgggaacttaggagatgcagaggacccaggcacgggaacggaggggatctggggactgcggccccccaaagggagatccttctccagcctggagagttcactggaccggagtaactctctgtcctggtatggtggggaatcctacatccagagcatggagccaggggctaacgtgcttagcagtccgctctctgggctgggtagaggtacctgaagaggacctggcaccggggacagacgcagtatttgcagtcaataactgtatccagcagctggcccagacccgctagccggaagccagcctccaagatggtgcctgggggccagaacattgctgatgatcctgaagaagggatgccatgagcatagtgaatcccctggaccacagtctgatccacttgccagactctggtgcacatccgtgatgtgaggcgcagtgagggagctccaagggccggtgaggattgcctaaattccgccaagcaagacgctactttctcacctcccggctgcaggctgtgatacccactgatgctgattccccaagtacttgaaacac

SEQ ID NO: 641355 - DNA, 145 bp, Homo sapiens
atagtgtatatggggcccacagctactggtgccagaacacagagacagcagcccagtgcaatgctgtcgagcattgcaacacgccatgtgtggaactcggaggaggaatattccatcttggcagaaaccacagcattggtttatt

SEQ ID NO: 641356 - DNA, 361 bp, Homo sapiens
ggtcccaccccgctcccttaggagggcctgtccaaactttttaaacccccccaaccgcctgccaggatgggctccctggtcattgcagggccaaaaaaccctttctgcccgaacatcaagggggtccctgccccaaaattaggcaagctttttatgggcccggcttttccagaaaacccccactaaaaaaagggagtttcccgaaaaaaaggttaccttaactttttaagtcccccccgggccactcttggaaaaaaaaaatttggctatttaaaagccccaagggtttttttaggggccttgcccattttgggtaaaacagggtctttttaaccctaataaaaaaaaaccaaatttttta

SEQ ID NO: 641357 - DNA, 770 bp, Homo sapiens
gcaggcccagaggactggggtgactcacgggccctgtgctgtgatgttgagagcggagaaaaagtcgtcctaaggccctgagcccctatgcctagccctgtcttggtcccccaatccccagagcttggagtctgggccccagatccaggcctgccttggtcgctgagcctcagagtgtggaattgcctgccctgtggacactggtgctgtggaacggtaaggtcttcccctatcacatggcggaccccggcctctcaggagtagacctccctatcttgcccctgccagccagcaatgcagcacgcgtgcatgggtggggccagtagctcctgtcgggcctcgagaggacaccttggtccatgcatcgagtgcatgctagaacggtgccgtggtgcgaggtcaccgcggggtcgaggcaaggccttcgcacaccgtcagccaacctgaggtgcccctgggaggctcctctggtgctggttggtgctgggttctgtggggcgcctacaggtaacccttctacggggacggcaagatggcaaccttcagtgtacccctgtatagtagacgaagcacgggggatccacgtcctggtgaggtgcgtgctggtgttgctggcctccacctgctcgatgtatttccatcgctcgctagggcagttgggggccctcccacggtgtagctgacagccaacaaccctgttttagccctccactagggcccaatggtgttccgagtgtgttggggtcttgaagcgcgaaaataaagaactc

SEQ ID NO: 641358 - DNA, 194 bp, Homo sapiens
aattccgtcgaactccgccacgataggtccgcgataggtcttgttgacgaatagcttacgaatgaactcgaaagcgtgccccgtcggatcacggcggttgatcgggtcgcaaagagcaaatgagtaggtattcaaccctccttttgcgaatgggctgtcgctgtctggactgttgaaaccccagaagaagaggg

SEQ ID NO: 641359 - DNA, 179 bp, Homo sapiens
  misc_feature (122)..(123): n is a, c, g, or t
cattatcctcctgcttgaactatagcaacagccttcataggctatgtgtcccgtgaggccaaattatcatcctgaggggccacaataattacaaacttactattcgccatcccatacattgnnacaactacacctttcctatacatagggacagacgttattcaatgaatattacgagg

SEQ ID NO: 641360 - DNA, 193 bp, Homo sapiens
gaagccgacgatcgccacccccatcgccagcacccacatgcgcatgcgggtccagtcgcccatgtgaacgatgtcggagacggcccccatcgtgcagaagtgggtgcgctgggcaatggccccgaaggccaccgacaaaaagaaagcagcccagagaacctgggctgcgatggcttggagatcgacgtcttgc

SEQ ID NO: 641361 - DNA, 432 bp, Homo sapiens
  misc_feature (432)..(432): n is a, c, g, or t
tattgtagagatgggggtctcactgttgccagcactggtcacaaactcctgggctcaagtgatcttcccacttcagcctcccaaagttttggaattacaggcatgagccatcacacagggcctgtttcactttcttatcattcatgagctcactggagtaatttttttcaagaacttttcctttgcattcacaactcaggtaactttagtgcaagagccctagcatttggcctgttttggattttgacatgttttcctcactaaacctaatcatttctagcttttgaattaaagtgagagacgtgacttttcctttcacttgaacgtttagcccattgtagggttattaactggcctaatttcaatagtgttgtgtctcagggaacagagaaacccaaggaaaggggagagagggatggggaaacagccagn

SEQ ID NO: 641362 - DNA, 213 bp, Homo sapiens
  misc_feature (98)..(98): n is a, c, g, or t
ttttttttccccggggggccccccctttttgggggctttttttgggaaaataggggggggaaaaaaaacccctttttttttccccaaacccctttttngggggggggggggggtcccacccgccccttttttaaaaccccccttggggtgttttttttttgggggcccccccaaaaaaggggggggggggggggtttttttccccccccccca

SEQ ID NO: 641363 - DNA, 937 bp, Homo sapiens
ctccccagaacgttctttcttccaaccgcccagggggggttctcctgggccgcatggggttgaaccgccccccccgagcaaccccagagggtccttgggggaatatacagggtttcttccgtgcgtctctcggggacaggagcattcccttttctcttgcggcgcccacacccaaattttggcgggggctccagtagttggcgcacccacttgttgctcgttccggtacaccaatcccccgctgtagttcgttctttttcggagaggagcgtctttttcttggtggccgacaaaagcacgttcccccccaatttttctcgagacggcgtgttgaatgggcggcccgagtttccccccaggtgccccttgggaccacccaacccgcgtcgataaggacgcgaccctctccttctgtttctcctcttgtctccctgcaaggggccaattttctctacgggcgtttctctcacgccagcgtttataccccccccctccttcttacactcgggacaccaccactccctgtcggtggtgtgacttacacggcgggctgtgcccccccagagagtgggtgtagaaacacgcggggtacccctccgaggacaccgcctttccatgtccgagtcccctctcctcgggccttctctttctcttttggccagaagaggaaccttttccctaccaaccggccccacaggatggtcgccccaacttccaccttgagcgctctcagctttctagcaaatatttactgtggaagagccttcctcactaaggggcccacccggagagattttcccccccccccacccgctttcccaggggtaaacccccaaaaccccctggaggtttttttgggagaccccccccaaccccctggtcaatttgccctttttcctggtttgaggtccactttaaaatacattgaggtttctta

SEQ ID NO: 641364 - DNA, 200 bp, Homo sapiens
tttttcccccaaaaaaaagtaagtaaactaaaccccaaaaacatataaataaaatccctcccttttgtgggggccctgcaggggggcacccttaatccaaacccctggctatcaaataatcaaaatgtattgtttcaaacaggatttcagttccgggaggcaggggcataatgggggagggggccggaggttgaaagcca

SEQ ID NO: 641365 - DNA, 122 bp, Homo sapiens
ggctgcaggatcggcacgagagagagagagagagagagagagagagagagagagagagagagagagagagagagagaggagagaggagagagagagagatataatagtgcgatctagaggtc

SEQ ID NO: 641366 - DNA, 344 bp, Homo sapiens
atgtctttcatacagactttcagttggtgtcgaaagggtaattatattttattaaattttaaaagagcatgttttataatagcactatatcagacataatagtttaaccatgccataaatggttgtgaactgttgctattattttagtgccagcatttattggcttttacataaacctgttatgtgataagtttcatttttccccttatacctagttgctgtgtagtaaacaacacttccacattcttgaactcgtatacattgactgagcttttaatttgctcaggaagtgtaggatggtgaattagaactgttgtcaaacctttttccccaaggttaactgg

SEQ ID NO: 641367 - DNA, 448 bp, Homo sapiens
tattaatatagctacttctgctttcttttctctaatgtttctgtaatatatcttttttccattctttactttcagctggtttatatcattatagttgaaatgagtttcttgtaaatagcatgtatttgggccttgttggtaatctactttgccaaattctgtgtttaaattggaacatttagaccatttacatttaatgtagttactgatacattagggtgtaagtctgctattttctttcttgtctctttttaattctttctatcttttatatatatatttaaaaaaattttttttaagttttttgagacggagtctctctctgtcatccaggctggaatgcagtggcaccatctcagcttactgcaagctctgcctcattcctctccatgatgccccctgctctgggcttctctcctgttttccccaataaatatgtgcctcatgt

SEQ ID NO: 641368 - DNA, 248 bp, Homo sapiens
cggttaaggaacatctttttagagctgcaaagtatcgattatgattcagggtgacagcatgctaggggctgcttcattaggcaaatggtattcataagcagaatggagtagggtgttcagtatccagtggccagctcctcaaggacttgtctgtgaaccacattacttctgcttggcctattgctgggctggtgctgtagggaccggtgaagggcagttctcaggcaccttgggtttgcagggctctg

SEQ ID NO: 641369 - DNA, 108 bp, Homo sapiens
caggtctttcccctcaaacggctgctcttgaaagtgcacaccacgatcaggttcaacatattcaacagttgaatgtatattatatgcctggcatggttctaaaaatca

SEQ ID NO: 641370 - DNA, 815 bp, Homo sapiens
  misc_feature (128)..(128): n is a, c, g, or t
  misc_feature (345)..(345): n is a, c, g, or t
  misc_feature (353)..(353): n is a, c, g, or t
  misc_feature (355)..(355): n is a, c, g, or t
  misc_feature (718)..(718): n is a, c, g, or t
  misc_feature (729)..(729): n is a, c, g, or t
  misc_feature (746)..(746): n is a, c, g, or t
  misc_feature (752)..(752): n is a, c, g, or t
tactgtcgctgcagccgccggaaaggtctccgtgacaagatgaagctcatcatcctggagcactattctcaggcgagcgagtgggcggtaaatacatcaggaaccgatcatccagtttaacccagggncagagaagtacttcaccctggggctccccactgggagtaccccacttggctgctacaagaagctgatgaatactataagaatggggacctgtcctttaaatatgtgaagaccttcaacatggatgagtacgtgggccttcctcgagaccacccggagagttaccactccttcatgtggaacaacttcttcaagcacattgacatccacccagaaaanacccacantnctggatgggaatgcagtcgacctacaggcagactgtgatgcctctgcaagcacgcacgcatcaccggcctgcacggctgcggatcgcagcctactccgctccgcgcacggcactcggccctgcatggcaccacacttgccttcacacgagccaggctccagtctggctgtccacggacccgtgtgaaccacgctggccactggcctaccatcctggccaactgctaggtctcttcgatggagaactcaccacagtgcccaccatggccttgcacggtgcgcggtgggccactgtcactggcatgctagagcaggtgatgatccttatcacaggtgctcacaaggccattgctctgacaagccntcgcggcgggngtgacacatgtggccgngtctgncttcggcgcacccgccccgttggttgcggcagatccctgggtgagttgagccgtagtttccac

SEQ ID NO: 641371 - DNA, 156 bp, Homo sapiens
tcacttcctctacccaaattcatacctccattttccccgccctcatctctccccagtgtcctcaatgtgggaagagggagaggtagcaatccctacggaatccaggcccactccactcctgtctcctggcaccagctgggacaggctgatgtcttg

SEQ ID NO: 641372 - DNA, 311 bp, Homo sapiens
  misc_feature (285)..(285): n is a, c, g, or t
accataatgtagaatcagtgggcgtgttaagcttgttttcctgcaactggatggtcccacctgagcgtgatgggaggaagtgacagatcaataggtattagactctcattaaggacagcgcaacctagatccctcacatgcacggttcacaacagggtgcgttctatgagaatctaatgctgctgctgatctgagaaggtggagctcaggcgggaatgtgagcaaaggggagtggctgtaaatacagacgaagcttccctcactccctcactcgacaccactcanctcctgctgtgtggctccttgcggct

SEQ ID NO: 641373 - DNA, 124 bp, Homo sapiens
tctttgatctgattttctccaaggctccctcgctttggcttctcctcttcctcctcctccttttccttgtcttctttcttgctttcttcaccatccctccaatcattcttctggtaggacttgg

SEQ ID NO: 641374 - DNA, 1228 bp, Homo sapiens
cgagcgtctcagcgcagcgccggccgcgagagccagtacgaacgatcccagcacctggccggatggatgcgtcgcaagcccgacatgcatgccccaggatttgtcagaggccctgaggggaggccagccaaggagagtgcacacccatggcagagaagtgctgagttcatgaggaacgtttcagaagggcctaggtgacccgatgacggcttcaagctggtgatggctctcctctgtacctacatcttatgtggccctggaggaggagattgagcgcaactgaggtagagctccagtcttcgcccctgtctactttcgccaggagagtagctgcaaccgctaaggtctgcaccatggcatgcagggaccctggtccatcctggtagcgggcacccagcgtggccgtgaggtcatcaccgcatacatcgacctagttgctatggtccagtcgacttagtgatggatagcgtgcctcctagcagaggtgggaggcgcggcattgaggctcgcagaagccttgctgggtggggcacccacgaccgtatcacctcgtgtacccttggggtgaatcctgttcctgggggcgccgaagcgttgctttcccatcacaacggaatttcgcaccctatgaaaacgccccgttgggaccccttgctcaccaaggcatctgggcgccgaccgggcgcccgtgagctccttatcgttctacatgcgtattcacacacaagtatttttgccagtggttgttcgaaccgaagggttcccacatcgcccagtgcttcgttagcccggcgtacccccgggtcaccttgaaaaatacttcccccctggggacagcgaattggagggtacctccggccatggtaccgtgagccgtgaccaggtgggttggccgtttgaagaccttgacgcgggactatggggaaccttggcccgttttccccttggggcatccggattcaatgttccgaaagactattccttcactgaatgacggaacagtttgtccacaggtgtgaagaccttgggccgttaaagccccccaaattggaaacccatccccgtgagtgtggcagccaaagaaaaggtccccgcctattccggacacggtggagcagtccccacatagtgggacattttccggtcgccaagtgtcgcggggggcccactagacgcacagccaaaaaacgggtgtgcccaacagcgtaaatttcgtatgggcgactca

SEQ ID NO: 641375 - DNA, 198 bp, Homo sapiens
  misc_feature (14)..(14): n is a, c, g, or t
  misc_feature (36)..(36): n is a, c, g, or t
  misc_feature (172)..(172): n is a, c, g, or t
agagtagagcctgnaagtcgcaggactcactggatngatgttattcaactccttccagttgtcttgaacagcctgactcctgcccgtccctatggaagttccatgcattggaggaaaaacatgttggctctcttgatgtgggagaaattgaaaagaaggggaaggggaagtnaagaaggggaagaagatcaaagaagg

SEQ ID NO: 641376 - DNA, 191 bp, Homo sapiens
ccggtcctctgttagttccctgggtaggttctatgtgtatgtggactgaggtgtgtgcctgccctctcttctcccttgagctgcccctagcacctgctttgctgcaagctcccagagggcaagcaaggtgggatgcattatggtgcctgtacggctccttctctgggagcttgcagcacagcaggtcttgg

SEQ ID NO: 641377 - DNA, 817 bp, Homo sapiens
ctgcctgactgcttgttcgtctcactggtgtgagctccagcatccccttgctcgaaatggaccccaactgctcttgcgccactggtaagggaagctctgcgccctggaatccccatttcccagccctattacagagggtctctgggtttcaggaagtcgcattttaagttctgagcgacggggactccagtacttcgttagatgctttcttcctgatcacgcccctgagagcattgccctcatccctgggcctctacgtcagagttaagaatactgaggctcaaggctgaactgctccacatcacccagttggtcatgggcctgctggctgggccccagtgctctgtccaggctctgagcaatcagtgtggttgggggtgctggaaacattgactcttcagagttcaggacagaaggttctggctcgcagtctcaatattcctgggttgtatgtgcacgtgggaccttcctggtgcggtaaaacaggagggtccttgcccttcccagcgttagtggagaggacatggggcttctgttcctctgtcctgagtgggaaaggagctctgagggctgggcctgcacagaggagggggcacgtggagactcactgacccactgctgtaccttctgcatctcactcactgcccactgcgtattcctcttccttgtaggtggctcctgcacgtgcgccggctcctgcaagtgcaaagagtgccaaatgcacctcctgcaagaagagtgagtgcggggcatctccaggaatctggggctgtggctcaggttgggagggaactcaaggcgtgggcctgaatgcatc

SEQ ID NO: 641378 - DNA, 365 bp, Homo sapiens
  misc_feature (1)..(1): n is a, c, g, or t
nggtcttcctcgaatcgatcatagattccttgatgattatcatcactataagaaatattagaatatccttcaatcttcagtattactcgcaggtcgtctaagtgagatgcctgcagtatgcacaggtgtcagctggcttgaagaatagcacccacagtctctgaaccattggagtatagcattggatcttgatctcttaagctccagtctgcgggttgcatacataagaagctttggtcctggctctctgttccttacgatcgggaggagacagatagccagggcaagccgcaggcttctcccacattgcgggggttgtcacaaactcttccaacgggcctgcttccgttctctgtgctttactg

SEQ ID NO: 641379 - DNA, 705 bp, Homo sapiens
  misc_feature (319)..(319): n is a, c, g, or t
ctgcctgactgcttgttcgtctcactggtgtgagctccagcatccccttgctcgaaatggaccccaactgctcttgcgccactggtggctcctgcacgtgcgccggctcctgcaagtgcaagagagtgcaagatgcagccttcctgcataggaaggagctgctgttggccatgacgtgtccccctgtggtgctgtgccaaggtgtgcccacgggacatgacgatcatgctagaagggggcgatcgcgagaacgctgcaagactgctggtgcgctgactggtgggaagcatggctgcttactccgcaagaatggtaagantagcaacacaagccgtgcctacaatgcactggcaatatatgtattgtatggacatagtatcagacatctgagtgccactcttggcgtggcatttttctcttgttactagctaaacatgtactgtgcacctgatcatactaagaaaccaagttgtatgacgtttacagaaaaaagaacaccaaaaagtggtcggtcccgtattccttaaaagaatgagtccccgctccgaagagggcgccccaaaagtcgtgtacggtccgtttacccctagtcgttgtctctgggataccgcaaaagtgtgggttcccctataattacgtggcagttcggctaattacattaaagccttagggccaccagtgggccccgaacggatttttactgaa

SEQ ID NO: 641380 - DNA, 803 bp, Homo sapiens
gactcggagcgcacaaaccaggctcgccatgaagccaggattcagtccccgtgggggtggctttggcggccgagggggctttggtgaccgtggtggtcgtggagtgccgagggggctttggctggggtgccgaggtcgaggcggaggctttagcaagtgtctgtgggacgacggaggaggtggacggctggctggctggctggtggatgcgaggacgggaagagggttggtggaggcttccattctggtggcaacctgggggtcgtggtcgcggggcaggggaaaaacacaggatggggaaaaaacccgaggtccggcggtgcgcacacggacagttcgttgactcgggctggacgccagcaatctgcggcccattggacgcggcggatttgggtttcccttttccaaaccatctttgggtaccgacagggacaaccggaaccgaatgcacattggatccaaccgaaaaggaagaacccccatttgggggggcctttccccccccccttttagcgaggacggcggcaaaacaacttttcccgaagcgggcgctacttattcaactttcgggggggcaacggcaaaatggaacaaaccgcacacggaatgggtttccattaccgcggggaactttcttctcggggacacgcgacggcatcggacgcaccaatacttcgcatcgttcaccccagcaacggccccactttgggggcaaaactccgcccccattttttcccccggggccattctcccgaataccggggcacgctttcaacgggtctccacaggtggccccacacggg

SEQ ID NO: 641381 - DNA, 195 bp, Homo sapiens
agagggaggctaaggagaaaaaagagggagaaggaagagagggagagggagaagaataggaactggtacaacaaattgaatatcataacgaaattatgaaacaattaggtaaccatgtaagaaaagaagaagaggaaggagaagaagaaggaagaggaaggaggaggaaaaagagggaggataaggagaaaaaag

SEQ ID NO: 641382 - DNA, 376 bp, Homo sapiens
gccaaacacgcagtctgattattttattgtgtatattgtacgtatgagcatgatcacattatgtttcatggctttgaacactgtcatcttcttattcacttcctggtcatttgatcctagattactgaggagactagccctgtggagggtccttgtgggcggcccccttggggaggtggtccctggggctttccaggaggaggtgggggaggaacttgctgataggctccctgtttgggtgggccttgtgtgcttactcgaggaggacggggatgggctccctagtttgggggaggtccttgtgggcttccttgaagagggagggggattggctccctgtttggggttggccttgtgggtttcccttgaggaaggt

SEQ ID NO: 641383 - DNA, 100 bp, Homo sapiens
aagaagtagaagactcagaattagaagaggaacatggagctgatccaggacacctcccgcccgccactggagtacgtgaagggggtcccgctcatcaagt

SEQ ID NO: 641384 - DNA, 503 bp, Homo sapiens
  misc_feature (179)..(179): n is a, c, g, or t
agaagagactagatgcaattgaagacagagtaatttggaagatagagcttagggaacttcacaaaatgggttacagtgagacaggtagaaaatgtgaaagaatagttgagagcatagaataagagtctagttggagatccaggaatagaaagcagaaaaaatcctggagagaaaaatantcaaagagatggcaactgagaattagcctgagaaatgcatgcatgaggtcttaaattgaacaagtacatcaagttttgaattttcaagtttaatgggaatgataaatcctcagatccaagaagctgaacaaaccccagtcaggatggacacacacacacagtcacataagttaatcaaattactgaaaactggttgtattgagaaaaatctttagccagaggaaaagccacaaattacatgggaacaaaactgatgataattgtagacctcttgttggaaaaaatgctcctggaagacagtggaatttgatctttcacttggta

SEQ ID NO: 641385 - DNA, 429 bp, Homo sapiens
ggactgcaccgcccgccctgccagacccgcccggaacggggctcgtctgccgccagtagccgcagcaccgaggcttgggcctcgcgccggtatggccgtgcctggggctgagccctcaggttgtgaccgagattcccgacgagagcagactgaggggaagacgaggaaggcaggggcgggctccgtggcaaaagcaattccgcgtcctgagcggaatcctgcaaaggatggagcaaggaggaggagacaaacccggggagctgctgcttgccccaatttggcagggggtagtgggctcccccaccgggttcttgacccaattccggccccaaggagggggaccagaccgggggccgtcctttttgttgccaacgcgagggtttgacctcgcaaggaaagatttcgccctcttgtgggagagggtgcccc

SEQ ID NO: 641386 - DNA, 161 bp, Homo sapiens
agaatgccctaggacatttatatgtactataagatggacacgacgtgacccataggatggatttaagaagaatgatacatgagattaggagacagtgtgttgatagtcaaagggccagggataaagttcttcctgtggcctgagtcacacccctcagttct

SEQ ID NO: 641387 - DNA, 131 bp, Homo sapiens
tagtagacagcacagaggaggtcaacgatccctcccttaccatcaaatcaatttggccaccaagtggtaactgaacctacgagtacaccgacatacggaggactaatcttcaagtcctacatacttccccc

SEQ ID NO: 641388 - DNA, 373 bp, Homo sapiens
  misc_feature (372)..(372): n is a, c, g, or t
ggcccattgcaaaaatgcattcatccaaagcgacacatgtggcaacgtagccccccccagtgaaataagccccttggtgatcccctgactccagttctccgtgtgctccattggctgcggctgcaggagaaaaatgcttgacagccttcatgttttccgcaggggggcgttcacaaaaatgccaggggtgtttattgggtttatttttttaattactaaaatcagtagttaagaaagggtccttgaaccctcttaacttgggttggccctttgaaaaatatatttgtagcccatattatagatggaaaaaagaagatatttatttatccctgtgatgccaattgtcattaaaaggcttttcatggcttgccna

SEQ ID NO: 641389 - DNA, 246 bp, Homo sapiens
ttaaaccttccgcccggtgaggaaacccggggtggttgttcccccgttggggccgcccccccaaaccccggccgccccgggccgcccccgcaccccgcccgggccgggttaaaaggaaaaattccaaaaagggccagggtggggctggggctggaaaccacaaggaggaggattaagtccccctgtccctcctgggggggtggaatgttttgttttcctgccaaataaacagggtcagggttttta

SEQ ID NO: 641390 - DNA, 851 bp, Homo sapiens
  misc_feature (803)..(803): n is a, c, g, or t
agcggggggggttgactgcccgtgggcgtaagcggactgtatccgcgagctcctgtcaggcggggggatggatgcggcggtcgagcctggaaacctggccggcgtcaggcactatcatcctggtctctcttcatggaagaggggggctgttgggaaaagctagcatctccacggagctggccctggcactgcgccatgcaggccagacacggtgggaatccgtggcatgtggacctgtgttgccccagtatcccccgcatgctcgggggcgcatgggcagggtctgtgcactcacgtgcgaccgcggcatggagcatcgctcgtcttcgctggagccgcgtggagcagtagctagtctcgctcatgtctgtgtggcttcctgctgtgagaatacctgtgacgagagccgtgagtgtggagcaggccccaatgtaccacgtgctgatacaagcatgttttgctgtctcgacgtgtgcctggggcggagctgtattacctggtggtggacatgctccccggggaactctccgatggtgcactttggccgaggcatagaagccctgcgtccctaccagcccctgggggccctcgtggtcaccacgccccaggtggtgtccttgggggacgtgaggcgtgagatgaccttctgtaggaagacgggcttgcggttgatggcgaatcggggagaatatgagtgggttcacctgcccacactgcacggagtgcaccagcgtcttctccaggggcggcggagaggagctggaccagctcgccgaggtgacctgcttaggctccagtgcccntggaccctgagctcatgactgacccttgagggagggtcacgccttcat

SEQ ID NO: 641391 - DNA, 918 bp, Homo sapiens
gaggccttacggtagctcgtagtttctcggacgggccgctcccgtgggctcgtgggctctgctctccacactacaactcccacggggcagcgggcgcggctcccctgtacccaccgagctggccgggcagggcatccatttcgcggtcgggcccgccggctgcgggcacccgcgcgatgggcggtgaacgatggcggatgtggtctgtgggtaaaagacatatgggcggaggtaacgcagcggacttcatctcgcatgaccatcatatccctgtcattcccgggtcatccatgataggaaggtctcccccgagagtgtcctaagtcgatcaaccgaaggaaggcggttggtgctcagcggacataggcgcactagagtgtctttgttcatagtgcctagccacgctattcctacagaccacggcagtggaaaggacaaagaaagtactgacttacagttgattgacccaaacatctgcacagtcaactcagaaaagcttttcaagtttcttgcagatatattaccaacagaagattttacgctagtaacattacctgataccattgcttaacagagacacagtacagaaggacatgagtgacaggagaggacggtacagcgacgaaaaaatggcaaggggagcctggaaaaatggagggaagagaaggacaacgcaaaagagacacgaaaatgacagacatgacagaaaaggctgcggtggacagcaggagcaggaacggccacgggaattgctcgcgaggggggcaacgaaaaaaatcggcagattgatgacaccacagaaaattgtgctggcgcacaccgggtatacgaacaaaatgcaaaggaggccctgcgttagggtattccttccagagcacctgggtggaacaatctaccccacaattggcgttctgacaa

SEQ ID NO: 641392 - DNA, 416 bp, Homo sapiens
  misc_feature (384)..(384): n is a, c, g, or t
cctactactactcatctttcgggcacatcctcacctcacctaacctttcatgtcactgaccacagtgactttccacagaagcacagctgcttaaatgctgggtgggttttttggtatgtcttcacaaggcatgtcccaaggatacatatataacactcttattttaattggtttttggttttttggagacagaatctggctctgtcgcccaggctggagtgctgtggtgcgatcgggctcactgcagccttcacctcccagattcaagcgatcctccggccccagactcccaagtagctggggaccacaggcgcatgccaccacacctgggctaattttggtattttaagtagacacgcggtttcactatgccggccagacggntctggaactcctgaccttaattgatctgcccg

SEQ ID NO: 641393 - DNA, 126 bp, Homo sapiens
ggtctgcctcgccagctgtccggacatacttctggtgggcactgtgcggaaacttgaggataaatcagtgagctgcatgcactttatacaggcatggccctggtctccgtcacttgagatgcaagg

SEQ ID NO: 641394 - DNA, 225 bp, Homo sapiens
tcgcttaggtgtactagtacgtatatctaaaactgtaagcaaaaaaaaaaaatgtggggcacaaaacaaattgtggggagaggagaaccctgaattcccttattggcatcagattgccccctccacatttctcattccataacaaaaaattcctttccttatgtgagccaccactaattggtagctaatctcaatctcttcactgtgacacacattccctgtgac

SEQ ID NO: 641395 - DNA, 1921 bp, Homo sapiens
ggtacctactagacataacaattctcattctcgctttaccttacgtgctacactgagactatgccatacatgcttaactgcgctgtcctattagaccgcgtggtaatgactaggatcacgacgaccggctgagtcatagcgtacaactagtcatgggtattactaaccccctatcttccttcatctagctctctcgtacatcacgcacaagcttagcacatccctccatttgacgcagccttcgtaactactagtacgtggtgcgaccatatgcccgctcttctgatacctgtgtaaaactagcgtgcacactaacagcgtctgctcctgcactttactacacacgatggctgcagatatagcaacaagtatcgctgtgagagtagaaagcgtttacactgatgtgagccaactagctattaccaccaacgaatgacgctcatctatactatatatcatacgacgtgttgtaatggctttgtgtacctactggacctatctagagacatgagtattttgtaatttgttacatgaacatagtgacacgcgtaaacgtaattgtttagaactatagaagggtcggatatggtaaaagagcttaaagtatgcagtggctatatgagcaatatgtgaaagatacaaggtaagtgggtcagatggaacgcgattttaggggtggagagggcatacgaaatttgaaccagggcattgataccactacgtggtgtaagatcacctcgaggagacattcactgattggcttgtactacaatatagagacaaggaattcgaccagcataattctcgctagcctatatataacaccatcatttgtgaaccctataaatgtccggaaaatcaatacaggcggaatcgtaaacactcaaggagaaattacctcttttcactacacatagtatggagacgcgacggctgataagttaaataagagataagttccttagtggggatagttaatgaaatggccagttgaaggcaaaagcactctatgcaaagattaaccatccaaatagggtagaacaaggtcattgaaacattcacaattttccgttggggaactatccagtacatatgcgacgttgtggacatagtcaacagtggaaagtagatgtatgagggtagaacactattgggatggaacacaacagtatggatctctgttaaaacagagccaataaattaacaatttcacaacctacaatattcgtatacacaggtattacccttaagggaatcacaccatcctaaacatattgattagtaacagttgaaccagacatgtatacccatttacaacttacaccataacatctccccaaagaaacacaacagttgtatccatcgacatcaaataaaatattaacaccgaaaaaacagtatcaccacagaagtagatatcaaactatatcatacgtaaaacagacaacccagccctttaatacacatctacaacatatgattaacacaaatctctaatccacccataacatactacaataattcctcaagcaaagctacctatcaaacgagcgaccataaccagcaccattacataatgaaacaagaaggagaaagatggagcggagcaagaagaggaagcacagagaaggtgacaggaacggcggagcagggatgtcgaacgaccaagcagagagcacaaacagagagagcagatggagaggaacgcggagcagaaggcaagacgaacgagacggagaaggcagacgatcgaaagagctgagggagatcaaacgaagagagcgagagagcgagcgatgagcacagagagagggagggctagagagatgtgcctccggcggcgggagtcgtggatgggcgctgatgacggtcagttcagagggcatgatagcagaagagaaagatggagaggatgcaagat

SEQ ID NO: 641396 - DNA, 127 bp, Homo sapiens
gacgatactcttgacaaccgacaaaacaagaaaggggaagtcataataaatgtgctgggaaaagtggctagccatatgtagaaagttaaaactggatcccttccttacaccttatgcaacaaattag

SEQ ID NO: 641397 - DNA, 172 bp, Homo sapiens
cagtacagcccagcgctcaggggagcaggctgctgcaagggtttgttgctgtggttattctggttcactggccccatcgcctccagtggctatggaaacaggccattctgggccagccacgtctctgcatggcagtgcccaagtcttggagttgctagtgggcgacggagct

SEQ ID NO: 641398 - DNA, 786 bp, Homo sapiens
ataacagacttcactcctatgctgatttttctggtgccactgaaggtattttgggagcagaattaagcagaggagatggtggtgtcccttggcaacacacccatttgtttttacaaagcttagatgaccatgaagaaaattggttgggaataattattaaattcacggacctttgagaaccctgaaatttttaaaaaagctcgggggggggggatgactttctggggtgctttggtgggtagaggcgatgctttgttggcggttgcccacctgtgggaagatgtttgtttgggctagagataacaataaaaccctacttatagtctcggttttacccgggaaatttgcatgtgtttgtgtgccccctcgcctcgttatagggttttgaatagcagggtttggtcgtttaggcgtttgggcacgatattttattatttcgcgtcccgcgggaccatatgcacggtttagtggcccatattacgaggcgccatgttttttgggtcgcatcaccgtcccagattttgtgcattactggcccattttgcgtttgcactatctcacctccaaaggatctctccagtagtttttcgatgtatccgcctgctcgcaacgagggtgttgttttgccctgccgccgcctgagatgagcgtgtgtccgaagattgtgtcgcagttaccgcatgcggtgttgtgtggcgatgtgtgtatttggtagtcggtggctttgctgatattcttacatcgctgttgtaagaggctatgtgtagagttatatatgcattatgg

SEQ ID NO: 641399 - DNA, 200 bp, Homo sapiens
tatacgggacctacagggtcagctttgtactgaatagacgcactcgccttgatgcgctgcgaacgagaagttggctaccttacagtcgccgacggtcagggtgtccagccaataggtgcctccgacattcgaagtgtcgacgtagtggatggagaatggcggacgctcatcggtctggcaggtgttcgacttgctctggt

SEQ ID NO: 641400 - DNA, 866 bp, Homo sapiens
ggctcatgctgtcctcatcctccttctccatcctcttttttctcctccgcctctccccccgagactcgccaccagtcgcggctattgtgctgtgaggcgcctgctgtcattcctgtgccggaggaaccggcgctgccggtgcctgggggtcggggcgcggtgcgaagccgggccgcggaggacacaacaggtagagcctggggtgtgcccggccgctgctgcccccctgcgcatcatgcagctctttgtcacctctctcgcccccaggcaaaatcctgagcatgatggaagacaataagcagctcgcgctccgaatcgatggggcggtccagtcggcacagccaggaggtgaccaacctgcgagccagaaactcaacggcaccaacctggagactggcggaactgagctggcgagcggcggccccggccctggggcccagggagcctgatggacagcgccctcggcaggcaggggggactcggcggagacagagacattggagaaaccccccaagcattggaagccgcaaaggtaggattcggccccaggaagacacagggcgagatggaacggccgaagcaggatgacacggaccacgagcctcgagaagagtggccagagtggaacaccggaggtacccccacaaaaccccctgggaggcagaaaaatcggcattatgacagtaccatgagctttgataaaccacctttatacaggagaacaggagagtagagacacagccggaatgactatcaccaggacatagggaaattgcaagtgcacatacatagatcaattcaacgaaaaaagcccagagacgcaagatgatgcaacaggggtaaaacacgaataacaacgttgcgca

SEQ ID NO: 641401 - DNA, 699 bp, Homo sapiens
  misc_feature (18)..(18): n is a, c, g, or t
  misc_feature (70)..(70): n is a, c, g, or t
  misc_feature (110)..(110): n is a, c, g, or t
  misc_feature (116)..(116): n is a, c, g, or t
  misc_feature (119)..(119): n is a, c, g, or t
  misc_feature (122)..(122): n is a, c, g, or t
  misc_feature (128)..(128): n is a, c, g, or t
  misc_feature (175)..(176): n is a, c, g, or t
  misc_feature (184)..(186): n is a, c, g, or t
  misc_feature (251)..(251): n is a, c, g, or t
  misc_feature (266)..(266): n is a, c, g, or t
  misc_feature (414)..(414): n is a, c, g, or t
  misc_feature (424)..(424): n is a, c, g, or t
  misc_feature (438)..(438): n is a, c, g, or t
  misc_feature (458)..(458): n is a, c, g, or t
  misc_feature (461)..(461): n is a, c, g, or t
  misc_feature (482)..(482): n is a, c, g, or t
  misc_feature (492)..(493): n is a, c, g, or t
  misc_feature (508)..(510): n is a, c, g, or t
  misc_feature (515)..(515): n is a, c, g, or t
  misc_feature (520)..(521): n is a, c, g, or t
  misc_feature (560)..(562): n is a, c, g, or t
  misc_feature (574)..(574): n is a, c, g, or t
  misc_feature (578)..(578): n is a, c, g, or t
  misc_feature (681)..(681): n is a, c, g, or t
tcctgtgcatatatttcntcaactcaagattagtggcataaaatgtcaggctgtctatgccagacatgcnctgccctatggcagggccaagtgagaggattgtcactttnaaagtnggnacnctttanatggatgatacgataacactggacccacagaccaagagcatccttcnnagcccccnnnccgcccgtaggaatggaagagggaaattggaagcagggtcccttttcgatcttcatgtgaagagncccagcctcttcaanggtatccaagataaacttccgttccccaagcccaccaatccctgttcagttcctttgcttcctgccctcccaaataggacattctccttttgttcccatcccccctttgcacagatcctccaaggggatgtcccatgatccacaaggnagataccttnatatgcagtagggnagggcaggtacacactatcnttntcccttattctatgtgtttgncactgacttnngcccttcatcacaannntctcnaatanncactgggagccataacaataaatctggaagtacggggannncatatcaaaaangggnaggatggattcccttgatgcccaggattacagggcacctaaagcacattttttttttttctgagccaaccagctaaaggatcactgcagctaaatacagatanagaagcaacaaagccagg

SEQ ID NO: 641402 - DNA, 216 bp, Homo sapiens
acttaatggagaaggactggatgaactgaggatcagccggaggagaaatgaggacccagagacatttattggggagtaggatgtggctaagtctttttttggccagattagcggattaagtcctggaagagtgtctcatatagtgggccccaggacttggaccctgggtgggaaataagggacaaggattggaaccccatttcccatggggatata

SEQ ID NO: 641403 - DNA, 269 bp, Homo sapiens
gactcgagttcggtaccctcggatagggccaagtaatgacaggtttcaccatgttggccaggatggtctcgatctcttgacctcatgatccacccacatcagactcccaaagtgctaggattacaggcgtgagccgctgcacctggcatttctttttttttaaaaaaagagacaaggtcttgcttgcccaggctgatctagaactcctgggctcaagcagtcctctcacctcagcatcccaaagtgctggaattgttggccttatcgag

SEQ ID NO: 641404 - DNA, 140 bp, Homo sapiens
cagtaggattagtcctctagctccatacttactcagttactgcagacccctctagctacctccttcattcactatacatcttgtattcccgaggatgtgaatctccctcaagaaagatccctggcgacctggagtggtgt

SEQ ID NO: 641405 - DNA, 381 bp, Homo sapiens
  misc_feature (17)..(17): n is a, c, g, or t
  misc_feature (20)..(20): n is a, c, g, or t
  misc_feature (23)..(23): n is a, c, g, or t
  misc_feature (38)..(38): n is a, c, g, or t
  misc_feature (57)..(57): n is a, c, g, or t
  misc_feature (61)..(61): n is a, c, g, or t
  misc_feature (71)..(71): n is a, c, g, or t
  misc_feature (105)..(105): n is a, c, g, or t
  misc_feature (110)..(110): n is a, c, g, or t
  misc_feature (119)..(120): n is a, c, g, or t
  misc_feature (138)..(138): n is a, c, g, or t
  misc_feature (146)..(146): n is a, c, g, or t
  misc_feature (151)..(151): n is a, c, g, or t
  misc_feature (168)..(168): n is a, c, g, or t
  misc_feature (179)..(179): n is a, c, g, or t
  misc_feature (183)..(183): n is a, c, g, or t
  misc_feature (185)..(185): n is a, c, g, or t
  misc_feature (231)..(231): n is a, c, g, or t
tttgtatgtctgtgctnagnggnatttactatgttccnttatacatggtgtttattnaggnttgagagtcncttgactgtgagaatgtacactgtctgggtttgncagcnattctgtannattatcattataatctgncaaatagnaatgntgcttctagaaaatttncctaggaggcnaatntngggaaggtgaagcactcaccataattccctaaattcatgttagaanatttcttgctatggttaaaaatgctgcttcctttgacctttatgaatttctgtacctttgtcattctgttacctttgtcattctgttattgcgctaattatattttaatgtctcctaattaaaattaaaatttggttgttggctaaatac

SEQ ID NO: 641406 - DNA, 258 bp, Homo sapiens
  misc_feature (17)..(18): n is a, c, g, or t
ggtcctcccccccaaannattttccccccccccccgggaaaaggccagccaccccaatttggccccccccaaaacccaaaaaaggggggcccttttccccgggccttgggaaaaatttttttcccttgccctcctcccccccactttggtttttttttttgcccccccgccctggccccaaacccaaaggggctttcccccccccccaaaaaaaaaaaaaaaaaaaaaaattaattaattaccttttttaaaagggga

SEQ ID NO: 641407 - DNA, 324 bp, Homo sapiens
tggagcctttgatgccagcagtcttagccagcgaaagagaagcaggtgatacaagagatgaacggtgaaggagacgaggacatcgtgtctaggaggccagcgaggccccagcctttggtacgaaggaaaatgactggcagtcgcgacttgaataggacttttaccccgattccatgctcagaattcccatggcatcgacccaccgagacaggaccactgtcagtgaacgcagagaggtctgtggtgggcctctgctatggcggattcgatccgttcccccagggaccatccacggatggcttcttccttcatgtaggcagggcg

SEQ ID NO: 641408 - DNA, 823 bp, Homo sapiens
gggagtttcctgcgagctcggcttcctacaacatggactgcgcccttgtccagtggaggtggagttctggagagtggtgcggagctccatgtaaagacggatattaagacactatcgagatcactttgcctggacagggacggaacccatgggacatccggaacctgctccatctggctcaaaggaagaattccggctaacaagagcggcccagagttgtacactcacaggggagccagcagtacgcgcgccaggacaattctggtgctcgatcaacagatagaccagacatggaagaaggctaagctggcgatgacgccatggacaaaaccaagacacattcagcgacccaagcgaccaacgacgaatacacataccatgtccataccctcaaacattccatgccaacagagcagagcatgacaggacccccatcaatcctaggcggacactgggaaacccaccattaaaaagaacgaagcaagacacacggacagccaaacgtcaagactcactccccccatttgggcccacgatggactaccaaagaggtacacacccgtgattcccaccggtttgcctcttggacgattacttacaccattggcatcatggaccgcgccgtaacgagctacaccatacaagagcaagagagcagaacagagggacacaaggtggcctcacaaaatggacaccattcccctcccaggcaccgctgaaacaacagagcacacgcacgcacacaggggccgacgaaagtccataggcaatacaccatatattacacggacgccaggtgagccggaggaaaggaactcaccac

SEQ ID NO: 641409 - DNA, 124 bp, Homo sapiens
agaggatacctgagtcgctgtatcagggggagtagtgtaatgggaagaaaagaaaggaggtcctgtggggccgagtctgccgcgagcgggcagtgattggcgttgactttgcaaacagaaggca

SEQ ID NO: 641410 - DNA, 1158 bp, Homo sapiens
cttagatatgtctctcccccacccgtagcactggcttttctggtctctttaccattgaattaggcctggtctagacttcacgatctttatacctgagagtacagaaaagaggcttaatcaagaatacgtcgagttctgttcgaataagatcccatccgtcatcagatacctttctacagcttctctgtcacgagtatttgatcactgctcatagaacctggcactagagatttcatgtggcgaatgtactcccattcaaaaggaaaaacattcaacaattctaatatttaattgattcacatcacatgtgctttgctaatgttaaggtattcatagtcacagccccatcacttgttgacaagtcctatatcaagtaatcatagtagattcaaaacaaaaccgagagtcaggaatcagcacaatcaggctttccactgccaaaaatgaacatcatattaacttcactgacttgatttaaaagagagagcacctcagaccctaattcaaagactgtaccatctcagcccacaaacatcgaaatatcagactgagaaacatatgagcaggccaggtgctgcaccacaggacgcaaacgtccatgaagccggctggcctgcacacgccacaggaggaaagcgtaaacagatatgcagccagcgactacacaaagcaacaacacggtgcacagcacaatggtgcaacatcccaggggccaccacaacagagcatcgggacaaagaactcagagggcacggcaaaacactcagaagcagcacactacgacccaagaaggataagtgccaagatcacaactcaatgagaagaccacgacccagaagccttacaggaacaggaaaaacacccgtacataggaacaagacaagaacggcaaacagacccgtagaaccacataacgaaaaccaccgatgttagggcacccggagccacataacagcacgaaacccaacccaactgagacagaaaatcctactagagcagaacgtaagagaaccaggaacaacaaacagcctacgacagctgagcgataacaacacagaaacatgaaacaactcagctacaacacagaaaaacgaggacctgcaacgcacaaacccgtaaagatacccgcacaagaagacaccaagacatcaccacaca

SEQ ID NO: 641411 - DNA, 93 bp, Homo sapiens
gcggccgcctactactactactgctcgaattcaagcttctaacgatgtacggggacatgcaactaattcaataaaactgtcttgtgagctgac

SEQ ID NO: 641412 - DNA, 347 bp, Homo sapiens
tacttttttttttaatttttttggctttttgagatggtcacgctctgttgcttaggctgaagtccattggcacgatctcagttaattctggttcggcttcccggactcaggcgatcttcttgcttaagcttccggattagctaggactccagttacacaccaccttgcccagctaattttaggccaatttttttgtagggccaggttctcactatattgcccaggctggtcttgaactcctgggctcaagtgttcttcctgccttggcttcccaaattgctgggattgcaggcttgacccactgtgctggttcttctcttactttttattaaacccttttattgcgg

SEQ ID NO: 641413 - DNA, 387 bp, Homo sapiens
tgagaggaacaggagaacagctgtttgcaagagagaggagtaagagggagagcgacacgtctgcaaaaaaggaggatcaataacaagttctgaaattgaggcagtaattaatatcctaccaaccaaagaaagcgcaggaccagatggattcacagccaaattctaccagaggtataaagaggagctggtaccattccttctgaaagccttccgaaccatagaagatgagggtctcctcctcacctcattctatgaggcccgcctcatcctgataccaagacctggcagagacacaacaaaaaagggccacttcaggccagtatccctgacgaacatctatgtgaaaaccctccgtcaaatactggcaaacagaatccagcagcacat

SEQ ID NO: 641414 - DNA, 1090 bp, Homo sapiens
ctcgtgtccgtgcccttcctggggacctcccggagtttggtattctgccctttctttcggtgcacccgcgcgtgttttccgtccccgtcctcccgttttccgccaccgcgtctctatgtgtctccccccgcgcgtgccttttctccgccccggtccccttggtccaaccctgtctcctctctcgcgccccgtgcattaatttctttctccccgtcccggtatatccccataccctaactcttgctccgggaggccatagaccacttggacacatgggagtggtgcgactcatgcgatcacgtggcccttccgtagggcgccctatgggcgggcgcaccaataaatgatacagtgcgggagagacgtagacagccccagcataatatgcaccgccgctacccttaatcatccgctatccccaccgtgcgtcaggtatggcagcaagactcgccacactccccggctaccaatagggtagtgatctgctacagtgctctgcgccctcggactcatctattcgtaatcagccgctagggctggaccctagactaggcgaatgttatgtagccaaaaacttccattcactagacatcgtacgtacacgacacggtactacggtgtcgtagctcacttccagcgtatgtcctatcaatacggagctgtactgttgccatacataggaggcttcagttcactgatttcccctattgctcaggctacaccctagaccaaacctgacgcccaaatccactttcactgatcatacttcatcggcgtaaatgtgaatctgttcttcccacaacacgttctgcggcctatccggaatgcccactgacgttacatcggactaccccgatgcatacaccacatgagacatcctatcatctgtagggtcatgtcatttctctaacagcagtaatactaataattttcatcatgtgagaatgccttcgcttcgaagcgtaaaagtcctaatagtagacgaaccctccataaacctggagtgcctatatggatgccccccaccctaccacacattcaaagaacccgtatacaatgaaatctagacaattaccaggaaggactcgaa

SEQ ID NO: 641415 - DNA, 645 bp, Homo sapiens
tcacccacccccaggctcagatctaccatctcagctcctgagtagctgggactacaggtgcacaccaccatgcctgcctaatttttgtattttagtagacaacaaaggtctcgccaggttgcccaggctggaggattttttaaaaatgaaaaatggtaatcctcttccaactccacatttcagttctatgctaccaactatctttctctgacaagatgctcaccaagataatcttcaacatcccttttattcattactatctgggctgctgcctccagtttggctctgtactttcaagaaggtgtctaaatacttctatcatggtgcttaccattacttattctctcacaagctcttcttccttaggatacttttcaggatcctcttagtaagctagtcccttaagaagtacattctttagaattccctaccaggctatctcttcttactctacattcagtacaattatcaatgactacaatagatttcaattatcttcaattggtcaactgacttccaaatcttcatagacagctcatatctcactgtcaagtaccacgtatgtgtctacccaatggatatgctacctgggttgtccatgggctcatctgggtgtgtggagaacgggggtcccgagctcgaatc

SEQ ID NO: 641416 - DNA, 453 bp, Homo sapiens
  misc_feature (422)..(422): n is a, c, g, or t
gagtaatgcagcattagtggatgctcacggtggaggatgggagagtaatgcagcattagtggatgctcacggtggaggatgggagagtaatgcagcattagtggatgctcacggtggagggtggaagttattttaggtcagctctattgggaataggagaggagagtgagatggacttatgtatatgtgtatgtattttggttagagtattttgatatttcagaatggaactaaattataatctagtacttagattttttttgttgttgtagtctgtccctaatcacattgataccgtgtagaatgatttagaataatctcaagtgtatttaataataatgagttgttctttgtaatttaatgtgcagattgtaaaatgctgtattttattatgtttaggatcttaaaacttcaaggggtcnatttgaagaaatgaagaaaacagcaaaccac

SEQ ID NO: 641417 - DNA, 1622 bp, Homo sapiens
  misc_feature (63)..(64): n is a, c, g, or t
  misc_feature (511)..(511): n is a, c, g, or t
taaataaatagtttatttattcaaaatagttttcttaccttattcacagtttcaagtttgaanntgaaaaaaaggggtagtaccgtggttcttgatcaacgtgtcatataaagtcaaaaggtgaactcctttcagaaacagtgcattaaatacagccaaatgtgcacaacgagcctcgctctttggaaaaaactccgtgccacgtgaagctttattgaagaaacaccaccttttttctcgtggaacaattataaagaggaaacacgtggtagaagtgttccagggaggctcttccttataaccccaccttgtgaaacctgtgttaatgtggtctactctgtggaattatagagagttctcctcttgtggacacacagagtttacacattctttatctctcacaacatataatctcatatattcttatagaacccgcgtgtgtatagcttgtgcaccattaacttctcaacaacacatatcacggtgacaaagagggtgcgtaaactgtgcnatatctacagagacagagagctctgtggttctaaactcacccgagagggacgtcactctacacatataacttttctctcaaaagagacacctttcacacactatagcgtgagaacaggcttctttaaagacttgagaatctctccgtgaagtgtctctgaggccactgtctccaaagtgtgtcacagacaacacgcccacgaagaaaagtctctaaacgcggcggtaaatctgtgagtccgtgggtcccacacttttacaagagtcacacgtcgtgggtggttttctccccaccgtgtgattatttacgccgtgggtttttcaaaaagtgcgggactatatttttcccccttaaactatcacttctcaacattgggcaaacaaccaaaacgagccaccgcaggaacacttagaacaaccaaaaccccggcggcgctcccccggctgatttgaggatcacggggcccaccctgtaggacacaagagcagcttctggttcactcgccggcgaccacaacgcggccttcacttctcgttgcccaacgatcacacaactgagaaacacgagcggccaatttacgagacacggatcaccgcgctctatgcgcacactgaggccccgggccgggaacaaaaacgatgtgtcgtccccccaccagaaggtgggttggcgcaacgcaataaacccgcgctatggacatactgcttctgcccgagaaaagaacagttgcgaggggaataacaaattgggacgacaggtgccatccaacaaacgccggcggagcaaaaaaatgtgactcatgagagagaggcttgcagaacacaggtggtccccactcacacagaagatactaagaacgagagaccactcattcaagcgagaaagataaaagccataaaaggaggcagcgcacacgcaacgcaaacaccacctcgcgcgcacacacacacactccatagcgagagacgaagaccaccctatgccacgctaacaacgcgcgacacacgaccacacgccacgaggaaaccacccaaggtagcgcacgacatatcaaacccgtcgcggacgatgtcacccaccccacaccaccacaccacaccacacagtataa

SEQ ID NO: 641418 - DNA, 663 bp, Homo sapiens
aataaggaaagggcccctctcaggacatcctagagaaggaaggcagtctggcccaccatgcccccagtgcaatcctccaggtaggaacagaaccctatgtggcttcccaggtactagcactcagccctcgtcacccatcaagtcgcagattcaaggccaggagtagtttcatcttgctagggccaagctgagagctcatggaggaactatagctgccaggattgggagtcatcaggatgtagtgtgaatagagatgtcatggggtatttagaggactttagcagtgatgttagtctagccctgctacccttcttgggttgggctgtatgtgggaaacttaccccagctaccacgcctggagagcttggctctgagtacggccagaagctccattggctcccaacgccaggcactgctgcctcttggtcctgctgcctctgctctcctgacccctccccagtcacttcattttctctgttgttcccttgaacacacagaagctgttgacgaattcttttttttgctgtgccaaggcaggtcaaaagcagatcagtggataagagcaagttgtcccaaggagccagctgtcttcctccctcttttgacctccactggacacagcctgattaatttactttggttaacaaaaacacaacaaaaaag

SEQ ID NO: 641419 - DNA, 1135 bp, Homo sapiens
gaccaggtccaaagcccccgagcaggcccaagtggtgcgagaagattccagctgaggctggttgcaaggatgatgcctgtcctgactcttccccgaacagcgtcccagaaacccctggacgatgctcgtctgacattcactgtctgcgtgttcaggtgcaatggacgatcagagaggccagtcctccacccgagtttatgtgtccagactcacttcatgtccaccccacataaagagtgccatcagagcgattccgggcaaatggaggtgtcgtcaatgaacgaacgaacgtcgcggaagcatcagtcctgtcaccctgtagtagccaaccaggtacaaaagtacccgactttccatggacctgcccgggagtccacgcctcaagggtaatggtaaggttcgctcaatgactagtgtgtgcggcctgtaactaaggaagccacttatcctgtctgtgatgtacgaagaacggtgctgactgtgtgatcgcccctgactcacgcgatgcagtctcgaggtcagtgctcctgtgggaccaggctggtggaccaagtgagttgtgtaccaattcagtgcttactaaccaagtgggatacgtgagatagaggcacatcagtagcatcagcctaatggaactggaggacttggatgagtctgtggcatgtggccctgagtccccagacccttgttgcatctgagggccaccagacgccttggaggctacccattcgggattgactatggcgtgggaacgccagaattcactagccggtggccacttgccacaaaatttcgcttcagacgggtaagcagtcgtattggcccttccctgtatggagaggacactcttgcattcattgggaggaacaccattcaggcgaggcatagggctggcatcccatgtccggccatagaaccgggccccccttggggacattaccggttagaaagcccgttggcctcaggccattccacgccctattgtatagccatgccctgggagtgccaaggcacagcttaggggacttaaagtatgaaggcccccgaagcgcctagggggttgggcatggatccctggtcccgttggggcaacaaatcgcttgagcaacggggaagggaactttgtaaaacaaaa

SEQ ID NO: 641420 - DNA, 131 bp, Homo sapiens
cccaccaccaacagagcaatacattttagtatgatatttcaatactccactttctgttatacaacaagagagaatattatgtaacggaaacagaagactagaaggcagtagaaaaacaattatctttaata

SEQ ID NO: 641421 - DNA, 252 bp, Homo sapiens
tatctcaggatcttagtcgctcggacgatgcgggacttgggataaaagtgagcctcggtggggcaggtgaagggcaggtagtggtaggtatcctggggctcccgggtgaagaacctgtcccgtggggtacaagagctcgtctatgaatgctgagagcgcgcggttaagtggccctgcataatcagcattcgttgcgccggtcgttcccagcagggagtcgatgcggtggtccgagcggaccgggtaccgagc

SEQ ID NO: 641422 - DNA, 886 bp, Homo sapiens
aagctatgttgtgaacggtgtcagcacggctggtgcacctatcgtgacatcctcgttacgccatatttactcctgatggtcgctgcccgatgcgcgacgctatgcgagactggcatcttgtagcacatatcagcgtcttgtccgtccggaattcccggttgcctctcgcgcggttgggtgttataaaacacaggccccgcatgttatttgccttcgcttttggctgtattgtctgcccacaaaatgttatggcgccgcacaatggggctttgccccgcccacgccctaatggtgctcatgtgtggtgcaccttaaaacggtcgcccccccccgaaaacccccggttgttcccgtcccgtgtgtttttgagaaggccccgtcccccaaagaaaggaaaaaaataattggggcgccgggtcccccaaagccggttaccgggtaaaccggaagggtcctaatgacgcccgcccccccggaaaaaaaaatggaattgggcgccaggtctaccacaaagcccaaggaccgggggacccccgaaagggtcccgggtcctaccaccaaaaaaacctggaatctgggtacaccgaaaggaatcccatagcgcttttattcccagcgtattaaaacttaggatataaatattctgttcgtgtgtaatacaaaaaagagaagggtctggtaacctgtttgtgtaaaaattcctatgaggggagtatttaatcaccaattaagtgaccggaagtcgtaccaagttaccaaaacccggggtgaatttttgagattaagcgcttttactgagaccaaagggggttctgtctccacgccagggtaatttaaaatttttccttgagaaaaaccaaaggcccacccgtttggtccaaaaaaa

SEQ ID NO: 641423 - DNA, 137 bp, Homo sapiens
tagaggatccccctgcgcggaactaccgcgcactgagagcgcaagggtgacgatacgcaaaaccattgacacgatcatcgcgacgcgggtgcatcgaggacgacctgcctttgctttacagcgatcgggatttcgat

SEQ ID NO: 641424 - DNA, 384 bp, Homo sapiens
  misc_feature (200)..(200): n is a, c, g, or t
ctaggggctccattgtgaactaaaacattgataactaacctgaacaacagtatacaaggcatattgacatttgagagagacatacagcgaggcatacagtaatcacaggtgttgaattgggaaagctagcacaacaacagtaggtaaaagtgcgttgactaggcaacggggccgacagataaaacaaacaagcagaatgnagtaccgtgattaatggacagtccagcgtgcatcagctatgtagccaagagatcagtgtccagggggcagcggtggatggggcagggaagctggactggcgagtgtcatccaggttaaaaaaaactaacaataactaaatagcttgtagctagttagctggtgtcgacgcggccgcgaatttag

SEQ ID NO: 641425 - DNA, 278 bp, Homo sapiens
  misc_feature (79)..(79): n is a, c, g, or t
gaggatccttttgtcatcctaaccaggcacagccctaggtagcaggtagacacacactctaaaaccaggcacagccctngggagcaggtagacacacactctaaaaccaggcacagcccttgggagcaggtagagacacactctaaaaccaggcacagcccttgggtgcaggtagacacacactctaaaaccaggcacagcccttgggggcatgttgacacacactctaaaaccaggcacagcccttgggggccaggtagacacaacactcttaaaac

SEQ ID NO: 641426 - DNA, 331 bp, Homo sapiens
cctctaggcatcatttttaaaaaggtatgttatactgatgcggtggctcacgcttgtgatcccagcactttgggaggttgaggcaggaggattctttcagcccaggagtctgagactggcctgggcaatgtagcaagaccctatctccaaaaaaaaatcatttttttttaattagctgggcatggtggcatgtgcctgtagtgctagctatttgggaggctgagatggaaggatccctgaagcccaggagttcaaggttacagtgaggttactgattgcgccactgcactccagcctgggagacagagggagacccaaccctgtctcaaaa

SEQ ID NO: 641427 - DNA, 169 bp, Homo sapiens
agtgtgacgatataggtgttctccatctattatcctcttcctcatcctcttcacggctccccatctgtttgctgttccagttcctctttgtgttatcatttcaaacagtcatttccatttccactactgtgctgggatcgatcatcttccctcctgtcactgtccgtgt

SEQ ID NO: 641428 - DNA, 444 bp, Homo sapiens
gtgtccccacccacatctcatcttaaaacccagtgggaggtaattgaatcatgggggcaagtctttcctgtgctgttcttgtgatagtgaataagtctcatgagatctgatggtttttaaaagagttctggctgggcatggtggtgggcacctgtaatccaaactactagggaggctgaggcagagtgaattgcttgaacctgggagaaggaggttgcagtgagccgagattgcactgctgcactccagcctgggcaaaattgaagacttggtctccaaaaaaaaaaaaaaggagttcctctgcataagcgctctctctttgcctgctgccatccatgtaagatgtgacttgttcttccttgccctcactatgattgtgagtctttccccagccacgtggaactgtaagtccaaataaacctctttcttttgtaaaaaaaaaaa

SEQ ID NO: 641429 - DNA, 764 bp, Homo sapiens
ggagctgccatgagcctctgggtggacaagtatcggccctgctccttgggacggctggactatcacaaggagcaggcgggccagatgcggaacctggtgcagtgtggtgactttcctcatctgtaaagtgtacggaccatcaggtgctggaataaaagacaagaattatgtgtattctacgtgaactttatggtgttggagtgggaaaattgagaattgaacatcagaccatcacaactccatctaaaaaaaaaattgaaattagcaccattggcgagtaactaccacggttgaagttaatcctagtgatgctggaaatagtgaccgagtagtcattcaggagatgtggaagatctgtggcccaatcacaatcaacttgaaacaaattctcaaagggatgttaacatgtggtatgatggacagaagttgaacaaatcggccaaagatggctcagtatgccttgctgaagaaccatggaacaagtttatgtctacctgcagatggatctcgtgctgcaaatctacgtctaaagtgatcccacctattcgtagtaccgtgctgggcggcacgtggtgcctgctcccaggcattgacagatatttggcacgtgttatctaactgtgtgtacgaaggacaggtctggaatcttccttcacaagtgggtcattagagtggcagagaaagtcttgggagagatctcagaaaaggccctgattatgtgtgaagcctgagagtggaacatatcctttgaatgagatccagaa

SEQ ID NO: 641430 - DNA, 1063 bp, Homo sapiens
tggtggccggcgtggcgctagggactagggggtgtagagggtgcctgaggaggtgctgcataggactgtagggccctggagcgcttgagcgccttcgtcttcccgggcgagctgctgctgcgtctgctgcggatgatcatcttgccgctggtggtgtgcagcttgatctggctggcgccgacagcctggaccccggcgcgctcggccgtctgggcagcctagggcgctgatctttattcctcggtcaccacgctgctaggcgtacggcgctcggagtagggcttaggcggctggctcttgcagcctgggctgccgcctccgcgcgccatcaacgccatccgttgggagccagcgggacagttgccgacaaatgcccccaggcaaggaggatgctcgactacagttcctggatcttgcgagcaaatatcttcccttccaacctggtgtcagcagcctttcgctcatactctaccagctattgacgagaggaatatcaccggaaccagggtgaaggtgcccgtggaggcaggaggtggaggggactgaacatccttgggctaaggaaagtgaatgccatcgtactaagcatgatggccgctgcggaagcctgggggcctgaatggggacgctgcatcaatcacgctactacaactccttaaatgaggccgagcaatggtgacaggatacatcacatggaattcaatgatacaagccccatggaggaacaataattgtacctatgatagactggtcaaaatacatgacaataggaaggaatgttggatattaactcctatatgacccgcttagtgccagataacatacttgtagcatgcctggaaggggtctcaggcgccaattccaatgtggcatccaatggtaagatggcgcccttaaatcaaactattctttatacaacgggaaataaacccgaaacggggttactagagggggacaatgtgtgacgccgtacttcactatgtaattgagaaacccataacaataacgcacagtacgcacttaagataacatgcgtggtgaaacaaacaattgtaggaaaaac

SEQ ID NO: 641431 - DNA, 324 bp, Homo sapiens
gaaattaaaaatttttgacccccggggggaaaaaccccaggcctggggtttggttattaaagaaaaatttttcccccaatttctaatccccgggtggaggatggccgtgtaccctaaacggggggtttttttttcctcccaaaccgccgaagggcctccttaaaggtttttttttgggggaaaaactggtttccttttaaccgagaaaaaagggccgaaaaaaagggggggcccttaaaaacaaagaaaaccaaaaaaaccccccggggctggtttttttttttcctgtgggggccggtaaaaaaaagggtttttttttgttga

SEQ ID NO: 641432 - DNA, 96 bp, Homo sapiens
catgggtttgctggtgcagtacaactaggcttaatagggactcgaattcgagcctcgaattcgagctcgaattcgagccgcaagggaaaaaaaaaa

SEQ ID NO: 641433 - DNA, 336 bp, Homo sapiens
gtttgtttgtttggttttttgtttgtttttaaccgaactagtcttatcagtgaagcaaccgggccagtggctcacacctgtaatcccagcactttgggaggccaaggcaggtggatcacaaggtcaggaaatcgagaccatcttgttgaacacggtgaaaaccctgtctctactaaaaatacaaaaaattaatcggacatggtggcacacgcttgtaatcccagctatttggaagcctgaggcagaagaattgtttgaacccgggaggcggaagttgcagtgagccaagattgcaccactgcactccagcctggtcaacagagcaagactccatca

SEQ ID NO: 641434 - DNA, 358 bp, Homo sapiens
  misc_feature (349)..(349): n is a, c, g, or t
cagaagaggacatattatgactttggctacatttagaataacagcaaattgtagtgcttctcctctttatacagccttacatatcacactgaatgctaaacattagatccttttgaatctcctattacttctcacaatataatttttccttttgtcatagcgttttcccttatgtattatctagcaaattctgttagagttttaaataagaaaatagattaaattctaaaagaatccataaaaatgaggggctcttggtctgggttagtgatgttggaaatggaacctgaacttgaactcttttgccatgagagacttgtcgtgtttccctttgtggtccttgattatnagcgtttgt

SEQ ID NO: 641435 - DNA, 560 bp, Homo sapiens
gaaactaataaacatgaaatgaggagaggcattactcagatgtgctttagcaaggggtggggtttagcatatgctcccccacaatatggcagcatggcatttgagaaaacagcagaagcagcaaagtcactctcatcttcccctcctttcttctccccaaagcaggtcgtaagacctagctgcccttcctctaaaggaggtcataagactttaattccagagataccctccctacacccagaggaaaggaacaaccttatcctcaaagacacagagatgccaagaagaatctgaacaggacttgcaaagtgcccttcagtttagataatacctccttggttcaatcatacttttgcacaattgtctactcttcatcaaacttgtcagaaaaatacatagaatttcctgttcctttgggtctttatttctgaagggtcctgtgtcatatcaaacttatactaaataaatgtgcatgcttttttcttgttaatatatcttttgttattgggatctcagccatgagcttagcaataggtgaggaaagacatcttctctattat

SEQ ID NO: 641436 - DNA, 1485 bp, Homo sapiens
  misc_feature (984)..(984): n is a, c, g, or t
  misc_feature (1037)..(1037): n is a, c, g, or t
  misc_feature (1086)..(1086): n is a, c, g, or t
  misc_feature (1138)..(1138): n is a, c, g, or t
  misc_feature (1231)..(1231): n is a, c, g, or t
tattgttctcccccgctcccccctacaagaaaaaaagtagggtgcgccaataagaggcacatcagcacaccccccgagagaggttttggcgccacacagggagaaaaataagtagggggaggatgaatatactgtgctcgtccgccagcgtccggcgcaacaaaaaaagagagggctctccccccttgcgaagagacgccttgtgggaccacagccactgctcctcccgggtgagatagaaggattggcctacccgtctcaggaatacgccacacatgctgggaagagtgcggcccaccacacccgggggaagaagcttaggaaaacacccccgctgtccaaaaacccacaggaaaatgggctaaagtgccttctccaatccacccaccccacaggaaaggttcgcaaacaaatgggtttcgagggaagacttttgtggttgggttggattccttgggaagatgtgttttccggctgggggaaatgaacaaactttccggtttcttgggagagaaaaacttacccagcgggttccctcggtgggcctttgggttggccacaccccctgggtggttggttgggaaaaaggtggccccaattgggggattggcttataaatgggatatttggttaataagataggaaccgccaatattttggaagttgcgttggaagactcacccaataagatatttttgggggaatttcacacacaccaatcacacaggtcgtgtcccaaatagttttgggggacaccccatggaaaagggggaaggagaaaattttttgggagagcgccaagaaaaggctttctttgggccccccctatattgcgcccgggtgagagagcgcgcacaaataacccttttcgcgcaatacccactccggagaacccccacacagggtggcccctatattgcgccggggtgtctccacagcacgggccacgccacgctatggcttatatggggccacagcgtgggncacagagaaagagattgtctaacatatatgggggagaacccacacaaggcttntatagctcacagcgagagagaggagagagagccccacagagagagaagntgagcacacgggggagaagcctaccacagcggttacacacaccacagagatnttgtgtgagaaacctcacagccacaagcaacacacagttggtgggacacaggggccctatagctggcgtaccacacaagagaagaacacatgntttgtatagagcacagaatatactacacatgtgttatatggcgccacaaaaactcgagaggagcctgtatttgtgagctaaattggataaccacggttattttaagtgtttctgtttctgtggagaaagtgtaaaagcacttcccacaccaaagggttttaaatgtaagagtttttttttttgcacccccactgctgttgagttgctaaatgtaacagtctgatcgtgacgcctgaataaatgtctttttttta

SEQ ID NO: 641437 - DNA, 216 bp, Homo sapiens
  misc_feature (46)..(46): n is a, c, g, or t
  misc_feature (78)..(78): n is a, c, g, or t
  misc_feature (184)..(184): n is a, c, g, or t
  misc_feature (189)..(189): n is a, c, g, or t
cccgcgcccggagctggcgccaggcccaggttagatctgcaatttntccagcggttcctgcagatactgaaggttttntttccttcttggtcatcacaaaatgcctcgatgttcctgacccttttgtgcctgaccctactggctgaagagctttgatcagttcacctgcaacctgctgtatgtnagctngaggaaggacctcactgagcaccttca

SEQ ID NO: 641438 - DNA, 211 bp, Homo sapiens
gcctatgtacgacatggcccaaaacccgcttctaggagctgcattctgccaagggaacctgtgctcggggaaccaaacctcagccccaatgcgtcttggctcaggattgcagcgcgagcctggtagtcgcctagccctaggctccacataaaaggccaaggaggctctgggctgactctggatccgagggcactgctgcttcgctgcacaa

SEQ ID NO: 641439 - DNA, 217 bp, Homo sapiens
  misc_feature (38)..(39): n is a, c, g, or t
ccgatcgtcttcttgaccacttcaggctctctgtatcnnctcccaactagaccttaacttttttacctccaggtccatctctgcaccaccctattttagcaagaatcctgctgttaaataaaatgtatgagaggctactgttctggactgagcttctgcaataggcccccacaggccagaacagagtcatctgtgctaggtgccacgtaattgaact

SEQ ID NO: 641440 - DNA, 297 bp, Homo sapiens
taaacagtgatggtgtcactagaagcgtaggacgtgttgacagtgtgagagtcgcttgtactttaggcataagccatatagaaattttgccattctgttttccattacttataggtgatatacaggaaaactccgtttgttattcctcagtgaatagtgagcttttcatgcatcaattgtcaatcagattattctaggtttccgtacataatttttgagcctcttgcaaacggttaaccattaagcatactttctgcagtaggttgattggatttttttctgaggtacagaccgtcg

SEQ ID NO: 641441 - DNA, 129 bp, Homo sapiens
ggtttgggtccaggaccatgatcggagaaactgtgaagaaattttttgattctgccgacctcgaaccgatcgcaataggtagatttttcatattaaaatataaaatctacctaaaaaaaaaatattttt

SEQ ID NO: 641442 - DNA, 890 bp, Homo sapiens
aagacaatcaggctaggtcgaggcccgggtgtttaatcggccgaagggagctagagctgccatcgtggaccggatgacagatacgagggatatgcactttgctcataagaggggcttcgctggcagtctgaacggcaagcattgaagtcaggacccttcattaagatcctcaattggctggagggcagatcctcgacgagatagggacaacgcggtaaaaatattgcttcggtgggatgacgcaggatacagctgcccaaggggcgttcgtaaacaggagaatgccgaagacgatgggaaaaatgggagcggatggcggaagacggggatgagctcaggacagagccagaggccaagaagagataagacggccgcaaagaaaaatgacaaagaggcaagcaggagagggcccagacacctgatatagagagacccccacaaggatcaagaaaaaacatcacacacaagatggcaaacacgtgacacacatcaagaatctgatctagagaatagtggatggagctacgagccatggaataaggaaggaaaggcatagatatgggtaaagggaagaagccccaagaatattactagtgcacctatcaaagaagacacagaaattgttcagacgaaccaaacataccagactgaacttaccggagcatgctgaaacaatctctcatacaatactggtcagaatacctcgggacaaagaaggagacaagggaggtgaggccagataaccagacagaagccgagacaaagaactaaagaaaaagcaagggagatgaacaggaagccgggtgaaggaagcaaagaaagaaaggaagaaagaaaaactaaagacaaaagaaacgaacaaggagaaacaaaaacgaagcgaacaacat

SEQ ID NO: 641443 - DNA, 102 bp, Homo sapiens
tcgggagctgtactaccatatgctctgagtgacccatgttccttttgaaatcctcctgtcatccccccctttattctgtacgtcccaggatcatattccaac

SEQ ID NO: 641444 - DNA, 795 bp, Homo sapiens
  misc_feature (58)..(58): n is a, c, g, or t
  misc_feature (72)..(72): n is a, c, g, or t
  misc_feature (107)..(107): n is a, c, g, or t
  misc_feature (113)..(113): n is a, c, g, or t
  misc_feature (147)..(148): n is a, c, g, or t
  misc_feature (167)..(167): n is a, c, g, or t
  misc_feature (171)..(172): n is a, c, g, or t
  misc_feature (174)..(174): n is a, c, g, or t
  misc_feature (204)..(205): n is a, c, g, or t
  misc_feature (335)..(336): n is a, c, g, or t
  misc_feature (373)..(374): n is a, c, g, or t
  misc_feature (427)..(427): n is a, c, g, or t
  misc_feature (482)..(482): n is a, c, g, or t
  misc_feature (586)..(586): n is a, c, g, or t
  misc_feature (646)..(646): n is a, c, g, or t
  misc_feature (668)..(668): n is a, c, g, or t
taacgggcatcgagtcctgcagtcggagtgccggctggcttggcgtgcgctcgctccncgaagccggggctnggccggagccgggcgaggtgctgggagctgggccngtgtcngggacagcgggcgaggggcagctgcctggagccnnggcagccaggccgctcagngcanngngacagctggcgccggttctgcgtgtctccnngggcccagatgtgaggcggctggctccccctgtgcccgagagcgcactgatgggggccccgctcgccgtagcgctggtgcgccctccactacctggcacttttccttgcaactcgtgcggcgccacgcgnnccgccggccacgcgccctgggacaaccactgtctccnngccacgccctgttcacagagacaccccatgacatgacagcacggacgggcgangacgtggagatggcctgctccttccgcggcagcggctccccctcctactcgctgnagatccagtggtggtatgtacggagccaccgggactggaccgacaagcaggcgtgggcctcgaaccagctaaaagcatctcagcaggaagacgcagggaaggangcaaccaaaataagtgtggtcaaggtggtgggcagcaacatctcccacaagctgcgcctntcccgggtgaagcccacggacnaaggcacctacgagtgccgcgtcatcgacttcagcgacggcaaggcccggcaccacaaggtcaagggctacctgcgtgtgcaggccagggtgagaactcccgtcctgcatctgccccgaaggccaca

SEQ ID NO: 641445 - DNA, 820 bp, Homo sapiens
gtccccacatgaaatgtttagatctagtatactaatgcttcgtacctctttccgttctcttataacagttgacagccgacagcagctcaatcagtattgtatcagtctgtcttcgaaatccgcgacgttatccattcagcctgtgagtcatctatacactcctgagtgtagtgttatcctagtcagcatggctttgagactgcaaggcgacgatgacttcactattgcttagaccgcctagtagtgactaccacttaccctctagatcatcagcgactgaatgtaacttcatcagcgaagcaaccactgagagctcgctgaaacgatgtctacaactcacatcatcactcgcccagagaactgagtccaatagctccatggaggccaagcaaggtgtgaagtaatgacgtacgtcgttacatcgaagttatgacattgaaataagtaagaggaataccgtctttttacggacgtccgactgtaggtgacgtacccataggatgccccgagtgtcggaaaggcacccctagtcgcatggaggtcatgatagatacgtttgcccgcagcaaactcgtgtaaaaacgtgaggaccggggtaactgagtttatagataccgtcctcacgtctcattctcagaacccctgaagcaacagaacagcagtagtgctagtccactatgccatagataacgaatcccctttatggagttcataatttataagcgaaggctccaatctgtctcttaagaccaaacaagtacctgaaaaatcggcttcatagacatagtcttcaatcaggccagaataaagccctcgtgta

SEQ ID NO: 641446 - DNA, 152 bp, Homo sapiens
ttgctgggggtggatctagaggatccctaatgtggatggggacaggatgagacagagacagaactttggagagttctcaaattagagtctgtgaaaggctgtgaagcaaaacgggaaggtgaacatgaaagggatctagaaaagcacttccc

SEQ ID NO: 641447 - DNA, 654 bp, Homo sapiens
agcggggtcgggctggagcgcctgaagccgcgactgccgcctcagccgccctcagccgcggtcgccgccgacttcggctgacttagggctccgcccgccgcctcctcaccctgcctccgccactgacaccctgcccggacctcccctgagcactcatcacgcgacaggccctgagtgcctcagacctgtccgtggcagtggcagaacttcacacttgcaaaggtcaatattcgtatacatgcactttataaatatagtggaaaggggtataaactctatgaattcgaaggtttcctattggcggcaaattggccctaagcagaaggacgaaagaaatgctcactccgaacgattggggatacccgggaaattgggccccaggagttgagtcaaccaccttcagcgggaaaacaaaagcgacgggcacgatgggacaggcgcacaatgaggcgagaaccacacacgggcaccaggggaaagcaaggaggaggaacacaagacgcccagagggcacccgatcatacggagtattaaagccaaagataccaggggtaggaacgcaggaccagggacgcgcagtagcccgcacggacaagaagagcaccacacacgacactgcacaagcgagtaccaacacaaggcacagcgcaccat

SEQ ID NO: 641448 - DNA, 118 bp, Homo sapiens
agttggcggtgagctggtcagctgggtatcattagtgaggctgaccagagccggttgacttctctgctagaagagaccttgaacaagttcaattttgccaggaacagtacggcgccca

SEQ ID NO: 641449 - DNA, 314 bp, Homo sapiens
cctggtacccaagctctcacacaccaacacaagcttttctttcctctgtctctttcccttagccctatgaagactcctcggtatctattaagaagtaatagtaaagtaaaataaataagtactcttttgaatccacccttgttctttattcctttttcccaacttcaaaataagaagcctgcgctcaccatttctatgtcctcattcccgttttcaatctagcctctgattctgccacaggactgtaactgacaaatccagtcctttgtattctctcactgtgagcagcgttgggggatcctcagatcacctcg

SEQ ID NO: 641450 - DNA, 171 bp, Homo sapiens
ctctctcctgatgctaggtcggggcccaccctgctccctgttcctgctagggcctgccaggtgcccctgagcttgctttccacattctcccaggggtatggagacctagacctgtctttggggccatgagcatctgggttatagcagagagtgggagcatgaactctggct

SEQ ID NO: 641451 - DNA, 195 bp, Homo sapiens
ggccccggggtgggggccccccccaaaccccccaagggggggggttggggaattttttggggtgggggccccaaggtgtttttggggggggcccccccccggagggtttggggccccccccccccccccccccccgggggtttttttttttggttccttggggtttccccttttttttaggggggggggggggga

SEQ ID NO: 641452 - DNA, 364 bp, Homo sapiens
tgtgtgctacatctggcacaattctatatcacaatacttcccactttagaaacgcagggtacactattctgcattatcaaacgtgtcgagggaactatagaccttaaaataactgacacattttattaaaggaactgcaaactctgctcattaatgcctgtcttggatgtggcctttgagattcatagcctcttttaaggaaacagggttgacacactttgattggtcccaggctttgaggcaatgctagatgtaatagcatcatctttcaatctgaggaaaatgtttctttaaaaaaacctgtctttcaaaatacaacaaaaaacaagggctgggtaatcggcgaattcttgcatggcactcc

SEQ ID NO: 641453 - DNA, 118 bp, Homo sapiens
tcgccggttctaggaataatgggggaagtatgtaggagttgaagattagcccgccatcatcctagtcctcatcgccctcccttccctacgcatcctttacataacagacgaggtcaac

SEQ ID NO: 641454 - DNA, 1010 bp, Homo sapiens
cgcggtggctcacgcctgtaatcccagcagtttgggaggccgaggcgggcggatcacaaggtcaggagattgagaccatcctggctaacatggtgaaaccctgtctctaataaaaatacaaaaaaatttagccaggcgtggtggtgggcgcctgtagtcccagctacttgggaggctgaggcaggaggatggtgtgaacccgggaggcagagtttgcagtgagctgaaatcacgccactgcactccagcccaggcgagagagcgagactccatctcaaaaaaaaaaaaacaatttttttttttaaaggaattacttaaaatgcgggcgggggggggggggctcacaccggtaatcccagcacttgggggaggccgaggtggggcagatcacgaggtcgggagatcgagaccatccgggctaccagggggaaacccggtctctactaaaattacaaaagaaatttaagccggggcgtggtgggcggggcacgcctggatagctcccaggcatactccggagagggctaagggcagggacgaatggggggtgaacccgggagagggcggagacgctggaagtggacgccaggagatcggggccaaaggaaattcacaggctgggggccgaccagaagcagagaactccggagcctacacaacaaaaacaagcaaaacagacagacgaaagacaaacatatttggtgcgccaccacatcgagggcccctgagaagaagagttgtacagaacacacaagacgtaatggggggcaggcggcgccccacggaaggggtggtagagaagacacgggggcaaaagagtgtgctaaccaagaaagaaaaccgtggggcaacaaaacaacggggcgggaagagtttcccaccaaaaatataaaaacccgccgggggaaaaccgcaagcggttgtgtgacaaaaaccacaaagtaggaagcgaaggagaccaaacggggagcttcaacaaggggagaccccacagagaggcgggaaataat

SEQ ID NO: 641455 - DNA, 896 bp, Homo sapiens
  misc_feature (121)..(121): n is a, c, g, or t
  misc_feature (128)..(128): n is a, c, g, or t
  misc_feature (166)..(166): n is a, c, g, or t
  misc_feature (172)..(172): n is a, c, g, or t
  misc_feature (174)..(174): n is a, c, g, or t
  misc_feature (176)..(176): n is a, c, g, or t
  misc_feature (195)..(195): n is a, c, g, or t
  misc_feature (207)..(207): n is a, c, g, or t
gcctgaagctagtgagtcgcggcgccgcgcactggtggttgggtcagtgccgcgcgccgatcggtcgttaccgcgaggcgctggtggccttcaggctggacggcgcgggtcagccctggtncgccggnttctgggtctttgaacagccgcgatgtcggatcttcanccccancnanccagatccggcctaaccanttgtggccgtgntacggatgaagcgtgccgggaagcgcttcgaaatcgcctggtacaaaaaacaagggtcgtcggctggcggagcggcgtggaaaaagacctcgatgaagttcttggagacccactcagtgtctgtaaagtgtttctaaacggtcaggttgccaaaaaggaagatctcatcagtgcgtttggaaacagatgaccagaactgaaatctgtaacgcagatttagactaaaggagaagttcaagtatcagatacaagaaagacacacacaagttggagcagatgtaagggacagttgcaactattggtgggcaggacaaatgtgtgaatcctgaaaacaaaggagaccatacagcgtgatccttattgagaagagtcatgaaaggacatccactattcgcgtgaataccaaacaaagaagtacaacagaaagcgaggctgtggcaagttgaatagaggcaggtttaaacgacgaacattgccgatagaaacgtgctcacgatttaagcgtgtcggggtcaaaccttccggtccaaggaagggcaaaaagcgtgagaccaaaggttcaggccatggatcagggccacacaaagtgcacatatttgccccacgttataaatctatttttttttacccggcagttccgcagaaaaggagcgcaaaaaagcgagaacagggaagcgtttgggagaccc

SEQ ID NO: 641456 - DNA, 312 bp, Homo sapiens
  misc_feature (121)..(121): n is a, c, g, or t
  misc_feature (128)..(128): n is a, c, g, or t
  misc_feature (166)..(166): n is a, c, g, or t
  misc_feature (172)..(172): n is a, c, g, or t
  misc_feature (174)..(174): n is a, c, g, or t
  misc_feature (176)..(176): n is a, c, g, or t
  misc_feature (195)..(195): n is a, c, g, or t
  misc_feature (207)..(207): n is a, c, g, or t
gcctgaagctagtgagtcgcggcgccgcgcactggtggttgggtcagtgccgcgcgccgatcggtcgttaccgcgaggcgctggtggccttcaggctggacggcgcgggtcagccctggtncgccggnttctgggtctttgaacagccgcgatgtcggatcttcanccccancnanccagatccggcctaaccanttgtggccgtgntacggatgaagcgtgccgggaagcgcttcgaaatcgccttctataaaaccaaggtctgcgtctgcggagagctgtgtcaggtgcacaaaaagagagactcatcat

SEQ ID NO: 641457 - DNA, 158 bp, Homo sapiens
caggaaacagcttataccaacttacatgcatgtgcatgccaagtgcgtacacacacacacacagcacacacacacacacacccctacctctcatcctgccctgcaggagaagtcatcccgattctactgatgctagttttctaaatttcttgtcagat

SEQ ID NO: 641458 - DNA, 321 bp, Homo sapiens
ctgtgtgtagcacaataaggaagggtcccaggttggtgagagccccaagttgcgaacaataatgaacaattattgtatgaacaattgttagaaacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 641459 - DNA, 792 bp, Homo sapiens
ggaaaacaggcttacgacgagatgatgtgattatattcaaggtcacatagaggggtcggtgacagaggcagtgctcaagcccaggtctcctgacctgcagcttacacggccgtgctgactcagtaaatgatggcgtgcttcagcaggaagcccagggacagcagagccggtcgcctctcattctgtacaaaggtgtgcatatggcattggtggggtccccaaccagatagcctccagacgccacagccttattacctgcagcttttcctgcttgatatagcacagatccctgccgaccaggtgtcaacttgttctgtatgggggaaaagtgtctgggagcggctgctgaccctgtggcatgggttcttcatcaacaggagccagaggaccaggggtctggacggcctcatgccttgggtgctgggctgaaccaccacttcatcgacctggactacttacttcctgatggttccatgccccccttacacacagaccatgagaggcctctggtacaagacatttctactgcctgttccaggccctgggccacagggatgactgtgagcagatggcgggacacatgatgggggccactgtcgcacagggctacaacgaggatcggagcccagcgagaacccacaagagtgcgagggacaactagcgacccccggggcccagacactggactaccccagaattgcaggcaaaaagtcactgggaatgcatacagacaccatgaaagcccagatgcgaaggccacgaacaaggacaaaaacaaccgaatacagacaa

SEQ ID NO: 641460 - DNA, 239 bp, Homo sapiens
aagacatagttacaacaatgctacaacggacaaatgtacttttaataaggaaacatatagcagttactatccttagcgaaggctgatcaactatggttaccacaagtagagacaaactgatataaactgtaaacctgcacatgacgattatagtaagtaacttataccaaaaatgtctacactcaacccaatcatgaggcagccaatctgaccaatcctgattataggatgggacatct

SEQ ID NO: 641461 - DNA, 732 bp, Homo sapiens
caccttacaacacataagacaaattcatacctgacgtggtctacagttgctttcagaaaccactaataagaatactggttctgattgaataacttaaacgcatgttatgctttttcacgtgagctaaacactaaaactacgacttgacaacttaccttgagttacgtaaccttacaccactggtggtttacacgtgttactttaactacaactacctgtgacacgtttactcttaaacctcacttttacacaaaagtgaccttcgtggtttttacacacttctacttacggacaacaacaggtacttacacaacttgaggttacttaccacaggcctattcaacttttacttcacgacatctaacatatttggcggctaaatcctttaccacacgaactcatggtagtgggcttacgggacattaattaaaacagggccttatttatcatccacatttcaccaaccaactactatacgacgtaaaactaaactggggctattgtcacgggtaacagcccaacatgtggggacaaccgtgggttgacaccctcacccacaattacttacacgggcttacttttaacagacctacttttaacattacccttaattcaacccctaagaaacttggaccaccctttattacgagggtatctcctgggcacttgtttgtcacacggctctaggtttataaaccttgtaattatacgttttcaacaaaacttacactt

SEQ ID NO: 641462 - DNA, 330 bp, Homo sapiens
ctatgataacttctggcagaggctactgtctgtatggagttgcatactccccccatctctgggtggatctctctcagtactctggtttccccctgacaccccaaagatgtgcacgttaggttcatagtcatgtctgcaaggacccagactgagagaatgtgggtgtttgttaatgcaccctgcaacgggatgacatcctacccagggctagttcaagtctggcaccctgaatagtcgggacaggctctggccatctgtgaccctgaactggaataagtgggtaaattatcatcttattcaggtttcttaaatgtatgttaccgctcacat

SEQ ID NO: 641463 - DNA, 1253 bp, Homo sapiens
ggagcggtaacctaagctggcagtggctgtgatcctggcaccaaatctggcccgctggtgctggtgcgtgagactccatgagtgccctgtgacatgaacaagctgagtgtgagtgcgggcgtgtgctgcagtgactcgtgtgtgtgaatggtggtgccagctttgtgtgtgcgctgatgtgagttggaccctgaccactggtgagactatgtcaagtaatgcccactgctgtggtgcttggcttgcatcaccaactgacaaacgtcattgtggacccatggtgcgttttccatacgttgtgttctgtgtacattggtgtttgtgttggacggtccatccgagtacaaattgactgtagacccatggaacttcagaccagcgcctgtgatcatcaggtgtcacccaaggtggcaaggatgacaatcaaagttctgcggttgttgatagacagtgtcataggatgcccatgagaggttgacgtaaacagtgtgtgtagctagcacaaactggtggacggggacgaaaactgcacacattgggtaaagcccggcccctgcattacaaggcctaccatagtcccattggggtgtgaaaagggactggttagaacccaatggcagacgcggtcgtgtgggccactttggagacaaagatggacaccaaaaagatcaagccagtcacattctagcagccaggagataggttcgactaaaccaccaaatgaccaaatgccgcgttacctagcaagcaccgcgatcccaggtttgtgacctcaagcagaggatagaaaacaacgacaccgaatatatgtgggaggcacgccaacaaaagcaaagagaatacacatgcacgccgcaaagcatgggtggagtgaacaacgatttttttcgcccgatgaaagaagatcatttaccacgacagtggggaaacgcacagcagccccaccgggagaagagaataagagagaggagaaggcagactaaaaaaggagtgccagtacgcgcggaagaaaaacagcgacgtgaagataggtagtttttttatgggtgaggagcccgaacaggaaaaggagaagacaaaaggtgatttattatcagacccgaggagttattaaagaaagagagtggattatttaccaagcagagatttaattttagccaccgagaagaaaatgcgagttatgtaaagatgtatatagaatgaattagggggagtcgtataactagacgtggaaacgtgagtattgtttagcg

SEQ ID NO: 641464 - DNA, 257 bp, Homo sapiens
gagtcatatacacactcagtgatttcttcagcccaatacaaatagcagcaaactgctacttaaagatgaaacagttacgccaattttttttttggaagacggtagatctagagccaatcgtatctggccagtctcattttcaagcccttactggtctacttccacggtggcccataagtatccggataacaattccgggtggtcattatggtaaccatagttcaccagaatagtcaccacctggcaggtggcatagt

SEQ ID NO: 641465 - DNA, 1285 bp, Homo sapiens
ggcgcaagtaaagatggcagtgggcctgatccgtgcgcccggtcggcggggatcactgacgcttcggcgtccgggtcgctcgagcatcccgagcggcggggaggcagaccaggtgtacgtgacgggtggcctggggacggacgcctgtgagtgtctgctgcgcgtgtccataggtgtgcgccgcgtcggcactggctgagggcggggctcttgcgagggcacgtccgccgacactcccggaccacttgagtgcatgcggagcattcgtctccgtgtctcgacatcgtgcctcttgacgacacctgtgtgcagacgaagcgtcctgccagcctaggcgaggggctcaccgcgggagcaaggtgactacggtcgcgatcgatcgacatggaccgtccgccggtcgcgtacgtggcactgtgtctggtctactacctatactggctgccaagagaaaccatatcgaagtgtgcacgcggggaagagcggatggtcccaaagggggttcctgtgttgagacgtcagcgttctagtctgggcgacggcggacgcttagggacaaggctagcctccgctttccctgtcgctctgcggctttccggcttcctgaaccgtcgttggaaccactcaatcccccgacttgtgaagcgtgcttgtccccagtcctgcgtgccagtcctgtggtgacacaagagccctccgtggatgcccggggattggattggagccaggacctcagttctcccctctgtgccctgtcccctggcccttcacaagaatcgctggggcccacaagccctgcaggccggcccgcatgggacatgtcccctggagtggacgactggcgctcaacgtgggacgtaccactcagattagcgctagagtacacggaacagacatatgagatcattgggagaagacacatttaagtcgggaaagaagatataagacacacggctgccacaaccaccgcactcatcctaccactacagaaaaaagagaacaccagacaaacagggagacaaaactagcacagtataggcgcccgcaaaacacgataaagggaaggaagaaccaacaacgaggaggagaacaacaacaacgaaggagtcaacaacaggagagcccagagcatgcgcatcccgactcgacacgactaaaaggagaacgcgaaagcaaacagacacggcagcaagagaagacaaaccacagaacggaacagcgaactactcacacgacaccacacacaccgcagaaagaaacaagacaaaacacgaagcaacaaaaa

SEQ ID NO: 641466 - DNA, 454 bp, Homo sapiens
tgtgtgaaccccaacaccggaaattatccaggaagcccccaccatcgggggggaccccaagtgtctttttttttacaattaacagcagaaggctcgcggggtgcacacccaacggatacagtagaccgcaaccaaccggtgcttggggcccttgccccccgccccttttcaaacaccggcaaaaaacgaaaagtgcttgggtggtgggtgctggaggattttccagttttgacacacgtatttatatttggaaaaaaaccagccccgagctgggcccctccccggcctttttttttccagatgcaaatgccacacctgctccttttttctttccccggggaaggaagggggttgtggtcggggaactggggtacaggtttggggagggggaaaaaaaattttttttttttaacccctgtgtcccttttgcataaaattaaagaaaggaaaagta

SEQ ID NO: 641467 - DNA, 228 bp, Homo sapiens
aaagtaagtgcccttccattgcgggcctcctcatattgtacttgtttcctgccaaatctgggggatcatttgtatttccccccctgaaaaatatggctctgtactaaaaaaaggctctcaattctgtggggtctccttagtatgtatgtgacttttcatgttgcaatatcacacgatgggatggcccgacttttgctcttaataaataatctgaatgagtaagaaaaa

SEQ ID NO: 641468 - DNA, 376 bp, Homo sapiens
  misc_feature (1)..(1): n is a, c, g, or t
  misc_feature (18)..(18): n is a, c, g, or t
  misc_feature (27)..(31): n is a, c, g, or t
  misc_feature (33)..(33): n is a, c, g, or t
  misc_feature (36)..(36): n is a, c, g, or t
  misc_feature (42)..(42): n is a, c, g, or t
  misc_feature (45)..(45): n is a, c, g, or t
  misc_feature (51)..(51): n is a, c, g, or t
  misc_feature (55)..(55): n is a, c, g, or t
  misc_feature (59)..(59): n is a, c, g, or t
  misc_feature (62)..(62): n is a, c, g, or t
  misc_feature (64)..(64): n is a, c, g, or t
  misc_feature (68)..(68): n is a, c, g, or t
  misc_feature (72)..(72): n is a, c, g, or t
  misc_feature (81)..(81): n is a, c, g, or t
  misc_feature (91)..(91): n is a, c, g, or t
  misc_feature (97)..(97): n is a, c, g, or t
  misc_feature (100)..(100): n is a, c, g, or t
  misc_feature (111)..(111): n is a, c, g, or t
  misc_feature (114)..(114): n is a, c, g, or t
  misc_feature (127)..(127): n is a, c, g, or t
  misc_feature (133)..(133): n is a, c, g, or t
  misc_feature (137)..(137): n is a, c, g, or t
  misc_feature (158)..(158): n is a, c, g, or t
  misc_feature (164)..(165): n is a, c, g, or t
  misc_feature (241)..(241): n is a, c, g, or t
  misc_feature (252)..(252): n is a, c, g, or t
  misc_feature (263)..(263): n is a, c, g, or t
  misc_feature (285)..(285): n is a, c, g, or t
  misc_feature (293)..(293): n is a, c, g, or t
  misc_feature (295)..(295): n is a, c, g, or t
  misc_feature (297)..(297): n is a, c, g, or t
  misc_feature (301)..(301): n is a, c, g, or t
  misc_feature (303)..(304): n is a, c, g, or t
  misc_feature (306)..(307): n is a, c, g, or t
  misc_feature (309)..(309): n is a, c, g, or t
  misc_feature (311)..(311): n is a, c, g, or t
  misc_feature (314)..(314): n is a, c, g, or t
  misc_feature (374)..(374): n is a, c, g, or t
ngttgaaacttaattttnttgttaaannnnntnttntttggngtnacagcnggtntttnttntnagcntttncccagagtncctgggggtntttttnttnttgtggggggnatngggggtttggggncagggngggnggtaccatgggggcagggggncacagnncacacacacacacacacacacacacacacacacacgttcacacacacatccccccacaactacagccgccaaaatnaccagcatggngttgttacatncccccagtggggggtagaattncccatggngncntgtnanntnntncntgngagaggggggggcaggggggttaggggggggggggaggagaacatttttttttttttttntt

SEQ ID NO: 641469 - DNA, 112 bp, Homo sapiens
aatcgatttcaaagacggcacggtcgcgccgctgaagacggttttcctgcacgatccggattaaaaagtgccgttccacatcattaacgagagtaccgagcagcgttatctg

SEQ ID NO: 641470 - DNA, 400 bp, Homo sapiens
ctttccaatgtcacccttccctactttcttagatggaattacttatatttctccaaagttcttatgcaatttgatgtttccttctcttcactcttcttaaaatgtccatcacattctttatcaatttgtgaaattcccaattccagaatcaactcaaaataatcattaatcttcctcaggattctcacatgagcaaaactgaatgctgtcacttccatagttccagaacaaaatacttacatattcctgtattttagcataagactactaatttaaaaatccttttcatcctttcagtattccacaaagacagagacatggtctgtttctacattcctggaacatgtacaaaatcaataaaagtcatccgaatcactggatgagtgaatgaaacgtatta

SEQ ID NO: 641471 - DNA, 139 bp, Homo sapiens
  misc_feature (20)..(20): n is a, c, g, or t
  misc_feature (23)..(23): n is a, c, g, or t
ggggcacccccacgatgcanccnaatgtgatggaacagaaacatccatcatcctgaaaccgagcagtgatgatccgctgaggaatgtttaattttcatgtattaaaaaatgaagaatgtctgacctactgttaatgacc

SEQ ID NO: 641472 - DNA, 110 bp, Homo sapiens
gattcattcattcattcgtacatacattcattcattggctgtgccagcactgtgctgctcagggcatagattcagcagagaacagcctcctggagctctagagttcccag

SEQ ID NO: 641473 - DNA, 235 bp, Homo sapiens
catcggtgctggcccatctctagctaatataaagtacaaaattagctgggtgtggtggcatgcacctgtcctccttgctactcgggaggctgaggcaggagaattactatgaacccgggaaggcggagttctcgagcagtgaagctgagatagtgcccattgtactccagacgcgggtcgacagtattaccgctcttcgtctctaacatataccttactcctcgttattcactct

SEQ ID NO: 641474 - DNA, 1634 bp, Homo sapiens
  misc_feature (283)..(283): n is a, c, g, or t
  misc_feature (1036)..(1036): n is a, c, g, or t
cagagcacgaggtgtcgtggaaagctacccctagaaagccgaaaatgggaaaggaaaagactgcatatcaagcattcgtcgtcattggacacgatagattcgggcaagtccaccagctactggccagtctgaatctataaaatgcgagtggctagtcgacataacatgataccagttgaagaaattatgaggaacggagcgctgcatgacgtatggtgatagagggcgtccgtgtcaagcttagtgcctggagatcatatgggtagtaaaactcgacacatgncatgtagcgttagaagcggttgcgatgtcaaccagtgtgactagtacttcactctgctgagacaaattttgcatgatcctaggcgaaatgattacgtaatagatagtagctaaatcactcttgaatggcaccaccacgggaccagcaagataggtaccatttcattcgaaaatagcggtgattgtacagggtagcatatcgtccaggcctgagcctgctgcgctgtcctctgaagtccgcttagctgacgtggggtgattgcgctggacagtccttgaaacgcatgggtatactcgtcgcgaatgcatatcggaggcaagaacgcccggaagtatgccaatggcaccctgtgcaggcgtcctattaggaccaacatgggcgctgggtggaacatctacaagtggaagttggtcctggtggtttaaaactacagaaattcggcagtgttcccaacttgaagtcccatccacctatccaggcacaaagcacaagaagtcagtagtgcagggacacactgggtcgtaaacgggcatacgtttcaagacgagcctttgaccaatcttaaacgtcacagagcactatggggcgtaaacaaaccaccccagtaagctaacaaagcaaaggccaatatcaggcgtgcaccacaacatcccaccttgggcacgggcacacactgcgcagtgacaccaaagcgcactgccctgtggaacaccccacacggacggactctagaaacgacacttagcacactgnggagcgtccaacggggcgaaatggcgaacaagcgttccacccccacgcaaccagggggaatggggaacaaagtgagccatagcgagaacaacactagcgcctgaccatgtacagggcaccgaggaaagcatggacaaaccgagaacacacacagaacgcaacacgcgacacaacacatggaacaaacgaccacatattggcagcacagtgcacgacctacccagagggagagttattcacagcaccactgcgaggcggcaaacacggcgccatcgacacacagagatagggcccgacaagcgagcaaacacgggagagtcgtcaacaacccccggagacacaggcgcgagaccacccatcagacacacagaacaagaagcaagaagcgagacactaataacatagccacaagagcacacgagataacaagtcgacagtacaccccatatggagcaaaaagagggaaacagaccaagagcatcgaaaacgacacaacaagccatatgacaagtacaaataaacaacacagatataacgaagagcagaacaagaaacacacacacgaagcaaccacagaagcaagaacaagcagcagcaa

SEQ ID NO: 641475 - DNA, 546 bp, Homo sapiens
tactgggttttttgttgttgtttgtttggagacagagtttgctcttgtgcctgagctggggtgcaatggcgcaatctcagctcactgcaacctccgcctcccaggttcaagcgattctcctgcctcaccctcccgagtagctgagattacgggcgtggtggcgggcacctgtagtcccagctacttgggaggctgaggcaggagaatggcgtgaaccgaggaggcagagcttgcagtgagccaagatcgcaccactgcactccagcctgggcgacagagcaagactccatctcaaaaaaaaaaaaaaaaaaaaagaagttttttaaatttttaaggggcgggggcagagggtgggttaacactgtgtatattccaggctttggggaagggcgaggggaaacaggatttgagtagaccggttggggcaaaaatgtggttattaaaattgcaaaaataaccgggggctgggtgggtttggccccgtgtaattccaaggatattgggaagggatgggggaggagagcatctttggacctgggagaattt

SEQ ID NO: 641476 - DNA, 284 bp, Homo sapiens
ggtcccccacgtgtgtccagacaacttagccaaaccatttacccaaataaatataggcgatagaaattgaaaccgggcgcaagggatatagtaccgcaaggggaaagatgaaaaattataaccaagcataatatagcaaggactaaccccatataccttctggcataagtgaattaactagcaaataacttggcaaggcagagccacaagctaaagacccccgcaaaccatgacgcagctaccatacagaacgagctaaacagagcacaccgcgtctatgatag

SEQ ID NO: 641477 - DNA, 157 bp, Homo sapiens
tttgtaccttctggctggaagtcctagtcattccttctctgaatcttagctgtgagaagtcagtgagatcatgcatgtaaaagtgcttagcacaagtcaggacatatacatgtgccttgttgccacccaggctggtttgagagcatatgttactgca

SEQ ID NO: 641478 - DNA, 199 bp, Homo sapiens
atccagaagttgggcccccacaaggcaatggatttgctggtgccccaaagttggacttcccagcctggagaattatgagggataaaaatctgttgtttgtaagtcactcaaaaaatggaattttgttaaagctgcccaacaggattaagacatacactaaggaatgaaagacattttctacctttatgttttgttttca

SEQ ID NO: 641479 - DNA, 301 bp, Homo sapiens
atactagggctttagtgagtgtcaaaatggcttagatgttgttcatgatcctgaattccagcaaaagagctattgccaaccagtttgaagaccgccccccgtctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgc

SEQ ID NO: 641480 - DNA, 580 bp, Homo sapiens
agtagtacttggtctgttaccagtgataaaccaaagaggagtatctgcagtccttctggacattttcaagcaatatctttataccacacagcagagaataagcaaaaaacaaaaacaaaattgaaaagcagtaatgcacttagttcttggccccatgtcgggcattggggagaacctgtggttggaatgtccagcctgcacaatgccattttattacccttggtgcgtgtacttacgtgacaggatatgggtctgtgcacaaagatatatcgcagctataaagggggctgggagggtcgtttttcccttggggatgctgaataaactttggtgcacctacgtatggacctcgacctgtcacataagctcaagtgtggaattttccacttgtggcatcacattggcactcaagaagtttggggattggtagcatttaagatttgggattttctgattagggatgctcaacctgtgtgcctaattattggttataaatatggaaatgcttaacacattgtacatgaagttgtctgtgcacgtaatatacttttccttatttcttaggtgatgctcaaagatc

SEQ ID NO: 641481 - DNA, 488 bp, Homo sapiens
  misc_feature (424)..(424): n is a, c, g, or t
cctatcgaatcgacggttctcgaaaagggggatgtgtcagggtcacaagacaatagtggggagagggtcagcagacaaacacgtgaacaaaggtctttgcatcatagacaatgtaaacgattaagtgctgtgcttttagatatgcatacacataaacatctcaatgctttacaaagcagtattgctgcccgcaggtcccacctccagccctaaggcggtttttccctatctcagtagatggagcatgcaatcaggttttatatggagacattccattgcccagggacgggcaggagacagatgccttcctcttgtctcaactgcaagaggcattccttcctctttttactaaatcctcctacagcacatgaccctttacgggctgtcgcggctggatggacgagtcaggtcttatcccatcccnacgaggtccatattctcagacttatcacatgggagagaaaccgttcgaattcgaaggggtaccg

SEQ ID NO: 641482 - DNA, 153 bp, Homo sapiens
  misc_feature (73)..(73): n is a, c, g, or t
  misc_feature (75)..(75): n is a, c, g, or t
  misc_feature (102)..(103): n is a, c, g, or t
catagggtgggcggtttaggagctaccagcactgaggggggcaccaaggggggcaaaccagaggcctgtgatngntaaaactggaggggggtagagcagggnncgggtctgtgggtgggggtctaaggggagcgaggtagcctttgaagttag

SEQ ID NO: 641483 - DNA, 146 bp, Homo sapiens
cacagacaacaagtcccaggtctagggcacagttgtctcattcctatgataccagtatgtagagagattgaggcaggagaatcgcttgagcttaggagttcaagatcagcctgggcaagacagtgaaacttagtctctacaaaaaa

SEQ ID NO: 641484 - DNA, 451 bp, Homo sapiens
tggcccctttccccttgggtttttccggttaggcaaaaccacccgtttcctttttccccaattttccaatattttttccccgtagggttttttttgggccggtttccttgtggttatttccccgctttggaaagggggttttttttttttggtggggtttttttttttttttttaacttggggccccccagttttaaaggttttttttttttcctggccgtttttcccccggttggctttccagttggggggggtggacccataacctgtttttttttttaaaatttaatttacccctggttgggggttcttttttttttttgggggttgcccctggccccttgtttggttcccttccccttttggggggcctttttccccccccggcctttttctttccctgggtaacttttttagtggtttaaatgggattaattgcttttttccctta

SEQ ID NO: 641485 - DNA, 1145 bp, Homo sapiens
gggcgagccgcatccggtgtccttccatgctgtggaggctctgtatgtttcgactctttctactgtcgttactcttcgggtccacactgcttttatgagctgtaacactcaccctgaaggtttgcaacttgactcctgaagccagcaatgaacacgagccccagggaggaacgaacaactccagacgcgctgccttaagagctgtaacactcaccgagaaggtctgcagcttcactcctgagccagcagaggccacgaacccacacagacaggaagaaactctgcaacacatccgaacatccgcacggcaacaaactccagacgtgccaccttaagagctgttcaacactcaccgcgagggtccgcggcttcatttttgacgtcagctgagaccaagaaccaaccacacttcgggacacaatagcaactctttcatgccaggagaagctccttcccacactttcggcgattaaccagcagccacatgggtccacaatctcctgacacagttgcagccacgggcagctgtcacacagaattcctccttttctcgcacatgcaaatctacatgatatcagcacggcgtccctggcccacagaaggaaccacgagcagggcgacaccgacgcacagtccacagggaacttcagatgcccatactgcagccgtcagacaaccaggacatgagactgcgcacccactcacgccctggagcgcaagccggcctcacagaggtgacggaaagtgcggcacgaacaaaagcgtgtggcccctccccccggcccgaaggggacccattgaaaaggggcaaagcggggacacacggacagggctgcccccagagggaaaccaaaaggcccagaaacaccacgggacggaccacgggacagcgggccaatcaggaagatataggcaggggccacagtcgagaccatgccaccgatgaggtcaaccgtgtggcgaacaaacacaccggggagaccaaccagaacctacggagtctcagcctaaaatagtatggacggaagtcaaatcaacgaagaggaggccgacacgagagcacgcgggccgacatgcgatcatcgtgtctcctgttgctgtttgttcttttcgtgcgcccacagcgcggcagcccagagagcacc

SEQ ID NO: 641486 - DNA, 493 bp, Homo sapiens
gccgctgcgtgcctgcggttggggacccatgtgcagggacccgggtcgcgcctgtgctatggccctgtaccacactgaggagcgctggcccaagcccttgcttcggccagaaattaccgggccttcttcttttaagacatggttaacttggggtcactacattttcaccccttttcagtgatattcctcttgaaggtgaacctctaaaagaaggcaacaagtggcatttccttatgaaggaaaagcacgaacatgattgacattatgagaaatcgtgtttaagtaatgatgtgtcagaaaattaccctcgggtgggaaccaacattgcttacacacatgcgacgcattggcccaccaaaaggaagccaaattgaatttccccatttaaagcaattacttgtacacacggattgcgacaaagcctaccgcatatttgttgtgcgaaaataatctttcccttatacaaaggggtaaataatattggaaattactg

SEQ ID NO: 641487 - DNA, 162 bp, Homo sapiens
tgcaacatagagtacttgcgggatgcaaaactgcttaaagagagaatgacataacatatacgcaggttcttccgagactggctacatgaacttcagcaatgtgagagatacggtgtctctgcatgagcagtcataggaaccagatcctccattgtatatcga

SEQ ID NO: 641488 - DNA, 1698 bp, Homo sapiens
gcttgctccagttggcccatttaactgggagaggtacttgcgcctccgaaggactgaatctggccgagaatgactataaagtccagaataaataccgcacatgttcaaaacacgctcgacctcctcttgaccgagtataacgaagtcccataacccccgagttggtgtggccaggtagaatgacagaatagctctctactagagcattgtgacccctggaaggtactagtcacacctccgtacctaggccagctgataccacatgttgcgcagtgcagcctgctagcagtgcgctgccttctcgccctgactggacacgccacttgaaccccacgctgtaaccgcacatctgtgacaatcgtaccaataccacatttttcgtacacccaactcttccacaacccaccatggactcacatgtctgtacgccatgtacgatcggacccaaataggacgacgcatacgtgtgtaattgcgcagagagccattggtgcgcgagatagcatataggtcatacgtcgcacacgttgggtagctgaatggcctcgtcgcccaagcgtgaccccgcactacttgacttcaggaccccgtcccctttgcggagcgattgcccctggcgtgttcctccttgttgctccccactgtcttcggagcacgttaatacacgcgtctcgcactgctcgtagtccacgcggcctcgatgccaccattggtggcgtccttggggcaactcgtcgcagtcgacccaccagagggacgataccacggggacctccccttcaaatgtagcccacaacgatcgcaccaaatcgttgcgggccaaggacagcttcttccgacggcggttcattcatcgtcccttgtccatgccccttgcgccggccactacccttccaaaccagacgcccactggcatgcgaatagaccgttgcacttccaaagggtgactgcgtgttgtccctacaagcaccacacgtggcgccacacgtgcgttccatagaactctacccagcgtctacccccctgtaaacagtgaggaagcttaccagcgcgtgactcttgggcgaagacgccccgttctgtgcaccagcacgaatggaagggagtctgacgaaactggggggagatcacgcggaggacgcctaggccacagatcactagagcacccccagcagattcgcccgaacagtgcagcagaaagacaccgccaacggcgggcccaacgacgataccagaaacgaaacgaggaccgatggcagcaatgccggtagagcccctgaaaccagccgacatagcagcaaaccaccgtgcacccttgccgccagcatcacacacgcaacaccggctggcgccaaagccacattcggcaagaccgagaacgcccacaacaccactcactatgaacgcagcacgcaaaagggcatgcgcatgggagagcgactaacacagggagacgagcaccagcccacgtccacgtccatagcagacgaacaagccatcaccaccgagcccacctagcgcgacattgcgcagctcgacctcgaacagccccacaccatgtaagacatcccaccgatggaccccgaagaaacacacaggagcccatcgccacacgtactgacacgcacaatgcacacacgatcgcatgcaactccggtacaacggacaaacagagcacacactacaaagacaccacgc

SEQ ID NO: 641489 - DNA, 119 bp, Homo sapiens
ttgtcattagaggccttttatggagacaaggtaaacattgggctgaaaatattacaggctgaaggaagggtgaggaaaccggtatgaaggcagctcaaatgatgaactaaatgtcgacg

SEQ ID NO: 641490 - DNA, 259 bp, Homo sapiens
agctccagttttataatcaaatttcgaccttccattttattccactgaacttctttgaatggcccacgaatatactccatttgttatcttgtatatcatcactttctggaaggtctttaccttggttatcctcggataagggccaaccgaggctccgcggcgctgccgtatcgttccgcctgtggttgagattctgacccagaagcgttcagtcataatcccacagatggtagcttcgccccattggccccttatcgag

SEQ ID NO: 641491 - DNA, 283 bp, Homo sapiens
aagagccttcaaggggccgagggaatcgcggtggggtagaagactaaggaggtcatggcactgggaagcccgctccccaaagacaatggctgagcagatcatccgaggagatctacagccagatccaggagcaaaagagaagatcctggacaagccctccacaggaggacgcacccgcggggacattgccaacatccgcatgccacagatctggcccagctactaacgtgggggacagagagccagccgcaaggcctacgggcaggcactggccaagctgggc

SEQ ID NO: 641492 - DNA, 175 bp, Homo sapiens
catctctctacaagcagctccgggatgcacaaagtcatattatagtcttctaaatactgaccaaactttgcgtcttactcagttcccagaggtgaccaacccacttggttaccaccatcacagtcataaagacatagtcccagttccctgacatcgctggctcccgactcctgca

SEQ ID NO: 641493 - DNA, 897 bp, Homo sapiens
  misc_feature (897)..(897): n is a, c, g, or t
gagaaataagaatcacggccgggcgcggtggctcacgcctgtaatcccagcactttgggaggctgaagcgggcgaatcacgaggtcaagagattgagaccatcctggccaacatggtgaaaccccgtttctactaaaaatacaaaaattagctgggcctggtagcacgtgcctgtagtcccagctacttgggaggctgaggcaggagaatcacttgaacctgggaggcggaggttgtagtaagctgagaccacgccactgcactccaacctggcaacagagtgagactccatttcaaaaaagaaaaaaaaaaaaaaaaattaaaattcactaacggctcttttaaaatttttgatttccaggtaaattatggaaaataaggccactttagttttccaaatttcactagtatttctccctcgggagatagtctccatctattttctaaattggcaggataatatactagtggagtatggtataactgatgactggagtatatctgatgaatatccgtgtcctttatagaatctatttatgagagatcccgtagacctattttatagattaccatagcggtctgtctatgggtagaaaagacgcggattaaattcgggggtgcaagatcattcaactcgtagtaatggagtcatctcaccactactggaatatgtcgtaatattatagtccattgaattaaattccaggcgagcattgaaactacagagtataaagcgaccggggggggtgcgtgtacccttggacagggggggcagaggcacatcgaccaggcaatgtaacgcgccaaatacaggcggggacgtacaccaggggaccacaagatgcgacacctgtgaaaaaacgcgcccgcgacgaggcatttgtctcgagaccacgn

SEQ ID NO: 641494 - DNA, 1205 bp, Homo sapiens
gagccacgtcagttcgagctgaagtactgtgagcttctttggggaatggcgattttgtgtgccattcacactggtctttatcacatagttttgagcttattgcagtatatgttttggggatttatctgtaaaatgggtgtaatatttcctaatacgaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttgaaaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtgaaatcttccaagtcttttctggaattattataaatactttagttttattttctcatcttaatctctccataatttcccatttaaaggtttacaaatatgagtgtgtggatgctttaattcatttaacctcactcctcaaaggtaacatgcaacttagttctgttatatgagagtctttttctttaatgtactggaaaaagcctatgtgaatctgttgatagaatttaaaattccaggccgggcgtggtggctcacgactgtaatcccagaactttgggaggccaaggcaggtggatcacttgaggtcaggagttcgagactagcctggccaacatggtgaaaccccatctctactaaaaatacaacagccaggtgtgatggtgcacgctcgtggtcccggctactcgggaggctgaggcaggagaatcgcttgaacccggaaggcagaggttgcagtgagctgagattgtgccactgcacgccagcctgggcaagagagtaagactctctctcaaaaaaaaaaagggggcgctagaatcccagggggccataagcaacaggtttggaacgggccaagggggtaaaaagaggcccttaagcgaggaagcggacggggacacggggaaaggaaccaacaacgaaaaacaggaaccgtggataaaa

SEQ ID NO: 641495 - DNA, 982 bp, Homo sapiens
tggaaacaaagtctcactggtgtttgcccaggctggagttgcaggggcacgatctcggctcactgcaacctcgtgcctccgtgggattcaagtgattctccgtgcctcgagcctcccaagtagctgggattacaggctcccaccatcacgcccagcttacttttacagtaattttcaagtagagacggggtttcatcacattgggccaagctgggtctcaaacttctgacctcgtgatctggcccagcctcggactcccaaagtgctgggattcacagatgtgagccactgcgcccagccttcttttaatatgttgtaaacagtggtgtcttccccaaatattaaagtggtgggataagcattgccaaatatatttcaagtaagccccccctccttaattttcttattgtggtggaaggtgaggcatctcccctatgtggccaaagcgggctctgtgaaccccgggtactcaagcaatcctcctacctcagccatccgtgagtgtgtccatctacaaattggataagagtgacaagtcataatcctacaggaggataaccctattattcaaaaaccctattgtgatacgggaattttgacaatacaggggaattacgaggcattgttgttgaacacccgtacagtaaagttagatgttaacacataaggtatggggaggaatatgacagagtatatataattacaaaggttgttgccaaagattttaaaagttcatgggtgtcaacaaagatgttcaaaagtttgggttcttgcacaaaaataaatttgcccaacatagttgtgttatgcgttatattaaaagtttgcaagaggatttgtagccgtttgtagaggagagttagagcacaagggggaaaattataagtagggggccaaatagtggtgggatcgtatacaaacaggacgatgcgatcaatgaagagtagcagtggtggtacaagagagagagatatatgataga

SEQ ID NO: 641496 - DNA, 172 bp, Homo sapiens
ctcacttccactatgtcctatcatagggagctgtcatttggcatccatagggagcttaattcactgatttcccctattctcaggctacaccctagaccaaacctacgccaaaatccatttaactatacatattacatcggcgtaaatctaaccttcctaccaacacaattct

SEQ ID NO: 641497 - DNA, 164 bp, Homo sapiens
gcaatgttaggacacggcggtggagcggtgggggaggggtcgtggggtcctgcaccgtagaaattccctcaggtccgtgctggtgtggcttaattccggtaactcttgcactaccgtaccgttcacgatggagccagaatgaccctatcggtggttcacgagcc

SEQ ID NO: 641498 - DNA, 360 bp, Homo sapiens
taaattggggcttttaccgtttacctttttattaatcttttagttcgtaattaattgttgagaggggtttattctttctaagggtggtattgtttttcacaaatcggtgtgtacccgatatatagtgtcacagagcttctaagtccgctccttataggccgtttggggttttccttatgttccccctgaatctcaaaatatccttactagtggggaaccctgtcttttaaaagggtctcctggacattagcctgttcatctcattcggaacatcgttttttggaggggctttaattactgttctttggaggggctacgggtgtcaccctacgcgttttttttttttatcccaaacattcg

SEQ ID NO: 641499 - DNA, 314 bp, Homo sapiens
cttagatcatgctttggctatgcaggctcttttttagttccatatgaattttaggatttaatttagttctgtgaagaatgatcatggtactttgatgggaattgcagtgaatctgtagattgcttttggcagtacggtaattttcacagcattgattccacacatccatgaccatttgtttgtgtcactgatactctctttcagcagtgttttgtagttttccttgtggagcatctttcacctccttggttcagtatcattcctaagtcatttatttattttttttttgtagctgttgtgcaaggaacaaatct

SEQ ID NO: 641500 - DNA, 192 bp, Homo sapiens
gtcctcaccgccccccctcctgccgactgcttcggtatgaagctgagcctgctgagggcctcaggggtcctgccttggccaagaatagccgggaatatgtgaggccggggctgcctgtcaccttcatcgatgaggtagactcggaggaggccccccaagcagccaaactaccctacctcccgcaccctgcca

SEQ ID NO: 641501 - DNA, 103 bp, Homo sapiens
tacaggatcccagactgtcgacaggttggctgatgccccgactactattgctgccatactataacctttgcggagattgtcagactcgcgcgtcaatcgattg

SEQ ID NO: 641502 - DNA, 500 bp, Homo sapiens
aagaggaggatcgcttgaatccaggagttagagaccagcttgggcaaccctgtctctacagaaaatacaaaaactatcgggctgtggtggcgcatacctgaagtcccagctactcaggtggctgaggtgggaggagatcgcttgagcccaggaggtcgaggctgcagtgatccctggtcatgccactgtactccagcctggtgacagagcaagactccggctcttaaaaaaaaaaaaaaaaaaaaaaaaagagagagagagaataaatagaaaagaatgtggctgggaattgtgaatcagaagattataccccccaatttttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttg

SEQ ID NO: 641503 - DNA, 195 bp, Homo sapiens
gtgccgttgttgggccaccttccagtctgtgtaggctggaaggctcagctctccaaatgtcctatcctgggaggagtgggtcttagaggtcctctggatctagatggatgaaatgcgataccatagggcagcgacacacatgcatgtgcgcacaaggcatgtgttgagcacatatcgagagcagagtctgcgtcc

SEQ ID NO: 641504 - DNA, 769 bp, Homo sapiens
agattccctgtgatttgggccatcaatgtggaggggccaacccaacaagaggagtcctttcccagagtagaagacacaagctgcatcttgaagaatgagtagatgtgctcctgagggtgcaaaatcaatcaatctgaagtccaggggatgaatttctgagagccacaaaaggggtcctccttactcaagaccaaagacctgaagagtccttcatcagggctctgacctggggtctgggcctgagcttccttctggattgatgcttattgtaacatacccaagatgctcacagatgctgaggacctccagccagttccaaatgagtttgcggtaggaggatctttaataggattgactctagacttagcatttgctccaaatgccttcctggctgcaggataaaacctatgacagcccgaaccatgcaagagccaatactgttctccagtcccacatcatttccactaactgcctgcacctctatgaatgccagtgtttgattaactcctcccacacacttacttggctcccctcccttccttttcggcccacaccttaagtccagaccctgtttacccatacgcccgcttttttaaccatgccacaactattcacccagtgttattttcggccgagccgcagagcgtttagtgccgtcgccccctttccatctgcctttatagtatgcacgcagtcgatccatcatttctcacccgccgctggagctgccccgcttccccgtcccgtcccgtacttttcctcgatcacg

SEQ ID NO: 641505 - DNA, 391 bp, Homo sapiens
aacgtgcacatgttagtacatctccgtcataggctggattcctggcagtgaaggagcacgcctgcaaacagatctccgtgcctgatctttgggtcttgagtggaataccccctgcgggagttggtcgtcccgtgcgactcccgttccagccgaacaactctgtactcgtagagaaaaaagagcatttctggagttttgaccggtcggaatgtcgaatcccacccaggccgatcagttcagatatcggaaaatgaccagttttctgctggattactactttggtcgcctagaacttgacttgcgtcacacgatcattcctgctaaatcaccagagaaatgcaggtagaacattattccggatctcttagccatgaacccccttcatgcccag

SEQ ID NO: 641506 - DNA, 228 bp, Homo sapiens
cagatatgaactcactttatatagtactcagagaacaaagagcagaaatatgtctcgcatcccattcctcagcatagcgtgttaaagcagaaacctaatttaggatctggcacccttgtggcaaggcagacacagctgaggttgggctacatcttagcttccaatgccatagctgtggttcgagttgggatggcagctgctccactactggagcagcagggaaagaca

SEQ ID NO: 641507 - DNA, 127 bp, Homo sapiens
atctagaggtccccgatgttgtatcataccccgccgccccgatacagcgactaagtatgaataacagtgcaggtattaacaacagatgcaggtataacaacagtgcatgtagtgaacacacagtgca

SEQ ID NO: 641508 - DNA, 312 bp, Homo sapiens
tctgcgagattcggatcctgacaggaactgggtgcttcccttccaaacagtgggttcccttttggtccaaggtatgtctaataatgtcgtccgggagcctcagggttctgcctgatgctctatcctgctgtggctgagctggtatccaagctgcaagacaaagccctctttcctctcctcttattctctagcagaaggaaggagtctctcctggaggtgcaggctgcactgcctgtggttgtgggaggagtctcactggagctgcaggctgcactgcctgtggttctgggaggagtctctcctggagctgca

SEQ ID NO: 641509 - DNA, 130 bp, Homo sapiens
tcgattgtcgtacttactgtttgactacttgatgatcattagaaacaaactgtgcatccacgctgcacgtgaagcaccaaccgcagcatgcaatacatcagcaatggggaataataatgacgatcagggt

SEQ ID NO: 641510 - DNA, 1349 bp, Homo sapiens
gacaacatcttgagtgacagcgtgactcgaatctgccgacactgggcattgtactccctgtggacatctgctgctgacattgaactgtgtgtacatgcgctgtggcggcacttcactcgatgaacgggtggtttgaatgcgcatactggccaacgtcacttagactagcctcctgacctcaatctcccctatgcgagaggagtgcgagtgcactccatcgaaccatcgtgtgccaggatcgtccatggcacagggtctccgtgcatgaccgtggaacctatctagtcccatagttatcaatgtgtgtttacgtggattgaagtgcttgggtggctgatgtattggactgaggtagggggctatcatgcttagcaatgtagtttgacgctgttcctgggacatgcttgctccaatgcttaatggaatgctagaacgtcgtggatagttaggtctgggattgaatggacattgggaacaaggacaatggaaggggaaataaggaaacccgtggatgttgttggggacagccccttgcggattaccagcggtattcgtgggttgcatgagcgtgaccatgaaccgcggcagaagagatatgatggcacttccatggatgaccccgttcacaccagacccgtatatcacacatgaattgcttgctccctcggagaatagcgcagtaggtgtcaccatgaagcttgttgacgtgctcaaagatgttggccaaattaggaaaccatcggtgctattcaattcaaccgttcgagtgagagtcggccacgggtttaggggagacctcttgaagtaagaccgtcatgggtttgtcatcaccctttaggtagccaacgggaataccttaggaagcacagtgggatcccaaccaaagcgggctttatgaggtcgcacgcctattggggaagaagcatgaggttagtgtaaaaggtcccttagcaaacatcaggtttagttggcacttacctacaagcggtgtatcgccctttcacaccgttgtacccagcaacatacgcctcaaaaagacacatttttggtcccaagattggtacccctctaaagtggtgattcacgccatccgcctttggtacatttattacacagaagggacactgtttgcattaacttcggtggggcattggtccttatgatgaccccgcgttactcaggaatatggccagaccacttcttgagcccaccgtggcaccaaacgcctatcatttagcacaaagcatggctatacatcggcgaaataagcgcaaaaaagtatagggacatcatacttacaacaccactctttgagaggcgcatgaaatgctaggccctcgcgtggaatt

SEQ ID NO: 641511 - DNA, 104 bp, Homo sapiens
gtttaaacagctgacattatgaacaagcagtacaacaacttgaaagtcgtctggatgagatactttctagaatgcagctgtgtaatggagctgttgtaactgag

SEQ ID NO: 641512 - DNA, 1043 bp, Homo sapiens
  misc_feature (50)..(50): n is a, c, g, or t
  misc_feature (66)..(66): n is a, c, g, or t
  misc_feature (71)..(71): n is a, c, g, or t
  misc_feature (76)..(76): n is a, c, g, or t
  misc_feature (93)..(93): n is a, c, g, or t
  misc_feature (97)..(97): n is a, c, g, or t
  misc_feature (106)..(106): n is a, c, g, or t
  misc_feature (123)..(123): n is a, c, g, or t
  misc_feature (130)..(130): n is a, c, g, or t
  misc_feature (153)..(153): n is a, c, g, or t
  misc_feature (155)..(155): n is a, c, g, or t
  misc_feature (161)..(163): n is a, c, g, or t
  misc_feature (171)..(171): n is a, c, g, or t
  misc_feature (182)..(182): n is a, c, g, or t
  misc_feature (195)..(195): n is a, c, g, or t
  misc_feature (202)..(202): n is a, c, g, or t
  misc_feature (211)..(211): n is a, c, g, or t
  misc_feature (215)..(215): n is a, c, g, or t
  misc_feature (246)..(246): n is a, c, g, or t
  misc_feature (252)..(252): n is a, c, g, or t
  misc_feature (255)..(255): n is a, c, g, or t
  misc_feature (259)..(259): n is a, c, g, or t
  misc_feature (273)..(273): n is a, c, g, or t
  misc_feature (280)..(281): n is a, c, g, or t
  misc_feature (284)..(285): n is a, c, g, or t
  misc_feature (307)..(307): n is a, c, g, or t
  misc_feature (319)..(319): n is a, c, g, or t
  misc_feature (323)..(323): n is a, c, g, or t
  misc_feature (328)..(328): n is a, c, g, or t
  misc_feature (338)..(338): n is a, c, g, or t
  misc_feature (349)..(349): n is a, c, g, or t
  misc_feature (356)..(356): n is a, c, g, or t
  misc_feature (388)..(388): n is a, c, g, or t
  misc_feature (405)..(405): n is a, c, g, or t
  misc_feature (409)..(409): n is a, c, g, or t
  misc_feature (412)..(412): n is a, c, g, or t
  misc_feature (436)..(436): n is a, c, g, or t
  misc_feature (463)..(463): n is a, c, g, or t
  misc_feature (473)..(473): n is a, c, g, or t
  misc_feature (480)..(480): n is a, c, g, or t
  misc_feature (515)..(515): n is a, c, g, or t
  misc_feature (599)..(600): n is a, c, g, or t
  misc_feature (615)..(615): n is a, c, g, or t
  misc_feature (625)..(625): n is a, c, g, or t
  misc_feature (675)..(675): n is a, c, g, or t
  misc_feature (681)..(681): n is a, c, g, or t
  misc_feature (742)..(742): n is a, c, g, or t
  misc_feature (816)..(816): n is a, c, g, or t
  misc_feature (829)..(829): n is a, c, g, or t
  misc_feature (836)..(836): n is a, c, g, or t
  misc_feature (1005)..(1005): n is a, c, g, or t
tattttaaacaaaaaccaacgggtgatataaaatgatagccaccccgganatgacacgaggctcanatgantctanacacttggtggaaagtnaggngagaaaaanaatgacttgggcaaatnacacgantgcaaagctagagctgccaacangnctccannnagcttggnttctgtagaantactaaggaagcngtacganctccacggnggtngggcgctaactagcagggacccctgcaagtnttggtnggnggcntagagctgcctganctgacannaanngaggggtctgtttagccaacangtgaccgaagtntttntttcncacagcttanttggccaaggngtttctnaagttcctgccggcaaacttagccttgctgcncagctcctcttcaattnttanganctggttgtacttggccaagcgctnagatcggtaaggtgcaccaattttganctgcccagtncacaganccaaaaccaggtcagcgatgaaggtatcttcagtntcccccgaacgatgagacaccatgacgccccaaccattggcctgggccagcttgcacgcctgaagagactaggtcacggagccnntctggttgactttgngcaggaggcngtcgccggacttctcgttcacggccttggcgatcctctttgggttggtcnctgtangaacatcccccactacctggattcctgcactggctgtgaacttctgccaagctccccagtnatcctggtcaaagggatcttcgatagacaccactgggtagtccttgatgaaggacttgtacaggtcagccagcnggtcaggcgagangtacctnctggggtcatcgggagacttgaagtccaggtcatacttcccagacctgaagaactcggaggccgctacgtccatgccgatgaccaccttatcagtttagccagccttcccaatagcagttttcagcagctccaggccttctttattctcaggatgttgggagcaaccgncttcatccccacattggtggcatctttccatatttctc

SEQ ID NO: 641513 - DNA, 255 bp, Homo sapiens
acatggaccccaagaaaactgtaaatcagacacaccagaaacctttagaaaaaaaaactacacctgtgctattaccacagtcaaagcaagagacacaaaagcaggcaaatggagtcgttgggaatgccgctgcatgtacacggacagactgaagacacgaccgtttccgatacacgggctgatgattctgacacgacacgacagacaccccaataagagacttcccaaacgtgagaacagactgatggtacgtga

SEQ ID NO: 641514 - DNA, 202 bp, Homo sapiens
cagatgatcccgctatctgttatcggctgagatcgacggtagtattgacatgacagtcgacgaaataccctggagtggtgcctgcctgtgattgatgccaggaataacgagtggcagcctggagtttagcattgcttgggcatcccagtgacttcttccctgttcaagtttcctttgtctcctagaaaaattactgtaacat

SEQ ID NO: 641515 - DNA, 203 bp, Homo sapiens
taattttgcggtgcctttcctactcagaggtatgagtgacagacagcagctggaacatcaggtcactcccaccctaatactgcgctatttccaaggggcttaaaaaatggcacaccaggagattatatcctgcacctggctcggagggtcctacacccactggagtcttgctgacttgctggcacagcagatctgacgatcaa

SEQ ID NO: 641516 - DNA, 417 bp, Homo sapiens
cttgttgttattgtacagaaaaaaataaaaaacaggactcccagcaagatgaatccaatgaccgtattcttatccgtcttcatagaaacttttattgagcggcaaaggtagggcatggatcgaaaactgggggttttcagtattatattccgttaaaataaagacatgaaactgtacagggaagaacagttcggtccgctcatcccagtggtgcctttcgacagtctggaagaacccatcgaatacctgattgagtctacgcatggtcagcaggtaagtcttttcagtaacgacagcaaagaactcgcttccctgattgatcccctggtgaaccaggtaagccgtgtgaacatcaaaagcgcggatatggccgggtgcggcagtagcatcttccgctacacggactcaggtggtgtg

SEQ ID NO: 641517 - DNA, 1029 bp, Homo sapiens
  misc_feature (698)..(698): n is a, c, g, or t
  misc_feature (822)..(822): n is a, c, g, or t
gggaccacaccaaaatgtcatctcaagatggaacatcgggccgaatggcaaaccatgcatgtttacattgtcacagaattcgtctgggcgataaaggctacgttaacaaacggaggacctgagagtactcatgtcatccagagagttccctggtagtttaagggacacatagtctagataagagaccctctggtctgtggtagctaagatataacactgtaaggacctggatcagtgtacgagatggcaaagtgggctttcccgagatgacttcgtttctcgcacttaattagcgggcgctcatgcatatgcatggcgaatgagctactttacgtcggtacaacattgaacgcagaacgggagaacgcaatgtagagccagaaagtgaagcaaggtatcggatccatcccatgactaaagagattgatcccagaagggatcgcgttaatggagatctggcccataaggcttcccctgataagaacgggatggtcatcgagcatgatcatgagacgatcattagcaagaatgtaacaataggtaagtatcctaaacttgtacatttttgagaaaaggctagaagaaagagaagaatgttttaaattacctcagattaaagctttatgatcctcccgtaatttggttgcgcgattccccttttggccctttccattcaacacttcaagggtctcctaaanaagtaaagtgacgcgaaaaaagaaaacccttggagaccggttaaagtttttccgagagggcatttaaaaaagaacggagggatttattcgccccatagagagaggggaaatgcagacatagatngggccatcaatggtgccatagtacaaggttgaaggactttggggacgcaaccgtttttcactgaagcgtcacaaaagtggggagaaatagaattcacggagagggatattcagcaaagatatagagacgactaaggaaagttaagataggagtagataaggacgagagtattaaccggggatattactagagaaagagtgaaaaaga

SEQ ID NO: 641518 - DNA, 684 bp, Homo sapiens
  misc_feature (620)..(620): n is a, c, g, or t
gcaggataggcaaacccatatccggagtaagcatctattcgggtgaagacagatcactgcccttttcatgaaggaagaggaccaatatatcaacctgttaccaagtagctggcttatcaccccaaggaatggtgccatatcgaaggctcagtgtttgtttctgctgctggcaaattgggcattcagcagtgtctgtagccaggtcagccttggtgagtggaagtccatgttgctgaatccatgtgtaacctccatcgctgccaccatggccactttgttcatgggctcattggatgatgacaggagtggctggggaagaagcctggggaaggaggctgagtgggtcatcccatccacttgattatttcctcctctgctgaagtcacccttttgtgagcattctcatgagatacaaatatcttaacaggttttgaccattcagagaggtccatccacatgcctcttctccaaatttctttgtcaccgattttccaatcatgcttcctccaagtccctgaccatccagtcaaaccacttgctacagcccatgaatcaatatataatcgcacatatggccattttttcttttaagcaacgtgctcacccagtgcactgctcanagtttgcccactgggaagattgcctttggttttctcggaggtgtatggttgacctgtcactttg

SEQ ID NO: 641519 - DNA, 2187 bp, Homo sapiens
ggcaacacccaggtagtttaggctgtcagacacaatgccttctgatgtgcttgaggtgaccaagaagtacatagcgggaccccatatcggattcttgatcaagacacggaacacgcttgacccctggacgcggtatccgccacgttctacactcaaccgtgcgaaccgagacgggacgtggacacagcatggaccacacatacctgctgacattgctactgcaaccccaatagacccactcaccacagggcaagtccaatcttatcatcacacacccacgcgatggacaggcgatggcacctatgggccatcaacccagaaacgcacagcatagcccatcgcctccagcagacatattcaaacacttaggatattcccagacacacaatgcccacttgagcacaacaataatatgcgacacccaacaaccacacaggggacaaaccagccacgcaccggactgaactttgacctatcgacacagaggacacaagattcaaacccaagatcacccattcgtagcaatccataagagaccacacagcaccgaataactaacaaccgaccataacacaacaccaccgcaccacagtacacacaagcacccaatagacaaccaacataggtagaaaaccaaggcgacaacgggcaaagacaaatagacaactcggctatcggcgcaaaaaacgacaccgacagaacaaagaacgatacaagtaccagcccgtacaaaatatcgcacaagccaatcaacatactggaaagccccgaatatgcccgagccaaccacgcgcaacagaactacaaagcgggcgaccagcacgacacgccagtttacacatacacatgtcgaccaacgcctaaacagaagagacgcagttagagggacgaacacccacgaacgagcacgcaaagcgagccaaacgccaggaggaccaatcaaaaacgcgacagccaccaccacgcgaggacacaccacaacacaggaaggaacaacaccgacattggagagaccacagcagcaacgaccaacgacaacagacccaacaaatcacagggaaaaaagcaacaaacacacagagcgcaccaagagcgaagacaaaaagcgaagcgacacacacgtacaacacacgccacaacaagcgcggacaaagcacaacaatgaccaccatactaggaacaccacagcaggacaaaccgaccagcaacacacccccaaacctacaacacagagcacacaacagcaacaaccacacaacacccaatcacacatcaaccactgtaaacaactcacccatacacgcaacatcgctcaagaaaccagaccaacagcaataccaccacacgcaaacacatataactcggagacagcacacaacacgagcagctacacatccaaaacaacatatgccatacacaccaccatcaccacaactattaacccacacaaacacataaatcagacatctattaacctcacacacacacgccacaaaacaatacaccctgactcataccccaaacaccgaacaacgatatgggagaaacaacgaatggagagtgagtaacacacgacaactattgtgacgacatcaccacaagtatagtgagcaaagaagaacaacgcacggagccacacaccaacaagcatgaacacacgacacagcagaccacacacacacaaggcaagcacacgcacaaaacgagaggaagagagagaaagccgcaagaaacacacgcaaacacacacgatgcgagacagcatacacggccagattgtacagcacagaaaagagaagcaagtaacaaagaataatagagacatacgaccaagacgaacaacagaccacaacaacacacgagacacaccagcgcagcagtagcggaaacacatcgaacgaagagcgacgacgagacgagctagagcatcagcacagaaaagcaggagggagacaacgccacagcgagcgacggcgacagacacacggagaccacacaacaacacaccaagacgaatgaagcatataccaacaacagaggcacgagacgaacaccagaaaccgcactcagccgcgacgcagagtgcacaccacgaacacaagcagacacgaagagcagagcaggagagacgagatcacaccagaaccgacacagcaggagcaaccagcacaaaatacgagagaacgt

SEQ ID NO: 641520 - DNA, 385 bp, Homo sapiens
  misc_feature (13)..(13): n is a, c, g, or t
  misc_feature (60)..(60): n is a, c, g, or t
  misc_feature (86)..(86): n is a, c, g, or t
  misc_feature (88)..(88): n is a, c, g, or t
  misc_feature (331)..(331): n is a, c, g, or t
gcatcacagacanttcaactgttttctgcctgagcagaattaagacttggcctcctaaantcctcccatcaccattttctccactntnttcccttggccttcatcaccaacaccacctcatcaaccgtgaaagattcaaagagtaaggaaaaccatttctaggaccatgaaatgtgtcactggatctcctgcagaaatctgccagagctacaatgtgactggtttctacatgtctgacaaatttctatttaaataagtatttttcaaaatgcaaattgctacctattctttggccatcaaatcactttagtgggttgcaaccggctttttnttcttaatagaaaaggaaatgtgttgcatttggtaaacatggaaattgttttat

SEQ ID NO: 641521 - DNA, 151 bp, Homo sapiens
gcagtacggtgagaccctgtctgcagacaaaaaaaatttaaattagccaggcatggtggcacgggcctgcagtcccgactacttgggaggatgaggtggcacattttttatcatttcaccactcagaaataagcatgcttaactttctggt

SEQ ID NO: 641522 - DNA, 200 bp, Homo sapiens
gctgttcagacttgaagattcgggacctcctgacgcggtgcttcacaaaggtcacaccacttctgtgttcccacccaaagtgagcaacaggactctggtccggcagatgaaaactgaggggaaaatccacaaaaataagatacacttccaaaatgcaccagtcaaggaagcaagagaagacaggagaaaggatgacaggg

SEQ ID NO: 641523 - DNA, 183 bp, Homo sapiens
cgctttggggggctccttgggtggctctttgtgtggctcgttgtgtggcacttggggtggcgcttggtggagcgatttgtctgtttgattccgaggcgcatcgtgcggctcgtcgcggggcgtttcgggtggctcgtggggcctcccacttattctacacctctcatgtctctacaccaagag

SEQ ID NO: 641524 - DNA, 504 bp, Homo sapiens
agtgataagattgtgaggtatgtatgacatcccatcgcatcacggagtgggaagtcagggtaggggttttatttgcttcttgttatgagacagagtcttgctcgtgtcagccagtgctggagtgcagtggcgtgatctcagcacacgtgcaaactccgcctcccaggttcaagcgattatcctgcctcatcctcccgagtagctgggataacaggcatccaccatcacgcccagctaattttcgaacttttggtggagacggggtttcgccatgtaggccaggttggtctccaactcctgacctcaggtgaccccccaactcagcctcccaaagtgctgggattacaggcatgagccaccacgccaggcaaatcatgggaaattagagttcgataaactgatgttatctggtaatactgtttggcccaagtgttttttgacatctgacagtttgctgttgggtgggaacttggaatggcattccatgtatccagggtttgatgc

SEQ ID NO: 641525 - DNA, 855 bp, Homo sapiens
agcggaggaaggctgaggctgcagtgggctgtgatcatgccactgcattccaacctgggtgagagagaccccatttttaaaaaaatatatagggccgggcgcagtggctcacacctgtaatcccagcactttgggatgccaaggcaggcagataacctgaggtcaggagtttgagaccagcctggccaacatggtgaaaccccattcctactaaaaatacaaaaattagctaggcatggtggcaaatgcctttagtcccagctactagggaggctgaggcagaagaatggcttgaacccaggaggcagaggtttcagtgaaccgcgattgtgccactgcactccagcctgggcgacagaacaagactctgtctcaaaaaaaaaaaaaaaaagggataatccattctgggcttggatttcgaaagacagagtggagaaattggaagaaatttcgtggtgccggggtaaatcaatttccaacgaagaatcgaaaggaaaaaaaaaggctttatgaaatctatgggtccatggttaaaagaaattggatggtggatggcaacgaataattggggggagcacaacatttattgaacagaatgtggacagcttggcattggcttgggaaaaaaggggacataactaggacaacatttacactatgggctattataaaaaggggtatggatttgaatcacttttcccagggcgaacgtgggagggtcaccacaaatcatggccccagggcggagagtcgcaataagggggcacagcattgaagggcacataggagccttgagaatgccgggacctcacaagaaatcctgccgggcccacgggcctcagggaaaaagctggg

SEQ ID NO: 641526 - DNA, 193 bp, Homo sapiens
  misc_feature (82)..(82): n is a, c, g, or t
  misc_feature (142)..(142): n is a, c, g, or t
  misc_feature (146)..(146): n is a, c, g, or t
accctcttctgataaatttgagggcccgtttgtccttggagaccttcagtaactccatggcgcgccatcgtacggggcaaanacacacctcccgaatcatgtcccgcacgaacttggtgtgtttggtcagacgcccgcgttnggcntgtgctgggcttgctcacgttcttgtcactttgtggcccttgttgag

SEQ ID NO: 641527 - DNA, 103 bp, Homo sapiens
ctgtttagttagggtaagcagatggaggtaggattggtgctgtgggtgaaatgagtttgatggtggtggtggttgtgtgtaaacatttaatagctgtagagaa

SEQ ID NO: 641528 - DNA, 359 bp, Homo sapiens
  misc_feature (359)..(359): n is a, c, g, or t
gagaactagtctcgagttctagccatgtggtcatgctgtgcatactgtttgggggccatacacaccaccaattatttattaaattttcctttgttaacaatagcccataaattggactgcccacccacaaacttggcctaaccgattttctcgctctaattactttccggggccattggatgaattgctttaaccattcttgagcctcttctagagattcatttacatctgaagactgcaggacctttacaagcattcctatggttagagcattttttgagatccagtttaagggccccactcaacactttgagcgcttgtgtacttccgcttatttcaactgccgcgtggtgcccccn

SEQ ID NO: 641529 - DNA, 304 bp, Homo sapiens
  misc_feature (41)..(41): n is a, c, g, or t
  misc_feature (46)..(46): n is a, c, g, or t
  misc_feature (77)..(77): n is a, c, g, or t
  misc_feature (287)..(287): n is a, c, g, or t
aaatccggctaactaaaaggaagtcacactggccgtggtgncttantcctgtgatcccagcgctttgggaagccaanacgggtggatcatgaggtcgggagttcgagaccagcctggctgacatggggaaacccttgtctctactgaaaatgcaaagattagccaggtgtggtgtcacacgccttggttctcagctgctcgggaggctgaggcaggagagtacctcgaaccaggaggcagaggttgcagtgagccgggattggcgccattgcgctccattctggggnacagacagctccgtctc

SEQ ID NO: 641530 - DNA, 758 bp, Homo sapiens
gcccaaacggtgcacggtaagagtgatggtgagctggctatgtgtagggggcaacacgattctcctccctgagttcgagcagatgcagaggcaacccatccctcggataactcacgccgaaaatcccctaagttccaatccattatccactctctgttttactgtccaaagtccctgggacactgtaaatgccacgatcggcgattctggagacgcatagacacgcagcacacagaggactacctgcgtgtgcgccagggaacgctcgctagtgagacactccgtgcgctgactcgtgtctgacgtataggaacagtgcatgaaggagtccgagcctgcaccctgagatgctgcagtctgacgagagtggataatgcgcagattcatatcgctgaacgatcgcctgaacgcgggggagagaaccagttcacccgtggacagttggacgccacaggtgaacaggcaatcggaaaagtgttgaacgtgccaaagaatacaggaatacgaagcaacgcggatagcgtccctcacgctgaacacccagacaagaacgggccatcgatcctttgctgacaagtcgcaatgccacggacatgaccaggtgaattgggtgccctgctacgtccttattcgtgcactctcacaagctattccacagtaaatgggatgttcagaagccattggcaggccttgtgtacacttggcagtattcccgaaaaacacgtggcgtaattgacagaatactatcgggtgaacag

SEQ ID NO: 641531 - DNA, 215 bp, Homo sapiens
  misc_feature (124)..(124): n is a, c, g, or t
  misc_feature (133)..(133): n is a, c, g, or t
  misc_feature (169)..(169): n is a, c, g, or t
  misc_feature (180)..(180): n is a, c, g, or t
  misc_feature (199)..(199): n is a, c, g, or t
gggggtggaggttgcagtgagctgagatcgcaccactgtactccagcctgggtgacagagcgagactccatctcaaaaaaaaaaaaaaaaaaaaaaaaaaaagacttgcttctgtacttaaatnccagtttancttatagattgtctttaatcacaaaagggtcatcanttgaaaaaaancgatgtgttttatttgggnaaagtaaaataggcct

SEQ ID NO: 641532 - DNA, 377 bp, Homo sapiens
gctgactcatcgctgacatcgtacctggaggctactggcatcccatcagcatcagccctttgattctgtgcctgcgcgtgctgtgggtgtgcgttacatcacgttcagcttcaaaaatacctttagagctgccatgcgtggacacaagaacagcagcccatcatccattccacggctgacaagctactggttcaggcttttgcggtaccggcaaaaccaccacactggtgttctacgccacacaacacgcctcggttgaaaatgctctacctctgctacaacaaatcccgtcgagctcgctgccagggccgctttccacgcaggaaacgtggtgtgtaagacggcgcatggcctccgcattattgggtaaaagaccg

SEQ ID NO: 641533 - DNA, 666 bp, Homo sapiens
agcggatcccggatccctggatgctaagggtgaagtgggacctgcagggtctccgtggttcaaatggtgccccatgtatcagagctacattccattacatgactaaataatattccattgtgcatataaaccacattttgtttgtccattcatctactgatgcacacttgggttgtttccatttttgaatcttgtgaataatgctacaatgaaccttgccatacaagtatctatttgagtcactgctttcaattatttggggtatatacctaggagtagaattcctaggtcatataatacacagtattttttttaatcaagtacattcaatagttttaaaaaaaacttggacttttttcctgattaaaaagcaacacatgttcattgtaggaaatctggaaaataattacaccacccagagaaagtcgctgttaatatttcagaatattcccttaaaatcttactgtctagttatacacatacacagagacagacatacatggatattttaactaaaactgggttatttccacttatcattgtatcaagagcattaactccactgtcattaaatgttcttcagaggccgggcacagtggctcatgcctgtaatcccagcactttgggaggcaaggtgggtggatcactgaggtcggagtcgaacca

SEQ ID NO: 641534 - DNA, 938 bp, Homo sapiens
gacgcctgcatgggatcgcaaggcggttgaggtgtgagaggttttcgtcgcactagggagattctgcatagcgaattcactatgtcgatcgacactaggtgttcccttccttcatatcaggaagatcatgtgaatcagtagattccattcgttgaaccgctccaggaagtgcactcgtgtcgtaccacgtttgataatagcaggagtttttgcattgcgggtttgtggcatattggtattatataaactgtaatgagacagggtggatacttactataatgtctcattcatctgatccacttgtcttgtgtgtaaacccatggctggttgtgggagcaatcgactgttggtcatggcctattccatgtctcgggatattcttggggctaataaattagtgcctcttatgaagcaggcatgaattggtagttattggtcgttgtccgtgggagagcgtgtgttaaacttagatgtcatttttatttaatagttcccttattgtcgttggaaatataagtatgacgtatggggtaaagatgattaactatgggctttttgaaatgatttggctttcttgtctttgctaggctttattattcggttggttgatccgagattcacttcgttggtaaggtcaacctagtgaggttgcagtacaaggtaagctgagattagttaatcatgtcactaatgcgctcgatgggcttgaaatgtcaccttcttagatttcaagatgacttcgttctaaggagattacgggccagcctaagggatccggtgctgagaaggggcaaattggggagctaaagcttgtgcccgtgaatacattggttccttttgggtgcgacgttacacatcccaaggggatatacgcggcgtcccctgttattttgtgtcaccccgcacgaacgcctgtattaaggccgacaaaagtgtgg

SEQ ID NO: 641535 - DNA, 427 bp, Homo sapiens
agtctcgacacccgagtctgtagcgtctttggtgtaggatggcagcaactgctccagcactaccagctccaagattagttcttttgtgtgcgtctctggcctgagccacagacggcaaagttctcggagctggctcacagcctcacggggcccaggtgaatcctggtatccaaactgcctgaatcgctgtcggaaaatctctgggtctgggagatggttccaggggatacttgatccctcttcgccatcaggatcctcctccaatttcactctcagaattttttcctcttcatctggagttgggcagataagtattgaatcttcttccactgactgtgcagacattctgatttataatatatcaagaaaagacaaatgaggcagaatataagcctcagggcaataccccgtttactacacaggcact

SEQ ID NO: 641536 - DNA, 346 bp, Homo sapiens
  misc_feature (300)..(300): n is a, c, g, or t
atctgtatatgttgtaataaaacttatgctagtttaatttggcgaacacgtgttcaaaaataaaatcacttggtctataaaattagctggccaagaagaaatgttcttaatgttcagaaacctggttgctccacctaataagaagtcagctttcaaccaggagaccacgtgaggccctagactggccagtctgggcagaggttggtactgaaacattcacacagggtctttgatggaccccgaacgtttagctttctcagggggtcagcagagttattgaatcttaattttttttaatgnacaagttttgtataaataataaagaactccttattttgtaaaaaaa

SEQ ID NO: 641537 - DNA, 204 bp, Homo sapiens
atatttttagaatctctcaaataatggaaaagatattctatttactgcataataatccgggatgtgactaggagggaggaaagaatggagagagagagatagagagagagagagagagagagagagaaatagttagataggtggatagtctcacatacttctgaaattttatagtgaatatgactgtgtggggcgataacatca

SEQ ID NO: 641538 - DNA, 153 bp, Homo sapiens
gcgactctagagggatcccctctaaaagctacccgcgctgcatatcaaacaatgttaaggcaggcccatccatatggaagcctaacgagatgatacaatgcttccaaatgttccatgtcatgcaagctttctggtgtttgtcccatgagatgc

SEQ ID NO: 641539 - DNA, 175 bp, Homo sapiens
atcccgttcatcttgctacacaatattcatacttgcatacatatgtgtacgtatgttttttaagtaacgttacttgttaccattagaataaacctagacactacagggacaactctggtggaacatagccggtctgccattaacatacccttctctcaggttgcagggtgtcaga

SEQ ID NO: 641540 - DNA, 134 bp, Homo sapiens
gaaggcaggacactggcgctcacgtcttcacgtacgggtgtcccagatcaccggccatcgaggcacagcacttgctcaagaggaaaccagatattggtgaccccgcaaggggctggaatggtgaagaaagtttt

SEQ ID NO: 641541 - DNA, 281 bp, Homo sapiens
tagtctcttaacgcagctgttgaatgggagttgaggtcttcatacagttcagcctctagaatggtaacaaatcagccacattggattcgaaacaaagaggactaggtgaaactcacccatcacactttgagagtactcactggttggaagaatatagtatagcaggagatcctgtatgaaagagagatgtgggcttcctttaagagtcttgggtgaggtgctgagagcttttacatgggcttatacagggagagagtcttcaacaaatagtctagaaggag

SEQ ID NO: 641542 - DNA, 520 bp, Homo sapiens
cctggtgcagcttgtgatatcatatgttctagctatcttcacgtgagtggatagcaataccagtatatagttatagaaaaaaacacgacacagcaaaaagcaggcacaaaaactcaacgcacataacgtcaggagccatgaattatacagcaggcaacaattcttgggctactgtgaacccctgaagccatcagtaaattcaaacaagaatcacaagtgcttctagctccaggagtctatcggagttagtggaccaggcacaggcttgtacggcccaccaggtccggttctgaccccagatctgctccttctgggctgtttaacttggcaagctgcttccctctcctaaagcatccgtttcccgaatgtgcaagatgaggttacacaaatgccacctccagggtggcccatgacggaggaaatgacaccggtacacgctgccagcacatagtaggggatgactgcgtgtgtctcccttaacaaggctgggacattagtcacctttgtccaggtgtctatc

SEQ ID NO: 641543 - DNA, 224 bp, Homo sapiens
  misc_feature (28)..(28): n is a, c, g, or t
  misc_feature (142)..(142): n is a, c, g, or t
  misc_feature (147)..(147): n is a, c, g, or t
  misc_feature (150)..(150): n is a, c, g, or t
  misc_feature (164)..(164): n is a, c, g, or t
  misc_feature (171)..(171): n is a, c, g, or t
gctcatcttatgtggcacgggggggagncagtgagtgtgtgtgagtggggggggagctgccaaacacttttaaaaccaatcaatctctggtgagaattcatgcactatcacaagaccagcatgggggaaaccgcccccatcntccantcncttccctcccttgncacgtgnaggttataggtccttccttcttctcgtgggtttttctttttgtgttgtgtttt

SEQ ID NO: 641544 - DNA, 131 bp, Homo sapiens
gctaagtaaacccccaaaaaaaaaaagctttgtaggccccttgtacttagtttgggaaaaaaaaataaattgaaattgttaggcttttgtattcccctttcttccaaaaaaaaatttttttttaaaaagta

SEQ ID NO: 641545 - DNA, 868 bp, Homo sapiens
actccctcttagccaatatgtgcctatgccatactagtcttgccgcctggacagacaggtgggcctagccctatagtctcaatctccaacacatatggctagactatgtacataactaaacctactccagtgctaaaactaatcgtcccaacaattatattactaccagtgacatgatttccaaaaaaacaccttatttgtgaatcaacacaaccaccccacagcctaattattagtatcatcccttctattatttctcacccaaatcaacaacaaccttattttagttgtccccaaactttttcctccgaccccttaaaaaccccctttcttaatataaactacgcttgattcctaccccttcaacaatcattgccgcaggaagcgcgcacaacggccacttataatccaggtgaacccactttattcaccgaaaaaacatcaagccaacacacacacctctttgtgcgggccgcgcccctggcccccctcttccgcgagtaacaaacacgggtctttctctacccacatacacataggcaaccacccttaccacaataacttgtagtatgagtatctacagtcctggcgagtattcattttataatgtagacttatataaggtgggaggtagtcacgagcgactagtcctcgtgctctcctgctctaccctcatctgtaacgctgactcgtccgcgctacctagcccctctcccccccgccctctcccccagcacccacccccacagtatgacactcacaccggctctgctaacacctacatattacatgacgtactaccacatacccatactcactgcctatcagatactcgtaccaaccacataccgtagctcctggccctccc

SEQ ID NO: 641546 - DNA, 206 bp, Homo sapiens
gggggggccacaggcacggagaaggcctgtatactggtggtgggattaaactggtgcagccactgcagaaaacggtatagaggttcctccaaaaagctaaaaacagaactactgtatgatccagaaattccactcctgcgtatataccccccaatgaaagtcactgatttgaaaagatacatggaccccttctccggtggcgtggt

SEQ ID NO: 641547 - DNA, 1976 bp, Homo sapiens
  misc_feature (1)..(1): n is a, c, g, or t
  misc_feature (1268)..(1268): n is a, c, g, or t
ntgcggctacatgtctgcagtcgtctgggtgcgtgtcggtcgtgcatgacatgtagttggtcagcacaggcgcgctacggtagtttgtctctcacccgctcgacgtattgtggtgctgccagagagggcgctgatatactcccggtgtgatattgtcgctcgctgactgtgtggtgtggacaccgcgcgcgactcccgttcgggggacagttcatcatcaatgagtggtgcgggtgttcttcgtgctcacgaccgtgggggccgcgccagtactgctccccgaccggtcgtttgctggtgtgaaaattgcgtgttctgtgttgtgcggtgcgaacagaccgttgttgtggttgacgactctcttcagtggaggacaccatgggagtctgtgcaacacagtgggtggccagcggcaataaaaacctttgttggagagccacaaaagttgattcgcggagagctgatggggtggttactagtaggcgttccagattgtgccgttcctcaaagaagggatagatatgtgctctcagaccggtgattcttcatggagccccactcaaataacaacactgttgtgtggaacactccagattgtggtggttaccacaaagccagctgtgtgtggtgggaagaagtctgcacaaaccgacgaggcaggttgattgaagaacacagcccaccacagtcttggggggagaggggtgaaaaaacacgcgcttccccccgtttgtggggggtgtgtttatcctcaagtattagacgctgagtggtacacaaatagatagcgctccttcgtggtggggaataaaatagcccgcaccactataattagggggcccttgtctcgtcaagaagctccgcttgattactgcagggagaaagtggggaccaccccgctgataggagtgggggaaaataaatattctcccgcgcgggcggtgaatttttgtaacagaagacgcccccaccaccataggcgccaatatgtgggggggaaagagtagaagattatgagacgcgccttgttcgtcacaacgctgcgtgtggtgtgtccacaaaaagagtggtgggtggaacatcacacgacgacacacttctattagtttatagagagtaagagggggaaggatatataatatggggacacccctccctcggtgaaaagatttgtctacgacagcacacaccgtcttgggtcgtctgtttgaagagccttctgattagtcgccaagagatgtgatcctcttgtagaatatgagtaggangacgaccacgcctgcgtgggaataaggttgttgtatgagggtgagaactcctgtctcttgtctcctgtgaaaaaaataaggagttgggggaacaaaatagtggcgccacaccacactctcggcacccacaggagcagagagagaaaattgtggggaaatagaaacacacgccggatatacttcacagagatgtgttttccagcacccacacataatgataatgatgggggggagacgcacacgtagtgagtactctccaaaagaaacacacccgagagtgagaaaaaatagagatacccccaaaaacttttgagagcccgtgtgagagagaaagagaatagagatataaaagacgacacacagagataagagaaaaagtgatataaatataagagataccacagagagatatttgtatattacatccatatttggggcgcacaccacacttcacagggttaaaagcacagtcctatactgtttccaccacactaaggggaaggctcttaactcttttgttatagactcggtggcacagtgggggaaaatataggagcacattaacacaaactgaaattgggtgccctgtgcaattttgtgcccacattgtaatactttattgtaaccatgatgggtacccctcatggaccttttaattttcccccccccacccccttttttgggattaaaatttgggaaatgggaatt

SEQ ID NO: 641548 - DNA, 250 bp, Homo sapiens
tgctgggattacaggtgtgagccactgtgcctggccgggattcaccattttaaatgccataaagaacatttgtggttcatgggaagaggtcaaaatatcaacattaacaagagttaagttgattctagccctcacggatgactttgagaggtttaagacttcagtagaggaagtaaactacacgtgcagtggaaataggcagagagtctccggcgaactagttcgacggagactctcctttataaatcat

SEQ ID NO: 641549 - DNA, 429 bp, Homo sapiens
gacaatttcacagtggcagatattagcttgcaaaattttaatcttcgcctaaaagctctcattttttcttaaagtaactgtttcactttgtacatttaaaaaaatcattgtttgggccgggcgcggtggctcacgcgtgtaatcccagcactttgggaggccgaggcgggtggatcatgaggtcaggagatcgagaccatcctggctaacaaggtgaaaccccgtctctactaaaaatacaaaaactagctgggtgtggtgcagggcatggtgctgggcactgtaatcctagctactcgggaggctgaggcagaagaattgcttgaactcgggagacagaggttacagtgagctgagattgcgccactgcactccagccagggcaacagagcgagactctgtctcaaaaaagtcgacgcggccggcaat

SEQ ID NO: 641550 - DNA, 298 bp, Homo sapiens
  misc_feature (235)..(236): n is a, c, g, or t
gggcggacgcgtggggcagaaatgcacgaaggagagagagtgagaagtctctagaaaatgaaacactcaataaggaggaagattgccactctccaagcttctaaacctcccaaatcctgatcagcccctaaagggtaagtgccaggcccgctccaccaaagggaggaattgcttgtggtgcaagcgaagcttctaaccgctccgtgctcggatctcagatgctctagacacaganngcagcagtcccgcttacaagtggtggggcggcaaaagtacgctccagcttcaagccatcgtg

SEQ ID NO: 641551 - DNA, 249 bp, Homo sapiens
atccccagtactgtgagtgcagttcgtagtttgacgtttgctaggcagaatagataatgagcgatgtaagtccgtagggcaattactagaatgactgcgccggattaagcttcagggggcttggatcacgaatggctgttactacatagggctactgtggctcattgaagagtatgcaatgagcgattttaggtctgtctgtcgtacgcagatcgacgcttgttatacttctgcctcatagggatagta

SEQ ID NO: 641552 - DNA, 369 bp, Homo sapiens
ggtgtactgggattgctggtctgacatcaaatgaaggaggagagaaagatgggtgaggcagcaggaataggggcagtcacaggaagcgggggcgggaaggaagatgatgagacctgagcatgtgattccttttcctgcagacagaagcggccagggtgaggagggagataatgcaagagcaatggcagcagaacagcactcatgctgtgaatggcagtgcagtgtcaagcacactgaataccagatcccttatgtattagtccgttctcgcactgttacaaagaaatgcctgagtctgggtaatttaagaagaacagaggtttaattggctcatggttctgcaagctgtacaagaagcatgacagcttc

SEQ ID NO: 641553 - DNA, 329 bp, Homo sapiens
gggtgatctacagatctagctctcaccacccggatagtagctaagcattgcgagacccgtgccgcggtgagcagaaaaattactcgagtcttaaatgaggacgagttgccagcgctgtcggcagagggaggaaggcgagaaagaaacgcaggaagaagaggtgctgtggaggaggtggaatgcagctatgaaatgcaaggccacaacaaaggtgggatggccagagttgtggaagcccaaaagagaagcgtggtctccagaataaagattctcaaaagaccagggtgcccaacttaagctggtgaaatcagactatttggttgcgtggc

SEQ ID NO: 641554 - DNA, 323 bp, Homo sapiens
tggcctcccaaagtgctggattatagcataagccaccatgcctggccaaaacgaagagatatttgaaagagagaaacaattctcattatttagagatgacataatttgttcttcaatagttgtacctaatatgaattacttgtatcagtctgcagtttttatattttatgacaaaattggaattactactctaggacataattgctaactatgaattcactcaaacctcaatgatgtgtgtctaaatgaaaagttatgatagcacaggatgttctagccaatgaaatatgacaagaaaaacacaataaaaggaagagttttta

SEQ ID NO: 641555 - DNA, 384 bp, Homo sapiens
tacaagaagtgactaggtccgtagtcatattcactgtatctttacctctaatgtcacttttcccagtatcccactcttgtgcccggggggaggtcccaaaataaactacctacatgcaaggcccgtgcctcaatatggattttctctcagtaactagaacttaagataggttttttaaaaagtctttaaaagctgggcatggtggctcatgcctgtaatcccagcactttgggaggcgcgaggtgggtggatcacctgaggttgggagttcgagaccagcctggctaacatggtgaaaccccatctctactaaaaattcacaaaaaattagccgggcatggtggcacatgcctgtagtcccagctacttgggaggctgaggcgg

SEQ ID NO: 641556 - DNA, 473 bp, Homo sapiens
  misc_feature (391)..(391): n is a, c, g, or t
  misc_feature (431)..(431): n is a, c, g, or t
  misc_feature (439)..(439): n is a, c, g, or t
taaaaggtgggtcatagtggagctctaagccaggcagagaaatcatacccctcagagtttgaatatgtagaaaacagcttcaaaagctgtgagaagcaacagaaactgaaatctgcttagaaacatacatgattagaattggttatgaaaaactgtgtgacatttgtaaaatgaaaacaaaaggaaactgggtttaagggaattgttttgaaatgtgagttacaagttgtttctggactttgggtggcctagagtggtggctacttcaattttccctcttaggaatagtttttatgggtagaatattccagatccctcttccagtttctgccaggtttgaaaagcactaggggtgggaggccaggggctgtgccaaacaggtttttcccgnagtctttttttgagccgtttgccctgctcttgttggtccntgttggcntgttaaagacacatttcttttccaaaagcaactt

SEQ ID NO: 641557 - DNA, 130 bp, Homo sapiens
gttttggagctgtcgtgactgtgaacgcctgcgctgaggagtacatgcgcgtcagtggggctcatgcatctggctgcactggagtgcctggttcctcttgttctctcctcattacctcctacatacgccg

SEQ ID NO: 641558 - DNA, 1037 bp, Homo sapiens
gcatacgtgcgttatgccaagctgtgaggaccgcttgcgtctgaaagtgagcgtagcaatggatctaatcatgagcagagagtcatcgcacaatcactgggcagaaccggtgaacgggtccggaaatgcgtgacaaatgcccaggagtcatcatcaattccagaaccagcgcaaacaagagtgacatggtcctagtctcagaggacctaagaatgaggtggaaatagatgcagctaaaatacatgtcatgaagcatggtggtcagagtccttggtgtgaagaatacgctattcgaactctctcgtgtggccgaatacttgagtaccagtcttcacaagaatatcatgggcgagaggaggcgcaaagcattgaagagattcgtgcacgaaagcgaaacctaccaaaagagtgcgaatcgtgtccagccagagaatagcaatggcagagaccatgtagtcgatcatcacgcgcgaacgtcgagccaatctgtcgaagctcgcccggagacaggattcttgtctattgagaaagacctgggcaacataagaccgaggtaggaggtctgccatcgcctgccaagctgcgcaactccctcattgggaccaagggccgtctgatccgctccatgcatggaggagtgcggcggggtccacattcactttcgcgtggaaggttcaggacgcgacagcgttgttatcagggggccttcctcggatggtggagaacggcaagaagcagctcctgcatctggcggaggaaagcaaccaagagttcactgttgaattcgcgccagcagatacacgaaattctcatccggaggggggggcagatcgaggggcgaagctgggcagtgtactcccggggtgaggcccggccagaccgtcccccatgggagagacgcggccgagcccaagacgggctctggccaaccggaggtgtggagccccgggggcacaacaaccctccccagcggttagaagaaatgggggccccgggaaacggagggggaaacacaagggggggcagaataacaggaa

SEQ ID NO: 641559 - DNA, 203 bp, Homo sapiens
ttacaaccacgctcaccctgctcacggcttcagcagcacctccatgaactctggggacccgagtggcccacccaccaggatcaccgtgctcaatctcatccagactcatttcaggcactctggagggcctgctgtacaggcccaggaacccgatcaaacaagtctgcacacaactcctcaaattccccacgagccacttcaga

SEQ ID NO: 641560 - DNA, 5812 bp, Homo sapiens
gaggaggagacggcatccagtacagaggggctggacttggacccctgcagcagccctgcacaggagaagcggcatataaagccgcgctgcccgggagccgctcggccacgtccaccggagcatcctgcactgcagggccggtctctcgctccagcagagcctgcgcctttctgactcggtccggaacactgaaaccagtcatcactgcatctttttggcaaaccaggagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcaggggtttgcttcagaacgtccacctagtgtttgaaaactctgtggaagatattctaagcaagaagggttgccagcaaggccagggagctgagatcaacgccatcagtgagaacacagagacgctgcgcctgggtccgcatgtcaccaccgagtacgtgggccccagctcggagaggaggcccgaggtgtgcgaacgctcgtgcgaggagctgggaaacatggtccaggagctctcggggctccacgtcctcgtgaaccagctcagcgagaacctcaagagagtgtcgaatgataaccagtttctctgggagctcattggtggccctcctaagacaaggaacatgtcagcttgctggcaggatggccggttctttgcggaaaatgaaacgtgggtggtggacagctgcaccacgtgtacctgcaagaaatttaaaaccatttgccaccaaatcacctgcccgcctgcaacctgcgccagtccatcctttgtggaaggcgaatgctgcccttcctgcctccactcggtggacggtgaggagggctggtctccgtgggcagagtggacccagtgctccgtgacgtgtggctctgggacccagcagagaggccggtcctgtgacgtcaccagcaacacctgcttggggccctcgatccagacacgggcttgcagtctgagcaagtgtgacacccgcatccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaatcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtggatggctgtttatccaacccctgcttcccgggagcccagtgcagcagcttccccgatgggtcctggtcatgcggcttctgccctgtgggcttcttgggcaatggcacccactgtgaggacctggacgagtgtgccctggtccccgacatctgcttctccaccagcaaggtgcctcgctgtgtcaacactcagcctggcttccactgcctgccctgcccgccccgatacagagggaaccagcccgtcggggtcggcctggaagcagccaagacggaaaagcaagtgtgtgagcccgaaaacccatgcaaggacaagacacacaactgccacaagcacgcggagtgcatctacctgggtcacttcagcgaccccatgtacaagtgcgagtgccagacaggctacgcgggcgacgggctcatctgcggggaggactcggacctggacggctggcccaacctcaatctggtctgcgccaccaacgccacctaccactgcatcaaggataactgcccccatctgccaaattctgggcaggaagactttgacaaggacgggattggcgatgcctgtgatgatgacgatgacaatgacggtgtgaccgatgagaaggacaactgccagctcctcttcaatccccgccaggctgactatgacaaggatgaggttggggaccgctgtgacaactgcccttacgtgcacaaccctgcccagatcgacacagacaacaatggagagggtgacgcctgctccgtggacattgatggggacgatgtcttcaatgaacgagacaattgtccctacgtctacaacactgaccagagggacacggatggtgacggtgtgggggatcactgtgacaactgccccctggtgcacaaccctgaccagaccgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacccagaccaggaggacttggacggtgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggttttgacgagtttgggtctgtggacttcagtggcacattctacgtaaacactgaccgggacgacgactatgctggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgcgaaccttatggcacgaccccaggaacattggctggaaggactacacggcctataggtggcacctgactcacaggcccaagactggctacatcagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcagagatatttaaacaagatttgctgcatttccggcaatgccctgtgcatgccatggtccctagacacctcagttcattgtggtccttgtggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctctacaatgacacacaaatcccgttaaataaattataaacaagggtcaattcaaatttgaagtaatgttttagtaaggagagattagaagacaacaggcatagcaaatgacataagctaccgattaactaatcggaacatgtaaaacagttacaaaaataaacgaactctcctcttgtcctacaatgaaagccctcatgtgcagtagagatgcagtttcatcaaagaacaaacatccttgcaaatgggtgtgacgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagttataaatattttgttaatatttattaagtgactatagaatgcaactccatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaatatataatgttgccagcgattttagttcaatatttgttactgttatctatctgctgtatatggaattcttttaattcaaacgctgaaaacgaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacgatccataactttagtcttaatgtacacattgcattttgataaaattaattttgttgtttcctttgaggttgatcgttgtgttgttgttttgctgcactttttacttttttgcgtgtggagctgtattcccgagaccaacgaagcgttgggatacttcattaaatgtagcgactgtcaacagcgtgcaggttttctgtttctgtgttgtggggtcaaccgtacaatggtgtgggaatgacgatgatgtgaatatttagaatgtaccatattttttgtaaattatttatgtttttctaaacaaatttatcgtataggttgatgaaacgtcatgtgttttgccaaagactgtaaatatttatttatgtgttcacatggtcaaaatttcaccactgaaaccctgcacttagctagaacctcatttttaaagattaacaacaggaaataaattgtaaaaaaggttttctataaaaaaaaa

SEQ ID NO: 641561 - DNA, 450 bp, Homo sapiens
  misc_feature (288)..(288): n is a, c, g, or t
gctgaggtgcgggaatcttgctggggacatggtcatgtggattgtcgtgcgtgagctggggtcctctgtcccaaaacgtatgcgtgtgaaaaagacaggcccagagaaatctgctatactccctgccggggccacaccacctcggtgctgccatgataacggtatctccatgtgtggctattgccctctaagaagaagtcgttgtggtcagagcgctcacgagatacctgcacgtgccgaagtgcagtggtcgcgtcggccaaaggtgccaagcagtttgggttgtcntatgttgcatagcgcattacctggggtcgagctactaggaagcggcgttcaacgcttgtgcatcccataggttccaacggtgcgtcgttccatggcgcatccatcatcgcattgtgtggcatccagatctcttagtgcgacatccagggattgtcaatcgac

SEQ ID NO: 641562 - DNA, 765 bp, Homo sapiens
  misc_feature (654)..(655): n is a, c, g, or t
  misc_feature (668)..(669): n is a, c, g, or t
  misc_feature (671)..(671): n is a, c, g, or t
  misc_feature (676)..(676): n is a, c, g, or t
  misc_feature (682)..(683): n is a, c, g, or t
  misc_feature (694)..(694): n is a, c, g, or t
  misc_feature (697)..(697): n is a, c, g, or t
  misc_feature (703)..(704): n is a, c, g, or t
  misc_feature (712)..(712): n is a, c, g, or t
accaatgcacaccgcttacaggcaaatacccctctaggcggcacagcctgatctctctctgcttcttgtgttagtccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaatcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtgggtgagtgaggggtagaagcaggggcactgaaacccgggcttccattctgatgaaaagcacaaacgctttgggaaactagatgaaaaacacagaaaagaaaaatcaattttagttgcacacgcaaagataactacttttaacatctgtgtttcagtcctcctgtatttctaatgtaaaaacaaaaagatgccaggtggcgtggcctgtggaatgtgggtagttgtgtggnntggaatgtggtgnntnggtanttgtgnngtgtggcctgnggnatgtgnntgttgtgnggcgtggcctgtggaatgtgggcagttcgtgtgcatgtatcgtggactgtgtg

SEQ ID NO: 641563 - DNA, 5520 bp, Homo sapiens
gaggaggagacggcatccagtacagaggggctggacttggacccctgcagcagccctgcacaggagaagcggcatataaagccgcgctgcccgggagccgctcggccacgtccaccggagcatcctgcactgcagggccggtctctcgctccagcagagcctgcgcctttctgactcggtccggaacactgaaaccagtcatcactgcatctttttggcaaaccaggagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcaggggtttgcttcagaacgtccacctagtgtttgaaaactctgtggaagatattctaagcaagaagggttgccagcaaggccagggagctgagatcaacgccatcagtgagaacacagagacgctgcgcctgggtccgcatgtcaccaccgagtacgtgggccccagctcggagaggaggcccgaggtgtgcgaacgctcgtgcgaggagctgggaaacatggtccaggagctctcggggctccacgtcctcgtgaaccagctcagcgagaacctcaagagagtgtcgaatgataaccagtttctctgggagctcattggtggccctcctaagacaaggaacatgtcagcttgctggcaggatggccggttctttgcggaaaatgaaacgtgggtggtggacagctgcaccacgtgtacctgcaagaaatttaaaaccatttgccaccaaatcacctgcccgcctgcaacctgcgccagtccatcctttgtggaaggcgaatgctgcccttcctgcctccactcggtggacggtgaggagggctggtctccgtgggcagagtggacccagtgctccgtgacgtgtggctctgggacccagcagagaggccggtcctgtgacgtcaccagcaacacctgcttggggccctcgatccagacacgggcttgcagtctgagcaagtgtgacacccgcatccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaatcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtggatggctgtttatccaacccctgcttcccgggagcccagtgcagcagcttccccgatgggtcctggtcatgcggcttctgccctgtgggcttcttgggcaatggcacccactgtgaggacctggacgagtgtgccctggtccccgacatctgcttctccaccagcaaggtgcctcgctgtgtcaacactcagcctggcttccactgcctgccctgcccgccccgatacagagggaaccagcccgtcggggtcggcctggaagcagccaagacggaaaagcaagtgtgtgagcccgaaaacccatgcaaggacaagacacacaactgccacaagcacgcggagtgcatctacctgggtcacttcagcgaccccatgtacaagtgcgagtgccagacaggctacgcgggcgacgggctcatctgcggggaggactcggacctggacggctggcccaacctcaatctggtctgcgccaccaacgccacctaccactgcatcaaggataactgcccccatctgccaaattctgggcaggaagactttgacaaggacgggattggcgatgcctgtgatgatgacgatgacaatgacggtgtgaccgatgagaaggacaactgccagctcctcttcaatccccgccaggctgactatgacaaggatgaggttggggaccgctgtgacaactgcccttacgtgcacaaccctgcccagatcgacacagacaacaatggagagggtgacgcctgctccgtggacattgatggggacgatgtcttcaatgaacgagacaattgtccctacgtctacaacactgaccagagggacacggatggtgacggtgtgggggatcactgtgacaactgccccctggtgcacaaccctgaccagaccgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacccagaccaggaggacttggacggtgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggttttgacgagtttgggtctgtggacttcagtggcacattctacgtaaacactgaccgggacgacgactatgctggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgcgaaccttatggcacgaccccaggaacattggctggaaggactacacggcctataggtggcacctgactcacaggcccaagactggctacatcagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcagagatatttaaacaagatttgctgcatttccggcaatgccctgtgcatgccatggtccctagacacctcagttcattgtggtccttgtggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctctacaatgacacacaaatcccgttaaataaattataaacaagggtcaattcaaatttgaagtaatgttttagtaaggagagattagaagacaacaggcatagcaaatgacataagctaccgattaactaatcggaacatgtaaaacagttacaaaaataaacgaactctcctcttgtcctacaatgaaagccctcatgtgcagtagagatgcagtttcatcaaagaacaaacatccttgcaaatgggtgtgacgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagttataaatattttgttaatatttattaagtgactatagaatgcaactccatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaatatataatgttgccagcgattttagttcaatatttgttactgttatctatctgctgtatatggaattcttttaattcaaacgctgaaaacgaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacgatccataactttagtcttaatgtacacattgcattttgataaaattaattttgttgtttcctttgaggttgatcgttgtgttgttgttttgctgcactttttacttttttgcgtgtggagctgtattcccgagaccaacgaagcgttgggatacttcattaaatgtagcgactgtcaacagcg

SEQ ID NO: 641564 - DNA, 107 bp, Homo sapiens
tgtcacgctccacgccaacgcatcagaaacagatacagaggagagaagaaaacagaggtcaaacacttcagttttacagatgtctattccagactaaaatgccaagg

SEQ ID NO: 641565 - DNA, 5610 bp, Homo sapiens
gaggaggagacggcatccagtacagaggggctggacttggacccctgcagcagccctgcacaggagaagcggcatataaagccgcgctgcccgggagccgctcggccacgtccaccggagcatcctgcactgcagggccggtctctcgctccagcagagcctgcgcctttctgactcggtccggaacactgaaaccagtcatcactgcatctttttggcaaaccaggagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcaggggtttgcttcagaacgtccacctagtgtttgaaaactctgtggaagatattctaagcaagaagggttgccagcaaggccagggagctgagatcaacgccatcagtgagaacacagagacgctgcgcctgggtccgcatgtcaccaccgagtacgtgggccccagctcggagaggaggcccgaggtgtgcgaacgctcgtgcgaggagctgggaaacatggtccaggagctctcggggctccacgtcctcgtgaaccagctcagcgagaacctcaagagagtgtcgaatgataaccagtttctctgggagctcattggtggccctcctaagacaaggaacatgtcagcttgctggcaggatggccggttctttgcggaaaatgaaacgtgggtggtggacagctgcaccacgtgtacctgcaagaaatttaaaaccatttgccaccaaatcacctgcccgcctgcaacctgcgccagtccatcctttgtggaaggcgaatgctgcccttcctgcctccactcggtggacggtgaggagggctggtctccgtgggcagagtggacccagtgctccgtgacgtgtggctctgggacccagcagagaggccggtcctgtgacgtcaccagcaacacctgcttggggccctcgatccagacacgggcttgcagtctgagcaagtgtgacacccgcatccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaatcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtggatggctgtttatccaacccctgcttcccgggagcccagtgcagcagcttccccgatgggtcctggtcatgcggcttctgccctgtgggcttcttgggcaatggcacccactgtgaggacctggacgagtgtgccctggtccccgacatctgcttctccaccagcaaggtgcctcgctgtgtcaacactcagcctggcttccactgcctgccctgcccgccccgatacagagggaaccagcccgtcggggtcggcctggaagcagccaagacggaaaagcaagtgtgtgagcccgaaaacccatgcaaggacaagacacacaactgccacaagcacgcggagtgcatctacctgggtcacttcagcgaccccatgtacaagtgcgagtgccagacaggctacgcgggcgacgggctcatctgcggggaggactcggacctggacggctggcccaacctcaatctggtctgcgccaccaacgccacctaccactgcatcaaggataactgcccccatctgccaaattctgggcaggaagactttgacaaggacgggattggcgatgcctgtgatgatgacgatgacaatgacggtgtgaccgatgagaaggacaactgccagctcctcttcaatccccgccaggctgactatgacaaggatgaggttggggaccgctgtgacaactgcccttacgtgcacaaccctgcccagatcgacacagacaacaatggagagggtgacgcctgctccgtggacattgatggggacgatgtcttcaatgaacgagacaattgtccctacgtctacaacactgaccagagggacacggatggtgacggtgtgggggatcactgtgacaactgccccctggtgcacaaccctgaccagaccgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacccagaccaggaggacttggacggtgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggttttgacgagtttgggtctgtggacttcagtggcacattctacgtaaacactgaccgggacgacgactatgctggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgcgaaccttatggcacgaccccaggaacattggctggaaggactacacggcctataggtggcacctgactcacaggcccaagactggctacatcagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcacagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctctacaatgacacacaaatcccgttaaataaattataaacaagggtcaattcaaatttgaagtaatgttttagtaaggagagattagaagacaacaggcatagcaaatgacataagctaccgattaactaatcggaacatgtaaaacagttacaaaaataaacgaactctcctcttgtcctacaatgaaagccctcatgtgcagtagagatgcagtttcatcaaagaacaaacatccttgcaaatgggtgtgacgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagttataaatattttgttaatatttattaagtgactatagaatgcaactccatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaatatataatgttgccagcgattttagttcaatatttgttactgttatctatctgctgtatatggaattcttttaattcaaacgctgaaaacgaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacgatccataactttagtcttaatgtacacattgcattttgataaaattaattttgttgtttcctttgaggttgatcgttgtgttgttgttttgctgcactttttacttttttgcgtgtggagctgtattcccgagaccaacgaagcgttgggatacttcattaaatgtagcgactgtcaacagcgtgcaggttttctgtttctgtgttgtggggtcaaccgtacaatggtgtgggaatgacgatgatgtgaatatttagaatgtaccatattttttgtaaattatttatgtttttctaaacaaatttatcgtataggttgatgaaacgtcatgtgttttgccaaagactgtaaatatttatttatgtgttcacatggtcaaaatttcaccactgaaaccctgcacttagctagaacctcatttttaaagattaacaacaggaaataaattgtaaaaaaggttttctataaaaaaaaa

SEQ ID NO: 641566 - DNA, 2100 bp, Homo sapiens
  misc_feature (23)..(23): n is a, c, g, or t
  misc_feature (39)..(39): n is a, c, g, or t
  misc_feature (41)..(42): n is a, c, g, or t
tttcccagttatgctaattgttnattgctttttttttcntnntggagatatttaaacaagatttgctgcatttccggcaatgccctgtgcatgccatggtccctagacacctcagttcattgtggtccttgtggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctctacaatgacacacaaatcccgttaaataaattataaacaagggtcaattcaaatttgaagtaatgttttagtaaggagagattagaagacaacaggcatagcaaatgacataagctaccgattaactaatcggaacatgtaaaacagttacaaaaataaacgaactctcctcttgtcctacaatgaaagccctcatgtgcagtagagatgcagtttcatcaaagaacaaacatccttgcaaatgggtgtgacgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagttataaatattttgttaatatttattaagtgactatagaatgcaactccatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaatatataatgttgccagcgattttagttcaatatttgttactgttatctatctgctgtatatggaattcttttaattcaaacgctgaaaacgaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacgatccataactttagtcttaatgtacacattgcattttgataaaattaattttgttgtttcctttgaggttgatcgttgtgttgttgttttgctgcactttttacttttttgcgtgtggagctgtattcccgagaccaacgaagcgttgggatacttcattaaatgtagcgactgtcaacagcgtgcaggttttctgtttctgtgttgtggggtcaaccgtacaatggtgtgggaatgacgatgatgtgaatatttagaatgtaccatattttttgtaaattatttatgtttttctaaacaaatttatcgtataggttgatgaaacgtcatgtgttttgccaaagactgtaaatatttatttatgtgttcacatggtcaaaatttcaccactgaaaccctgcacttagctagaacctcatttttaaagattaacaacaggaaataaattgtaaaaaaggttttctataaaaaaaaa

SEQ ID NO: 641567 - DNA, 260 bp, Homo sapiens
gtgcagtcagttctgcaagcgactggacacatcagccgattttaggagtgccttatttttcttcccaataaagcatactcacatcatttccttgctctaagtttggtggttgggtatctaggggtagaattgttgggcagtgtgaaaatattattttgacagaataactattttttgcgaagcttgcttgcacttgtgcttgttgacagaggcctttgtgatcttgggacacgaggagtaccctgcctcacgaatcttga

SEQ ID NO: 641568 - DNA, 554 bp, Homo sapiens
cagttacactaccccattaaaaagtgaacaaaggccgggcacagtggctcacggctataatcccagcactttgggaggccgaggcaggcagatcacaagatcaagagatcgagaccaccctggccaatatggtgaaaccctatctctactgaaaatgcaaaaattagctgggcatggtggtgcacacctgtggtcccagctactcgggaggctgaggcaagagaatcacttgaacccaggaggcggatgttgccgtgagctgagattgcaccatccagcctggcgacagagtgagactccatatcaaaagaaaaaaaaaaaaaaaaaactccattggcttccaaaattttttcctcataatttctgccttcaatttggtcatggatgtggctaattggtaattttcatgtggtatattggctaccaaattgtttataatgattccatatcctggtccctttccaattttaagagaattattaatattttttggcactattattttactgctaagaattccctttttggtgtaaccggatgggggaccctctaga

SEQ ID NO: 641569 - DNA, 1250 bp, Homo sapiens
tctgggacaacagagcgaaaccctggttttcgctcagttttattttttaaaaaggggcaaaagcccaggtgaaagggtgtggtgccccaggaactccctcgcctcccttcccaaggctgaggtgaaaaaggccaccccatctcatctcccattctttaaaaaggctgtggaaaagagaagttcccaactttgtgcagccatttgtgcaaagctctcccggagactcctttcaggctcgtggaggcgggcggggtgtgcggagaccttctcgggaattgtctcacccgtgtgtgagaacattttctcctgtggagaatgtggtggagcctcgtgatctcgtggctccccgtggtgccccacaaaggcccgccgaactcccacatctcagaagccgaacaatattttgcacagagcacaccctgtgtgtgctgtgttatactagacacgcgtgtgctccttatggagagtaagagagaggatgtcacccgcgcgcttggatgcgacatattgaaaaccgagcaccgcatatagggatagaagtgtgtgtccccagggagctccacatctgttgaggagaaaacgagcatactacctctcaacaaggcgccccccgcgtgacaacaagtgtgttggtgggtggtgtacacaccctacttgcagcgcgtgtatatacaatagtgtgaggcaccaacaagatgtagtctatgagggaggaaacaatataatgatgaacggcttataggagaacattgggagggagaatattggagaacagccctcgtggatgattgaatggggcagacataaaaaacatctcccccgtagtgggagggaagttcccaacaatattaatagacaacacccttacctatacataatgtagacttgttgggagcacccactagctaacaccacccatgtgtgggggccccccctttatatgattaccccccccaaagatgacaagtcgcatgagctagtgatggtgtggtgacccccctcctccaccgagaaactgcgacggcgacatacaataggaaagagaactacatcatcgaggggagagaaggtaatgaaccaatataacaaaagcgacgcaccctataaaaggtagttaccgcaccggtgaaggacgggacatatcaaaaaaaaccgagggagtacaaaaccgggagacacacatgataagaggttgggcaacaaaatctacatctgagcaacttaagacacaaaatcacatcgaggacgca

SEQ ID NO: 641570 - DNA, 1074 bp, Homo sapiens
gaggaggagacggcatccagtacagaggggctggacttggacccctgcagcagccctgcacaggagaagcggcatataaagccgcgctgcccgggagccgctcggccacgtccaccggagcatcctgcactgcagggccggtctctcgctccagcagagcctgcgcctttctgactcggtccggaacactgaaaccagtcatcactgcatctttttggcaaaccaggagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcaggggtttgcttcagaacgtccacctagtgtttgaaaactctgtggaagatattctaagcaagaagggttgccagcaaggccagggaggtaggtgtgttgtgaaaaatgcattttatatactggcttggatggatttctattgtgacatggtgtatgtgtgtgtgtgtatgtgtgtgcattcatgcttgtaaaaatttaagtaaaaatatttgggtaact

SEQ ID NO: 641571 - DNA, 755 bp, Homo sapiens
  misc_feature (590)..(590): n is a, c, g, or t
  misc_feature (657)..(657): n is a, c, g, or t
gaggaggagacggcatccagtacagaggggctggacttggacccctgcagcagccctgcacaggagaagcggcatataaagccgcgctgcccgggagccgctcggccacgtccaccggagcatcctgcactgcagggccggtctctcgctccagcagagcctgcgcctttctgactcggtccggaacactgaaaccagtcatcactgcatctttttggcaaaccaggtacgattatttcttaaactcaatcaattatttaatggtgctctaattttaagaaattagagttctcgaactctaagaagcggagaagaaaaggagcatttcgattcttaacttaaggtgggtggtgtatctattaacactaaatggcaagtgtttcttcacgtggtgtttctactgcccgcttgaagagcaaggcacgtggccgctcctcagcttttcctccgtggctgtgctttcaccagccgggcaccccttcctctctgagggttgtggctgctgctatttcaatgtatatacctgcctgggacccgggtaaacgctttatgttttcagtttccgaagaagaagattccacatgagagtntgttattgaggagagaattagaaacaactcccggaatatctgaaaagtaactggagattagagaganactctgattgttaacatcattattagtagattagagagagactctgatcgttaacattattagtagattaaagagagactctgattgttaacattatt

SEQ ID NO: 641572 - DNA, 388 bp, Homo sapiens
atggaaggtgacaaagattctttgcttggccaaactttagtcagactcctcaaccttttcgtaggtttatctgtgcatttccttggaaaatccagttagaaccctctaccctcaatatttgatcaggttcctcatcctctaccatccaaggtgatgtttgatcaccttgacctattttcagcaagaaacccctttactcctgaagttcctttttagtaattttttatccagtgaccccaagctttttgttccttggctataaattcccacttgcccatgctgtatttagagttgagcccactctttttttcctaattcagaatcccattgccatggttgctatacctatcctgatggtccggaataaaatctgtcttactgtgcttta

SEQ ID NO: 641573 - DNA, 1093 bp, Homo sapiens
gtgccaagacttctgtgtgcgtgctgtgctgagtgcgtgctgtgcctgagcgagctggctggactcggggcgcggggagtcgatggcatttgcgctgtggcttctggagctgtagcgccagggcctgatgcctttgaagcaggaggaggcggaggatgagagtggggctcctctatcgggaccccctccccatgtggatctgcccatggcggctggcgtgcggctggcgtgcggatggatgtgctgacctgagaagatacccgccctgcgccccgctctgctgtgggctgctgctggcgctctggctgtgctgctgctgaccccgcgcatgcatttgcagtgtcgagatggctatgaaccctgtgtcaatgaaggaatgtgtgttacctaccacaatggcacaggatactgcaaatgtccagaaggcttcttggcgggaatatcgtcaacatcgagacccctgtgcagaagaagctgctgccagaatggtgggacttgtgtggcccagtgccatgctgggtgaaagccacgtgcctgatgtgcctcaggctttacacggacgaggacttgccagtactcgacatctcatccatgcttggtgtctcgaccttgcctgaatggccggaacatgccatattgctcagccgggatacctatgagtgcacctgtacaggtcgggtctaacaggtaaggatgtgcaatggacccgttgcctagctgtctcattccctgtggccaatggaagtagctgtaccactgtgggcaccagtctcctgcaaatggctacaggctctacaggggcagaagctgtggacggatggctcatgaggtgtgacaatccaaggcagctggcaagcatggttgtaattgctcaacctgctggactccatacagattcagtggcattaagggcatagcaaggcctcgaatgtgagcgtcccttatttgcccgtgagcctcatctggtatacagggactgcctctggtgaaagtgagaaactaatagtgaacgggccacgaataggagatacaaccttgtaaatcgagacggaaaaaagacaactaacaacatgtcaatacgacaaaggagaga

SEQ ID NO: 641574 - DNA, 943 bp, Homo sapiens
  misc_feature (923)..(923): n is a, c, g, or t
gaggaggagacggcatccagtacagaggggctggacttggacccctgcagcagccctgcacaggagaagcggcatataaagccgcgctgcccgggagccgctcggccacgtccaccggagcatcctgcactgcagggccggtctctcgctccagcagagcctgcgcctttctgactcggtccggaacactgaaaccagtcatcactgcatctttttggcaaaccaggagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcagggtacgctctgcagggaggtggccgcctgtgaggggaggaaaagagcttaagctgggaacttgatcntgctaattgcgtctgggtga

SEQ ID NO: 641575 - DNA, 186 bp, Homo sapiens
gacgtccttcatcatacatacctccatcctggcttaccccagagatagcagtcaaaaagtatttagaattaagaaagaactcaactacagccaatgttgttccagcagtggaacatgaaaagatgttgtaggtggggcatttctgagttataatgtacaaatcatgggtaggtatgatgaaggacg

SEQ ID NO: 641576 - DNA, 1026 bp, Homo sapiens
gtataactgtacaaagttggtcgctctactgtcgccaaatgtgagcgagatatccaactatgtcagggggggagtcatattacgaaaatccagaggggtcagatgacagaagttcaaggacgtgaaggtacaccagggatagacgtacacctagtaagcacgtggatacgataaatatgcaggaagagatagtaatgattttttgggttgagtagccgtcgaaggctatgttggaagtcatcagaagtgagagatgtagattgacagccgtatttgacgtgaggattaatgtgtattcaaagggtgtactatcattaaggaatccatatgacagatgactcgaggatcctcatgggcctgtgtctgattcataatgggtagccgagaaatagacagaaagagttcaggtgaaattgtcttggagaatatatctagggtcattatagtgagccgtggcaatacagtcgcagggtgccgatggggataattgtagagcgtaggatcggtgttgaagcgaggaactgcatagcggtgagcgaaagaagcgcttatcgcagaaggaccactgctatggtggccgacgtgtatactgaacatggactcatgtcagtagcaggttgctgtggtggctatttgaagtgcaaaacagctctattgattgcatgattcaaatgcaaggaatgtaggttccataggaagaggatcagtgacgtgcttctatgctaagtggtaatgaaaaaccctctcaaatgaggcgagtagtactaggatgacgcataaatgggcatggacggggaagcaagagaaccaaaaggactctgggtgaatacatgcaagataataacgagagtgatccattgccttggaattttggcatgcgagccgtgaatagaacaatcgtgaggggcttatggaaggataatcctttggtgcttagaagaagatattcaatcaggcattagcaagatgggatgaagaggacccgtagagggtatcgatttgagggaatcaggcaagggtagaaag

SEQ ID NO: 641577 - DNA, 680 bp, Homo sapiens
agtgaaatgaaattgaaataaaatcgaaatgagatgaaatgatgagatgatgaaataaaatgatgaaatgagatgtgatgagatgaaatgatgacatgaaatgatgagatgagatgagatgacatgaaataatgaaatgaaatgatgagataagatgaaaagagttgatgagatgatgagatgaaatggaggatgcaacagcatgaccatgcatgagcatgaaatgtaaatgtatgagatgaaatggaggtgaaatgcaaatttagcatgcaaatgtaatgagatgcaaatgaaatggccataatgcaaatgaaataatgaaatggcagatgcaaataaaataatgacatgcatgaaatactggaccatggaaaatgagctggaaatggattgagataaggaaatgcatgagatggaaatgatgaaatgagatgagataaacatgagatgaactgatgagatgagatgaactctgaggatgaaatgacataatgaatgaactgatgaaaccggaatatgacactggaatgatgagctgagatgcatgagttgaattgcgatgaactgttgaactgtggatgcccggtgcgctgagctgggctgactgacttgcatgttgcctttatggctgcggggtggttgtggtgtgctgggatgcatggatctgtctgctctgttcg

SEQ ID NO: 641578 - DNA, 120 bp, Homo sapiens
atcttagaggatcccccacgatatagatcggagcggtccagcgagtcagcagcttgcggttgatctggctgcgcggatcatcggcatcgggcacttcggccatcagcgcgctgtattgat

SEQ ID NO: 641579 - DNA, 150 bp, Homo sapiens
gagatgaaaaggggccatgagccacctatatttaccttcatatttccactcattaactcttgtgagcggggggcggcgaagcaggttttccttctttccaactcctgctgatggaagataaactgcacactttccctgaacacactgtat

SEQ ID NO: 641580 - DNA, 189 bp, Homo sapiens
ctagctcggtaccccgttggagtatttcgctggctctgtctggggttcgctcatctagatagtagaacatcaaaccaaaaagaaagaacgacacatcatggctacggctgataaacagtactccgaccggcgacgcgccgttgcgagcgaaatagctgaacaggacattgactccgtactagtaacgca

SEQ ID NO: 641581 - DNA, 773 bp, Homo sapiens
tcccttttttctgggaaaagggggtctcgctattttgcccaggcgaggtctcaaactccggggctcaaggctatcctcccgcctcttagcctccctgagagctgggagattacagggctgtagacgccaccggcgccccgggctccttgcaggcgggggcgcttgtgcgcgccgcgatccgggtactgtggcgcctccgggtctggtcccctcgggggggcggagatcctccctcgggagccccctttctgtgcgctagggccccgggcgctgtttccccgttcaagcccctcctctatttaaaggattccctgcaccgtgtcacccagggtcgctgtcccacctttgccgggcgccctcatgggggagacctgggtgttatccccggggcagaagaagactcgaatcctttctcccatctctgggcatccgggcccccttgttggaaagtgcgttagagcgctggagggcgctgtcaccgttctcttccaccttatcgttgtagtcccgtatctcaataaacgagaacctcggcctcccttcccaaaaccaaaaacacaaaggacgaaacacaacccaccacagacaccgcccgcgcgcctctacccggggggccgggcacaaaaacagcgcccgaacgcaacggcgcaggaggagacaactgtgctgcacaccggccgccgaactcgtggacacaagcgggcgataccccgccggcccccccacatagacggcccattatataacggcacacccgcgcgccaccgcacaag

SEQ ID NO: 641582 - DNA, 227 bp, Homo sapiens
tcggactgctctctgccggatgcttttttttctttctgtgcagcccggcccctcctgctctgagctcaccgtggattgctttggtgactgtggtctcatcccacacgagggccttttcctccttcccctgagcatccccactcctgactggcttctcatgtagtggaacagagaggagacgggtggggtggggggtgtgcgcgcatgtcctgtggcatcgataaaca

SEQ ID NO: 641583 - DNA, 388 bp, Homo sapiens
  misc_feature (354)..(354): n is a, c, g, or t
  misc_feature (380)..(380): n is a, c, g, or t
tgcgctcagggccagcgaattcctgctgcaactgtctgaaaccatgcatgagcagagctgccctctggagaagaagacgagcgtcttaccgaatgcccttcacatcttcaacgccatcagagggactccaacaagcacaagggctcacgggacgaccagctcgtcattgggcgagggattacatctcatggcccgtgtgtggggacttgctttgtcatttgcaaactcaggatgctttccaaagccaatcactggcgagaccgagcacagggaggaagagattggaggggagaggggagaagaaagggatggagaggagctgttcaccgggatgcggaaggaactgctcacccncttcggccagcttttatggaactatngaataaga

SEQ ID NO: 641584 - DNA, 169 bp, Homo sapiens
tcattcatgtcataaattataaaatacacaaggtggctgttataaatgacaaaactcaaaacagtacataaaaggggttagtagtcaatggacaaaagtcagtctctagagtagaggcaccaaggagcatcacccaggttgaagggtggatttacctactgcagggcca

SEQ ID NO: 641585 - DNA, 800 bp, Homo sapiens
tggcagggtagtgcctagagtggcaaggagataaagtggtggctggtataatagaatgtagaggggcaagagtaggaacaaagagaccaggtagctgactataacaagtaatacccattgaagcaggtgcatagcgcaagcatagggcatataagggtaggtggccagttggcagctgacagaacaaaggggctagtgtcagggataatatccagagataaagtaacagtagcagtcatagggccataggtagtagataaaacaacgcaagcagccataaactaagcacgtatgcatgacataaagtatttgcacaagcagcaaacttgggtaagcaataggggaaggcccaattctgtaacgaccatagcaaaggcaaagcacgaggggcaaaaagggtccaagcgcaaggagaggtcgcagcggaaggcaagcaacaaaaatcacaataacaatagtattacgagacaccggtaaacagtaacaaagaaggtagccctaaagctagggtcaaccaaaaatgaaaatactggtcaaaaacaaaaataaactaagagaataataaagaaatacataggcagccacagaggaaaacggtcaagagaaattgaaaacataaaggcgtaaaatcacgagcccaagacaggcgtcacccaaagcaaatacaaccccaagagccagaagacttgtagaaatcacgaagccagaacgcaggccctgggacgcttaaatactctaggaaggtaaccaccggatacacataagacggacgagagaatgcgagacggagaaggcaaccg

SEQ ID NO: 641586 - DNA, 289 bp, Homo sapiens
tctagaggacccccagcggcggggagagtaagctggcacaaccgctttggacagcgatgtggcaacctcacataaaggtaaatatctaattagcagacaactaggaattccacttctaggcatctgcacaagagaagggaaagcacatgttcacaaagagacttgtacatgaatgcttaaaggagctttattcataataggcctcaaatggaaacaattcagatgttcatcaacaggggaacagataagcaaatagtaacttattcatgccgcccagaatgggggaccg

SEQ ID NO: 641587 - DNA, 242 bp, Homo sapiens
tcctcccaagggtgcccgagaacactccatcgtcgcggaatgcccgcgcttctttcgttaaagctgtctttgagtttgcctcctctggtggtataagttaattccacaagaaaagacccgtcccttaggagtttcaaagaaccgtgagcctcccgtttttacgccctaccggctcacgctcttggaaacgacgaaagcgttgcctgtttgtcaagaatcctaaggtttatcactgaagaacg

SEQ ID NO: 641588 - DNA, 291 bp, Homo sapiens
tacctacatacattatatgtatttagctgcaccagtaaatggaccattaactagggcccactttaacagagcacccctttgaaagtttataggtatgaaatatatgtagatatttgtaaagggtttaattttttttttttggagggggtgcggtgtaaatctggtatttataaatgtaatgaaggtatggacagaaataaatatatacaacttttataaaggatggtgtactgacggaatacatttaaaagaaaatatatttggaaaccggtccggctaatgtaagagata

SEQ ID NO: 641589 - DNA, 377 bp, Homo sapiens
gcgggttccagcagccattctggtcagattacactcctgcttaccagacgacaagtcggttgttcctggtcattcgagtactgtccatcggcgggtgacctgatgttccacatgcagagcgcagaggtaagctccctgaccgagcacgccaggttctacgcggcccgaagatctgcatcgccctcgacttcctgtcacgtagagggggcatcatctacagggacctgaagctggtacaacgtcctcctgcatgcggacgggcacatcaagctcacaggactatggtatgtgcaatgaacggtctgggtccatgcctgatacatacgagcaggtttctgtggaagccctaattccatcgtaccccgcgcccggattaa

SEQ ID NO: 641590 - DNA, 137 bp, Homo sapiens
tctctactcaggtgtgcaatatatatttgttttctctgtgtgctgcgcggcgcctgctgctgctgatgctgcttctgcttctgctgctgctgctgctgctgcagctgtgctgctgctgctgctgccgctgctcgcta

SEQ ID NO: 641591 - DNA, 443 bp, Homo sapiens
ccgggaaattcggcctttatggccggaaccagagtttttggttatggaagttgggaaaaccacccttattttaaaatctgattctgagaaggagaaggcttggtttaataagttaagcccatttaatccgggaaatattccttaatttaagcatggttccatattggatggaaggctttaatttggttaccagagcaaattggattaattccttgattaaccggttggattacctggttactaagggcaggattaggaggtaccagattctttcttataaggggcctggttctgatccttaattcggaatgggactattaatttaccattggttatttaattggggggccttaattggagggtttttaatggaaaagccttctaatatctgaggatggaataaatccaatcccttacttgccaattcaatcttccttgttgaa

SEQ ID NO: 641592 - DNA, 98 bp, Homo sapiens
aaaagccaatgacaatcaattagccaaaaagttttgaacgatttctaaactttatggaaaaagccaatgacaatcaattagccaaaaagtttagaaat

SEQ ID NO: 641593 - DNA, 330 bp, Homo sapiens
catctcttccaacactcttcactatggaatggtagatctccactgtggagtctctcatgttgcacaagacatggggaccgattaaagctcttcccacattccttacatttatatggttactctccagctatgaatcctgcgatgctgtgcaaggtgtgacatataatggaagaccttgccacatacattatttttatgtggcttctctccagtatgaatactgtgatgacatgcaaggtacgacttcaaatcgaagatcttggcacatatatcacatttaaatcgcgcctctatagctatggattattcgatgtatagtaaaatgtacag

SEQ ID NO: 641594 - DNA, 108 bp, Homo sapiens
atcagagagtatgaagattgtattaatcatctcaagtacgattgtttacctccctcgtgttccccatgttaatgttgatgttgtgtctgctgagaaagtgtacataat

SEQ ID NO: 641595 - DNA, 697 bp, Homo sapiens
ccgtggctgtgggtggggcgcggtggcggtggcgcggagccacggcaggatctggagccgggcccgtggctgtgccggcgtctgaacgcagcgaatggccggagcaggatggaaccaggtgaggagctggaagaggagggctctccagtgtggccgtgaggatggcttcatccgtcgagcacctggctgcagaggccatggcagttgacatggacccctggctagtgtttgatgcccgaacaactgcctgccacatgatgctggatgcctggtcgtggccaatgtacctcatccatcccgaagttacccgctatggtggaccctcggttcacccaagctcagagcctgtgggcttggattgcatgtgtatgggcagggctacatgtcccaaactctcggggacgtgcatgggcctgcatgcatgcctgggaagctctgcagaccagtgggctggccatcacaccgggtaccctgttgccagctcgccatcgaccaccacgttgctctcgggcaagtggcttatgcatctggcaccggtgcttcaagctggaccactgcctggggcctgggcatttgcctggcgccgtcggttgaagtgccggctttcaggttggccaaggttggcccccggtgccaaggaggggtgggcgccatgtccatctgtgttacccggacgatcccggccgttgggtgtctg

SEQ ID NO: 641596 - DNA, 928 bp, Homo sapiens
  misc_feature (196)..(196): n is a, c, g, or t
taattgaaacggagcctcactgtgttgcccaggttggagtgcagtggtgcaatctcagttcactccaacctctgccacccgggttcaagcgattctcctgcctcagtttcctgagtagctgggattacaggcacctgccaccgtgcccggcttaattttggtattattatagtagagataggtttcaccatcttgncccaggctggttttgaactcctgcaccttgtgatccacccgcctcggcctcccaaagtgcggggatcacaggcgtgagccaccgcgttgtggccataaatctgacatcttctaaaggacagtttccatggtgagattaggggcttaacagcccatgaggtcatatacacatgaacgtatctataccattaaagcaatacaccactcggcgcttctgataaacaatagccaggaggaagagtctcctgacatctactgtcgactaccgggagtctagcccacattggtcacaaaacaaaacgaacaacttcacgcggcaccacattttcgcgcggacaactctagcaagaaacaacttgccagtgagcgccctcgacacaacagcggaccaaacacttaggacgacaactcaaacgcaccacttagtgggggggccacggggggacacaaccgtataagcaccggacacgatgggggaagcagacggggcggaacactactggacccccactaatacagaatgtgccgcgggacacacgtggagaaccccgggtcactctaacaacaaaaaacaagaggggggccgcatatagatcgcagcaggcccacgaaccggggtagcgcctgcgcaagcgggcagccaagtgaacaaaacccagcccgcccgccaaagcagcagactgacagacggcaattgccagcacccagtcaggtacatggcaccacaacaaag

SEQ ID NO: 641597 - DNA, 644 bp, Homo sapiens
aactaaaatacttttttaattaaaaaaaatggacacacatacagcacacacacacacacaccctttaaagctaaaaggccttcccaggattcactaatagaacaccagactggcctccaattctaatctgactctgggaggtgaagagttgggtttgcacctgttttcaggcaccctatgcaccaatgtggccaatgggtgttcaaacctgccagagtctttctgaaaatgcagcctttccctgactgcgagttaaacatcctgagacagagtgtggaaggcgtattatttatgctggcccatgaacagctgaagcagagttgagtgtgacaaggaataactgccgaaacaggcaactgaaccaatgttttcatgaccccctattggaagactccagggccgatgtcaagcggaacaacgtgacacgaatggtgtccgtgccccagacaacagcaggtgccatcctggacagggtgaacattggctgaggctatggcctggtggaaggacaccccaggaggcagtttgagaccaccagtgactccgaggatgtctggtacatcctgcaatttgactatagcaggctccccaaacaaaggatcgggcatttccacgagggggatgcctatgtggacaagtggaaa

SEQ ID NO: 641598 - DNA, 608 bp, Homo sapiens
  misc_feature (593)..(593): n is a, c, g, or t
gaagaagtcttttgtacgccgttagggcacgttcccccacccccccaggttaaaataggcgttcaaacccatccttaacattggagtcgcgttctctttgacttggttctagggcaccccggtggacgttgtcccccactccccaatttgcccccttgtggcgagggaatagaagcccacaaactggcgtcaatacatgcggtcctttcacacagttaataggtttcccggaggcccttctttcttggcgcagaatataaaaggggcaggacccacaactgattcagtccctctttgaataagggagtctctgtagtagcgttctatttaggacacacacgcatgtgcatactcgatgccactccattatggaacagaggagaattttccgccttctcggtgttcccggagcggggcgatatttcagatcatttcagtgggttccccacgggggatacacttgtgcgtagactacggctgatacacccggaagaggacagatttctattgatatgattcatataacggtaagtaaggagcacctctatttctatatacgcccaaataaacatgttttccacacgccccatcantagaccaaacaaata

SEQ ID NO: 641599 - DNA, 461 bp, Homo sapiens
  misc_feature (1)..(1): n is a, c, g, or t
  misc_feature (14)..(14): n is a, c, g, or t
  misc_feature (34)..(34): n is a, c, g, or t
  misc_feature (75)..(75): n is a, c, g, or t
  misc_feature (151)..(151): n is a, c, g, or t
  misc_feature (328)..(328): n is a, c, g, or t
  misc_feature (332)..(332): n is a, c, g, or t
  misc_feature (354)..(354): n is a, c, g, or t
nagaggctgtttcnggtccccttcccaagacccnaatctggcacagagcagatgctagttcaagtctatcaaatnactgaatgatgagggcaataatgctgttggctatgctagatatcctcccagattgctttcagaatccagatctaancccggctttctaatccttcagcagttccctcttacccacaaaaggaagtctaagcttccgagcctgcctgtagggcaccttcacatagtgcactggtccaccttcccagcttcctcttctgctcttcccagcaccaatcctatccaagctcgtgttcacatctgaaatatgaaagtncctngctgccgggtacagtggctcanacctgtaatcccagcactttggcgctgaggcgggcagatcacctgaggtccggagttcgagaccagcctggccaataaggtgaaaccccatttctactaaaaataca

SEQ ID NO: 641600 - DNA, 143 bp, Homo sapiens
ttaaggctggaacctgctcccgccatgtcatcagtgctgtacactgcctggagtgccttcttggtgttagtccctgagttcaccttgtgatcttcataattgatttcattgagctgcttcgtgaaccagtcagcatttaacca

SEQ ID NO: 641601 - DNA, 485 bp, Homo sapiens
agagaaatcaggctgggacggagggtggcccttgctttgcacgattcctgcctcgacgttacaccagggacattccagcatctccccttcattaactgtagaccgccagcaaatccagatttcattcaaccaagtaaactggtagagtcatttccagcagctaatgtgagctagcgcattaaattcagaatctctagtaagtgtacctgcatcaataaagccaagccggtccagctgcattaataccctaccctccattcccacacggttcccaggtctccgtgtgtgaatttgtaacatcttacgagcattttggtgtgaaagtggttccttcctgagtcaggctttgtacttgacccttcccctccctgggagtacactgaggttctagaggcaacagggtggctatggtggttaaataaaatgagcatcatttctaggcacctggccaggtaagcttatcacagcattttcaagcagaacaa

SEQ ID NO: 641602 - DNA, 219 bp, Homo sapiens
caggaggattttagaggatccccgacaaactaccagtgacgacttaacttagatattattgtgtataccagggttatttgttaatcgggtggtgatggcacgatgaatggcaaacacacacacatacacgcacacatgcacgcgcacacacacagacacatttaataaattatgcatgtattccataaaaatattttttcttggcttcattccagggag

SEQ ID NO: 641603 - DNA, 501 bp, Homo sapiens
tgctctttgcctcctataagtggaatgtatcccggccctcattgctggctgactccaaggatgtgatggacagcaccaccacccagaaatactggattgacatccatttgcgctggggggactatgattcccacgacattgagcgctacgcccgggccaagttcctggactacaccaccgacaacatgagtatctacccttcgcccacaggtgtactcatcgccattgacctggcctataactcgcacagtgcctatggaaactggttcccaggcagcaagcctatcatacaacaggccatggccaagatcatgaaggcaaaccctgccctgtatgtgttaccatgaacggatccgcaaggggctacagctttattgatctgaaccgactgagcctaatttgtcttttgagaactatggtgagcttcttttccaacccgatcatcttggtttgtggattacaccaacgtttacaaagtgactattcacaatacccttgaag

SEQ ID NO: 641604 - DNA, 203 bp, Homo sapiens
caggtggatcacctgaggtcaggagttcaagaccatcttgaccagcatggtgaaaccctgtctctactaaaaaaaaaaaaaaaaaaaaaaaaaaaaaaaaacccccccccccccccccaaattttcccgggggggggggaaggccccttttacccccaatttttgggggggctgggggaaaaaccctttacccctgggggggg

SEQ ID NO: 641605 - DNA, 759 bp, Homo sapiens
  misc_feature (1)..(1): n is a, c, g, or t
  misc_feature (176)..(176): n is a, c, g, or t
  misc_feature (233)..(233): n is a, c, g, or t
naaacgtccaacaacgtttaaatataaacaggcgcgcgcgggtgtcccaaaggggtgaaaatcgcaagcccccctctcgggcttgtgacatagtgatagcgccacgaggtcctcctctctcgccacagggagccacacctgggagaacccacaggaggtagccggtctgtttgcanaagtcgggccccccctggtgcagccacaagcttgtcgctctaataggtatagaaagnaaaaattcgtcgcctgtatgtaacaccgccgtgactcccaccggggaggcttataggcaaatggcgttccaaaaaaatgtgtggggcctcctcccgcgcttgccacatatctccacgcgctctatatctgtcttctcgagagatcggtccagccgccaccagcgctacctatcttgcccccccggtgtagtagaaacgaggtgtaacatctcgattatgtaacaattagtgttacatttcctccggctgccagcacccccgctgctaagagacccgcagcaatcaaatggtgtggtccgcccactatacgccaagtaatgtggtgagcgcccctttatgtcttcatagcacatctgtctcaaagctcccacattactccctgcggccaaggatgtgacctatgagaaccggtttaacttgcgagatcccgccttggttccttctaggcgcgggttcacccaaagagccgtcgccccagcaacactggtgttccaggcgtcaatcaatgttagttcctatggagaca

SEQ ID NO: 641606 - DNA, 848 bp, Homo sapiens
  misc_feature (717)..(717): n is a, c, g, or t
aggctaattgatgatatcgacgtgaggttccagatagcagccagtggcaccactgggtacctaccaatgagtggagatggacaatggtcccaggaatctagtatccagggataactagtttgacatcaaggaatgggccagatgccaggtgtcgcagggactcaacggataacagatgttggagtggacttggatgaccgagttaactcagagacatttctcatatggagaaagctcaacgcgatctgagtgttgaactcgactcagtatagagtcttctcatgacacttgtcacccgaggaattccagattgtgcacagagtgggaaatccctgggaagtatccaatctaggggatggatacactcttgacatctagtgcttcattaaggcgagggttaggggaccgggattaccttggttgcccgaagggttaagttgatttccgaaagaaggctcccgatgactggtgttccacgaaactagtgccctgggtgttatacgcatacatttgtacacaagggacacccttaggctgtaatatgagctacgcttcgcattcttgcggacatgtctaacaccgggagatagctacttagatagcttacactaggcaataggtaggacttcgtgcgtgactggttattaggcgaacacctgttctggagacgggaactttttcagtccaagacaacgtataggcccctaacggaagggnttactttttccacgcaggcccgattatctagattctgcctgcaaaagaatcccacgcgcgatgggctggcatgatggtgaaatacttttccagagaacacattctgtaccaacttccgattatgcgcgaac

SEQ ID NO: 641607 - DNA, 442 bp, Homo sapiens
  misc_feature (30)..(30): n is a, c, g, or t
atgtcaattgtctttctaacatctatgatncaagcagagtacttataaaaattcaaatatatccttctgtcctgccctgcccaccattatctagaggggaaaactcagctgggataggatgtatttatggatgcctgtttatatgacatgtgattttaaaggactgataaaaaggcaaatttaaacagaggccattttacttaagaaaaccagttgcatctcattcttccttttgcaaagcttctggcagctcttcagtgtgtaagctcacccaggctcgctgggcggttgtctgggaggagcaggaagggcttaaaatccagtcatttacaaagctgctaatgatcttgtttgtgcactgtggtttggccatcattgccttattttgaagaaaggaaaaaattatcacataataaaccaataaagcagatattaaatattc

SEQ ID NO: 641608 - DNA, 421 bp, Homo sapiens
tggttctcaatgctctcatcgtctgatcagtagcccacgttttatacgtgtctccagttcctcgatgtataccctgagaacatcgatggtacctacttcatagggtcctggtgaaatgaacattcattggttgtgtgtaaatttgttgaaacggtgcctggcacatggtgactcaataatcctgtgcatattcagttattgctgttcacttggttcagcgtatgtaatgcattcattttcaaaaacaaccaacattagccagacatggtggcgcatgtctgtaatcctagctccttgggcaggctgaggtggcaggattgcttgagcccaggagtacacggctccagtgagccattgcagcatttcactgcagtgagcatcctggccagccagagtgaaaccccgtctctcatcaaaaaca

SEQ ID NO: 641609 - DNA, 340 bp, Homo sapiens
taattaagaaaaaaacagttaagggagcagagtggaaaacgacttgcaggtaacttaagactatctggaataaggaatgaatcaagctgaccttgggccagcaggttttaaactaaacttgttacttgcctttctcacgtcagttgatctgtcactgtacttatctaccctctgtagaaacaagtgttcttggtacactaattctgttatatggttctgctaaatttcttatgctggtgccttattctttgcttttagtcagaccattccatatcagacttttctcttggtttactatagatatttggcatttagtgcgttgtgtgtgtgtttgagtgta

SEQ ID NO: 641610 - DNA, 160 bp, Homo sapiens
  misc_feature (10)..(10): n is a, c, g, or t
ttacacaggncaggtcttatctcttcatacattgacagacccagatcctcatgcctgtaacagattcctacctcctcagacatgaagagactcagatccacatacctgtactagatttgtacctcctcagatattgaaagacccatatccccaaatcagg

SEQ ID NO: 641611 - DNA, 621 bp, Homo sapiens
  misc_feature (39)..(39): n is a, c, g, or t
atgagtctcccttttatgtttatacacaagaaacaaganttggtaaatatgcacatccctgtctgaaagcgcttaagtaacagggcaattattagaattcaaagccactactcacaacagtaaacacgcgtgcgcatggatatgttcagaaagagtcattccccaattcactttattcaagcgctgatatcaagaggcggaatgcctaacagcatctattgaatttcagtctggatgatgtctttcggccctcgttttaataacccagatgttcaggcattcgctccacccatgccaggtgtaccagacatgccagttgtctgttttatccgtgtaggggccactgtagtatgcaccattcaggtctgcagagtgtctcttgttaaccccgcaccaagagtgttcttattctgcgcagttccatcaatagttgtcatgatctgtgtcccaagccataaattccttcagttggtgattagcccccctgggcacgtgagtatgaagctcccccgcaagggattgtccaggtgttcgagaatcttccccaatatgtgtctagaagaatgtatgtaaatcaaaagctttgaaattcttatattgtgcatcgcggtttttttctcc

SEQ ID NO: 641612 - DNA, 992 bp, Homo sapiens
gggaaataggagcgagcggcacgcgccggaaaggaggcaagagcgcgggcggggaggcaagatggggcaaccaagaggaaacgggtggaggctttcggaaggtacaggcgaagacgccaaaaaagaaacgaaatagatgcggagccggccagattaaggggcacgccaccagccagaagggaggtggacggcacggcactgagcagcgggccccggactccccaagggcccccggttgtgcaactggggaccacgggtggccacaaacttagggcaaccgggattcataaatctttttcttcccaggaggacatcaaattttttagaaccaaacgactatttacagtgcgcgccactttgcagacccttggtgcatgcctcaattacttaaaggcagatacttaaaacagtgggatccggaagggtaatcacgccctactttgtgtggaataaacgcgagggtttgtggtgaaacatggaaagaaagtgtaaaatacacgtggcattctaatttgggaaaggcctaaaggaaacagacggggggactctcctaatattggtgggcttaccagaatttcacacctcttcccaggggaacccaattgttgattaaaatttctctgtggtcccaaaaatatttcatactctttcgactgaaaggggaaagtaatgactgggcacaccaacttggtcgtgaagagcgttctacgggccccattttgtgttctatgtgaccccgtgctttctgcattgaaatttcacccacattactgcttggggtaacacgcaacctcttaattcaagatcttagtaacaccagggttatctatcccaaaaagggcaaccctttgtggtggcccacgtgtgttcctttccaccaattgtggcacactacgacatacgggtccgggcacttcacagactacttacaagagacttcggtcgtgacagaacaggcctcggtgtgcttaactctcaaaaagattccagga

SEQ ID NO: 641613 - DNA, 482 bp, Homo sapiens
tggaggggggctgctcgtgacttccgacctctgtctcgctagttggcatgagaagactggactccttctgcaggcctcagggcagaggcagatgtcagcccccagggatgtcactgccagaaccccagatgccccaagccatctggactccccctgtgcagtatctctgctacaataaaatgtacccagatctgagtcctctcacctgggcgactgccaatgtcccctgcggccctataccccgcccccaggagcccagaggatctttctttttaaagatattcagacctcacagataagtctgccctgaccagcccctccccagttcccaggccctatcctgacaacggccacaacttcagagcagctgaaacctgctgtgagtgaaaaatgagaagctgttgttttaattttactttctctgattactaatgaggttatttcttctctgcataaaaacttcattcgtgtttaaaaaaaaa

SEQ ID NO: 641614 - DNA, 458 bp, Homo sapiens
  misc_feature (354)..(354): n is a, c, g, or t
  misc_feature (362)..(362): n is a, c, g, or t
  misc_feature (381)..(381): n is a, c, g, or t
  misc_feature (403)..(403): n is a, c, g, or t
  misc_feature (416)..(416): n is a, c, g, or t
  misc_feature (435)..(435): n is a, c, g, or t
  misc_feature (450)..(450): n is a, c, g, or t
aactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccaggaatacctgcagggcagcttttccttaagcccaaatggggacttntcaattantttgattcttattctgagntcactgccggtcaaatcaacanccttgtgaacttntaatcggatgggtggatgnacatctgtttaaagnacatgggc

SEQ ID NO: 641615 - DNA, 133 bp, Homo sapiens
tgaggactgtgaggacgagagctagcagacgcacttaggtgctcatagctctgcctgctggaggaggaggtggtggtgtactagatggtggaactgccgcctccaacagagatgaggccacccccaaatggct

SEQ ID NO: 641616 - DNA, 558 bp, Homo sapiens
tagccctccttatgtactgtctacgagctcttattatccatatgcagatcagtcaccatgcagaggaaagcagagagatacagccttcccatagtgaagctcaagggccaagtacttattaataactagggactcaatttttttctaggccacgagaggtcagttcaactatgcatattccaacaatactcctattgatggtcgatgacataatgacagcatccttctatggccacagcaaagtcattttggcatggctccagaccccccatggcgtccttttttgtggataacttactgtgaaagcatggcagaatccgcgggaacacagcgggtcacgtggactttgcctcccctgctgagcacaggggacagattcttggacccagaaaagcatacagcttgtgctaatacggctaattgtcctatgtaatcgaaaccagtttcaatgacagcttgctagagaagtaaataggcccttctgcaggattccttaaagagttttcacatttttttctatatgttgaaccagttagacaactcaagggtaacggagct

SEQ ID NO: 641617 - DNA, 890 bp, Homo sapiens
atcgcaatggcgttcctaatggcttaccgaacgaaaaattctaggctatatacgactacgcaagaggccccaaggtggtaggcccctagcgggctactacaacccttcgctgatcgccatagaaactcttcaccaaagagcccctaaaatccggcgcctagcgatctaccatcaccctcataccatcagccgtccccgaccgttaggcgtctcaccaatcgcatcttctacgtatgaactccccgctcacgcatagtacccaaaaccgccgcgtggtcaaccactctgatcgtaggcactccgtatatatgcgtaagcgcagctctagacctacatgctatgtacatcaggtctgcctagatcatggattggagcgctctcaagcttctacagaactgaagtcactgatccgtgtggactacgtgcggagactacgatacagcgcccacacaatacagtcctacaatatcgatacggtactagcacgcctaagggcacgactacgactatgcatgaccatgaataccgacatcaagtaagaacctcacacttatagtgggcctcactcttacacactgctactcggcctgattgacacagacaagaagatctctgattggctcctcgccataatgacccgtggacataaggacgcatttatccttctattatttactcacaagaaccaatccgcatgacccccttgcgagcattggccgaaacgcggaggccgaaaatgtcgctctcacggcatgcgtaacatcgactttacgtgcgggggggcccccttctgcccgtgattctgtcatgcgcccgagagtaggccccaatccagttgtgatcctcaaaagatgcttcagggaatacaaacgagtcttaggaaccggatc

SEQ ID NO: 641618 - DNA, 154 bp, Homo sapiens
agggtgtgaacttctatacgtcatcatgcgcgcctgttcgaggagctcaatgctgacctctttcgcgggacctggagccggtggagaaggcgctgcgtgatgccaatgctggacgagggccagatccaggagatcgtgctggtgggcggctcca

SEQ ID NO: 641619 - DNA, 510 bp, Homo sapiens
  misc_feature (104)..(104): n is a, c, g, or t
cctatgatattcagttcccctgttctggtcagcgtccggccatctaaagggctgatggataaggtgctgtccagggctttgcctttgacctccacggattttcngatcccggtttgcttcagggttaactagcgctcctttccgtaaccccgggaggcccggccgaaatgttcccgaagacaggagtccatggagattttcgattcttcctgtggcccctccagcatggcccctttcccttttgtggattttaagtccctgcccctcagatcagctttgctccttaaattgcctcccaaaaaaaaaaaaaggggatggtggctgcgtggttcccaaggcttccgaccctttggaaggaagagcccctcccctgcccagccccctggccctttgggccattactttttggcccgtgggcctcccgttaacagcccccttccaggccccggcgccggcaaaaaaaaaatggtgctgtccttaaattaaatttccccctagcttcctggggga

SEQ ID NO: 641620 - DNA, 493 bp, Homo sapiens
  misc_feature (378)..(378): n is a, c, g, or t
tttttactcttagagcgactgcagataccatttcggtacaatcaaaacggttttagcaagacagatgaaaacacattacaaaattgccccaagaggtgagcaaactggtgggggcacagagcacgcaagaaccagcctgactaaaatcctaatgcctgctgctgtttaggcgtgagtacaagagactgtggttccaaggagaagccatctgtgtgtggggttcagggcgagacagtcgacgggtctgcccagtcgcatacgcaatcccacgctgcggaactagaggaagtgacaggggttacgggaaagaggggcagagagcatcttgctagagctccctgacgagaaaccatttacatgagtcagccttatcacatntcctcttcacttacaatcaacacctaatatataatgcatagagattctcttaaacatagaacacataaatggtaccaccaataagaagagcaagagtatctcaaacactaacagc

SEQ ID NO: 641621 - DNA, 931 bp, Homo sapiens
aagcgcaagcataagaaggatgtcagtgaggctgggcatggtggctcccacctgtaatcccagcactttgggaagccgaggagggcggatcccaaggtcaggggtttgagatcagcctggccaacatggtgaaaccccatctctactaaaaatacaaaagttagctgggtgtggtggcatgtgcctgtagtcccagctacttgggaggctgaggcaggagaatcgcttgaacccgggaggtggagcttgcagtgagctaacaccactgcactccggtctgggcaacagaccaagactccatctcaaaaaaaaaaaaacaccacacgaggggtggtccaccggacgaacaaaaagaagctattctcaccgcaatcactgtgggttgtgcgacgtgggtgggaacgggtaatacctctcttcttccaaggacaccacgggcgggtatcgcgagatggtcctctctatagaagaaatccgatttcttatacctcccaattcacaagcggccctgatttgcagcgacctggccctggaagaactggatttggccaagggaccaatccagaccccggtagaaggaaagccgtgcgagaaggccaaatctagaaccaggtcacaggactccatgaattattggaccgggggggaccaaaataatatgcccaaatttaaaaagttatcaaagaattcttcagggggaacacgaccttggattagagggctcacccctatgagagctggtggctaaagggccacagctgtcacggagccccccattttggacgaagttcggacatggtccaaattaggtttgcgggatgccacctctttctggagttgaaccgagctcagagtcagactgtccccttaagcagaataccttctcacacgcacagcattcgccttgtgaccaccgtgcgtcaggatcagg

SEQ ID NO: 641622 - DNA, 273 bp, Homo sapiens
atctcccagttctgacgtgctgattcccttttactcatgctgacatataccctcccccacacaggcacagcctccctcatcatcagcatcccccaccagagtggtatgtttgttacagttgatgagccgacattgacacatcatcacctaaagtccatagtttacactagggttctctcttggtgttgtacatgctgtgggtttggacaaatgtataatgacatgtattcactattatggtgtcatacagaataatttctgtgcccatttcaa

SEQ ID NO: 641623 - DNA, 395 bp, Homo sapiens
ggaacaactcgatcatcatccatatgctcctacacacaaacaaaacatataaacctcatacttaaaaaacacttacaatagatcataaatctaaatgttaacatgtcaactaatcaaacatttagaagaaaacaaaggagaattaggacctaggactagactatagttatctaagacatgacaaaaaaatcacacactactacaacactttaattaattggacttcatcaaattaaaatatatgtacactgaacaacactggtaagtaaacaaaacgacaagctgggctaggacatggcggcatcatgcctacaatctcagcatttagggaggccaaggcaagaaggatcacttcaggccaggagttcgagaccagcctggccaccgtacgcaag

SEQ ID NO: 641624 - DNA, 711 bp, Homo sapiens
agtccgggggagcggcgctgccgtgtggagatccgcgtgagggcgacaggattcgttggcgtgggtccccgctgctgtgcattgggttaaagaacgacaagccaacatcagccatgaaagatccaagtcgcagagtactagcccaagcatcatcaatgaagatgtgattattaacggtcattctcatgaagatgacaatccatttgcagagtacatgtggatggaagatagtgcaaggaagagattcaagagagaaatagaagaggcagttatgggcaagaagagaatttattgaacgctgtttccaagaaatgctgggagagggacgaagagcgatgaagtggtttattccgagcgtcgagatctccgcgaagaatatggaccaaatccgaagaccagtttaatgaccttgtcatcagtgatggctcttctctggaagatcttgtggtcaacgagcaatctgaatccaaatgcaaacggagtttgttcctggggtgaagtacggaaagtatttgagtacgacggggccctcttttggtggatgtagcacgaattatccacacgtgtggaaggggagtgataagaacgacttaattgtaaagagctctctgtgtcacgtgtgttacacttatgcattgacaaaaggtttcgtgagtcttgcaatggtgtaggtaaaagtggtgagacgtgtgtactaagtacataatgaag

SEQ ID NO: 641625 - DNA, 162 bp, Homo sapiens
ttttcccccccctttttgaattttttttgaaacctgggggtaaaccctaaaaaggggttcccctttttttttggacccccggtcccctttttccaggggggaaaaaaagggggaaaaaagccccccccttttttttggggaacccctaaaattgttttccca

SEQ ID NO: 641626 - DNA, 179 bp, Homo sapiens
  misc_feature (84)..(84): n is a, c, g, or t
cggcggccgagtccagcgggctcggggccaggcctgtgcgtgcgggcgcgcctcctcctccgcgccgtccccatgctcgccctncgcgtcgctctcgtccgagttgtcctcctccaagtacggtaaccgtccaccttgtgctggggccgcgggattgcgggtgcgtagcggcccacgcc

SEQ ID NO: 641627 - DNA, 261 bp, Homo sapiens
gtacacgtgcatggggtcctcccgggtcaatgcaactctccgtgggattcagcctcccacgtagcttggactacaggtgcgtgccaccgagcccagctacttgtcgtatattgcgtatagacggggtttcacaatattggacaggatgatctcgatctcttgacctcgtgatccgcctgcttcggactcccaaatgtgcttgggattacaggtgtgagccactggtgcctggccttgaacactattctcatgtcaaacatt

SEQ ID NO: 641628 - DNA, 377 bp, Homo sapiens
  misc_feature (181)..(181): n is a, c, g, or t
  misc_feature (295)..(295): n is a, c, g, or t
ttttgtttttgtttttttttgagacagagtcttgctctgttgcccaggctggcgtgcagtggtgtgatctcggctcacttcagcctccgccacctcaaggcagttcaagcaattctcctgcctcagcctcccgagtagctaggactacaggcgtgtgccacctctcccggctaattttttngtatttttagtagagacggggtttcaccgtgttagccaggatgatctcgatctcctgacctcgtgattcgcccgcctcggcctcccaaagtgctggaattactggcgtgcaccnatgcccagcctcaaatatgttttttaaaaatatcattgtcctcctcctcttaagatttttttaagttatttgctcaagtctt

SEQ ID NO: 641629 - DNA, 219 bp, Homo sapiens
caaaaaccaacttcaaaaccgatcatccccctccctctcccccccccccaacactactgtctaccacctctaaaactacaactgtcctcgtaattcaatacccaaacatcactcacccaatatcccatgctgtcactccagttcctgcccaactctcgcttctcggccttccggaccttgcgaagggtccacctctaacgccttaaatcaagtattctt

SEQ ID NO: 641630 - DNA, 507 bp, Homo sapiens
agcaaccattcatggcctcagtgagtgacactcaaacagctataaccattcacagtgctgcgcttggcgatcaacagtaatcagcagtcactgccatacattagtctgcataagaaagtactcagctaatgacctgtcattggcgtcataaacatgaaatgtccaacaccagaatagtaaccgcttcaacaataaactgctattgtaccaaataatgaaactcactcatttaactcataacaagcatcatatacatcatactctataatccactataaaaatccaaatgctttcctttctccgtgtatatcaagcatggtagttctcaacagcacacactctcaaaagtgtaacaaagcccattcgtaacacacaccccacctcagtttccgaaagtcagtgcattcagtggttataaataggcatgatgtacttccacagctaagagttctagaagaaaggggacaaaaaccgctcaataatctgaaaagttcctaatgatcacaa

SEQ ID NO: 641631 - DNA, 435 bp, Homo sapiens
agagccgagagaacgtagtctcgagtgtttacagcttagctttctaaaaaaaggcaaaaaaaggcatttatttaatatacaaggggctcagaccgaggcttactttaaaagacaaaaacaaaacaaaaataccacagctcaagataaagagtcctatacagaaatcacaaaagaggacagaccatctagggaaacaattaaaaagacgacacaatggacaggcgtgggcagccggggtcagggcatcctgggcgtggtgaccgtgattaggagataggtatactggcaggatacttcattaataagctgtggggttttatccagagctcggcagcatgtgtgttccaagggactatcaagtgtgggagttctccatagaaaggctcgggagtggagagcagaaagggctccgtgacaatcatacagggacagacc

SEQ ID NO: 641632 - DNA, 119 bp, Homo sapiens
cgccggagactattgacttggccgtgcagtgcctgcacgaacttacaaccacatgcactgctagcacatccctagatgtcatcgacctacctttcgcgactccagaaaccagagtgtgt

SEQ ID NO: 641633 - DNA, 791 bp, Homo sapiens
  misc_feature (37)..(37): n is a, c, g, or t
  misc_feature (85)..(85): n is a, c, g, or t
  misc_feature (161)..(161): n is a, c, g, or t
  misc_feature (172)..(172): n is a, c, g, or t
  misc_feature (186)..(186): n is a, c, g, or t
  misc_feature (202)..(202): n is a, c, g, or t
  misc_feature (212)..(212): n is a, c, g, or t
  misc_feature (263)..(263): n is a, c, g, or t
  misc_feature (355)..(355): n is a, c, g, or t
  misc_feature (359)..(359): n is a, c, g, or t
  misc_feature (409)..(409): n is a, c, g, or t
  misc_feature (412)..(412): n is a, c, g, or t
  misc_feature (420)..(420): n is a, c, g, or t
  misc_feature (423)..(423): n is a, c, g, or t
  misc_feature (426)..(426): n is a, c, g, or t
  misc_feature (456)..(456): n is a, c, g, or t
  misc_feature (474)..(474): n is a, c, g, or t
  misc_feature (483)..(483): n is a, c, g, or t
  misc_feature (487)..(487): n is a, c, g, or t
  misc_feature (489)..(489): n is a, c, g, or t
  misc_feature (503)..(503): n is a, c, g, or t
  misc_feature (522)..(522): n is a, c, g, or t
  misc_feature (527)..(527): n is a, c, g, or t
  misc_feature (529)..(529): n is a, c, g, or t
  misc_feature (534)..(534): n is a, c, g, or t
  misc_feature (561)..(561): n is a, c, g, or t
  misc_feature (563)..(563): n is a, c, g, or t
  misc_feature (581)..(582): n is a, c, g, or t
  misc_feature (603)..(604): n is a, c, g, or t
  misc_feature (607)..(607): n is a, c, g, or t
  misc_feature (614)..(614): n is a, c, g, or t
  misc_feature (631)..(631): n is a, c, g, or t
  misc_feature (633)..(635): n is a, c, g, or t
  misc_feature (639)..(639): n is a, c, g, or t
  misc_feature (641)..(641): n is a, c, g, or t
  misc_feature (643)..(644): n is a, c, g, or t
  misc_feature (646)..(646): n is a, c, g, or t
  misc_feature (648)..(651): n is a, c, g, or t
  misc_feature (783)..(785): n is a, c, g, or t
cctaacgccccggctgctgtccgtgcgcttccggtanggtggcgccccccaggccctcaccctgaggctcccagtgaccatcaanaagttcttccagcccaccgagatggcggcccaggatttcttccagcgctggaagcagctgagcctccctcaacggnaggcgcagaanttcttcaatgccancctccccttggacgcngatgttactnaggccaagcttctggggtttggctctgctctcctggacaatgtggcccccnaccctgagaacttcgtgggggcggggttcatccagactaaagccctgcaggtgggctttaaaatatcggctggagcccaatgcccaggcccngttntcccggctgcccctgcgccccagcaaggagcccttctcccttcacctgtntgngcgctggnacngcngttctgagccctggactctgccccgggggntgtggccggcactgggcngccccttgnactnangcagttttggtggntgggggacctccactggtnacagngnagacnccagggtttgggggatgcctgggactntnctccggccttttgtattnntatttttgttcatctgctgcnnttnacattcnggggggttgggggagtncnnntccntntnncncnnnnaagcacagaggggagaggggccagggaagtggatgtctcctcccctcccaccccaccctgttgtagcccctcctaccccctccccatccaggggctgtgtattattgtgagcgaataaacagagagacgctnnnaaaaaa

SEQ ID NO: 641634 - DNA, 130 bp, Homo sapiens
  misc_feature (54)..(54): n is a, c, g, or t
acggcctgtgtcgtctcgcatctttctcacacgacgaaacgcctcccagtcagnggaaggtaaaaaagaatgcgaagaaaaacggtgtgcgtggcatggtctacctaaggttaatgcgaacaggttttaa

SEQ ID NO: 641635 - DNA, 506 bp, Homo sapiens
  misc_feature (30)..(30): n is a, c, g, or t
  misc_feature (56)..(56): n is a, c, g, or t
  misc_feature (75)..(75): n is a, c, g, or t
  misc_feature (105)..(105): n is a, c, g, or t
  misc_feature (112)..(113): n is a, c, g, or t
  misc_feature (122)..(122): n is a, c, g, or t
  misc_feature (171)..(171): n is a, c, g, or t
  misc_feature (190)..(190): n is a, c, g, or t
  misc_feature (201)..(201): n is a, c, g, or t
  misc_feature (364)..(364): n is a, c, g, or t
  misc_feature (402)..(402): n is a, c, g, or t
ccgaaggggtcaagggcaaaaagctcaaanccaccttcccttagcccaagaaaagnaaacccttctcttccaaanaagcaacatggattaaaaaacccaaccccnaattccnnacccacagnatccccccactgctagaacagcaaatggtcggtacccccaggatctggncactgatggggctcccagnacggtctcctnaaaaggcttcttaggcagacagacctgggaacttggaagtacctgctggacgacctgggttcatggagaaaagagaagccgagaaggtggaggaggccggtaagtggtgacctccgctttcctgctgaggaacactgctttgaagtggcatggcccagcagtncccaccctccagggagaaaagctttgagtgggaagaanccttctatcctggtccccatgatggttctcagcacatcaagggtttttctccccagaaggacgcgatggaggatttcaggagggatttggctcgtgccgaattc

SEQ ID NO: 641636 - DNA, 446 bp, Homo sapiens
tcgcccgccagcagcacgttgcccaggtgcgagatgtagctgaaggccaggcgcagcgtctcaatcttggagagcttgcggtcggcgggctcggtggggatcagcgtgcgcagcgccgtgaaggccgtgttcacgctgttggtgcggtctcgctcgcgcgcgttcgccgtgtgccgctgccggggctcacggcctggccggccccctggccccccgcccccggcccgccggccccccgccctccgccgggcgccctggaggccgcagcgcgccgcgtgcacgcgacagggtttctcgtcggagcccgagctgtcgctgccgcggtcctcgtcctccgacagcgggctcacctcggggtacaggtagcggcccggcggcgccgggcgcagcgtggcgaaggacatggggccggcgggggcgcggcgtcagctctgtcgcgcgctgct

SEQ ID NO: 641637 - DNA, 162 bp, Homo sapiens
atagaaaggagggaaaatattatttccaaaagatggcagaaagaagaaattcatccctgaaagtatagttgggtccgattttgttgagattggctctttccctctgaacgtgctctctactgacccacccccttctgtcgtcttctcccaagcgtataagta

SEQ ID NO: 641638 - DNA, 639 bp, Homo sapiens
ctatcatatagtaaaagccagcccatgacgccctaacaggggccctctcagccactccgtaatgaccgtccggccatagccgatgtgtatttcactgtccagtccataacgctcctcatacataggtccgtacataatccagacacacgtaaccagtataccagatgatggctgcgatgtaacgacgagaaagcacaataccaaggctcaccacaacacccgacctagtgccaaaaaggcgcttcgaatacagggtataatcctcatttattaccatcagaagtttctctttctgtcgcaggactctgttctgagcctttatgaccacgtccaggcctagctccgcgtacacgcccgcgaattgtaggaagggcatctggacacccagacaggcatcacgccgccagcgtacaaggtcccctagaagtcgccacgtccgtggaacacatccggtattacttctgctatcaggagtagtcagaggccatccggagactcagccatgaggctagtagaagagagagcgaaaacaaataattcgaagcacgtgttagtcaacaagttttaactgggtcgtcgtatcctgagccgtccgtacaagcctcagagtacttcgagtctcgccttcgacattttcga

SEQ ID NO: 641639 - DNA, 166 bp, Homo sapiens
tcccccttaaaaaaaattttgggaaatttttccttgggggccctttccaaaattttttttttttaaaaaaaaagcggggacttggggccgttttccctttcccaaggcccaaaaaaagggtgggggggattttttaaaaaaaatccttggggtttggggattttta

SEQ ID NO: 641640 - DNA, 115 bp, Homo sapiens
caagtaatctgtgtataatgagcaatagcttcatcaaatgcttggactccaagctgtgccctgcccttaagactgggcttatgtataatacaggacttctggccattgccacttc

SEQ ID NO: 641641 - DNA, 352 bp, Homo sapiens
atcaccctgatatgtctgggggttagtaactgactccattactataatagagacataatactattaattatcatattaattttctatactgatatgctatcacctatattgaggacaatagagagagcttacactcatattagtctcagctaattagttcattgaagatacctgaaccaggacatttagaacccaggacatatgggagtacattaaggataaatgactactacaaaatggataaccatgctcattccttcaaaacagagatacaaacaatgaaggaaatattagacctatacatgctcgaatttgattcttcccgtgtcctataaaagtgataaaggttaaa

SEQ ID NO: 641642 - DNA, 196 bp, Homo sapiens
cagaaaaacccaaagaaaaaattttccccctttgttatttccccctggtttgaaatcaatcaaaagaatttttttccagggggggtttccttgggtggaaaaaaaccccccggcaaaaatttttttatttacttgaagacagggggttttccccagcccaaagtttactttttttttttttttttttttgacagga

SEQ ID NO: 641643 - DNA, 283 bp, Homo sapiens
gtagacagacttggtttcatgttggcacatttaatgttgaaatggatttaagcaggtgtaaaatggcttcatcttcctttattatcattataaggtcactaggacatagttacattaagttcattagaacatagttattccactaggacatacttataccagtgtattttttaccccttagcatcaaaatctgttacccaaattttactctgtaaataagagaaaatatttttacaaatcttaagaattctttattcacttacatgttgtctaaatgcaatca

SEQ ID NO: 641644 - DNA, 202 bp, Homo sapiens
ggacagcacagaggagggcggacgatgaagttctagatccattgagacaagctctagacagtagcatgcagacccacaaaatttaccaacatccccagcagattggcattcactgtttctgctcctgtggcctcacacggatgcaacccagctaacggtttaatatggacctctgcctcatctttcttcttttgcacttcag

SEQ ID NO: 641645 - DNA, 893 bp, Homo sapiens
gggatatcattatataatatttaaagtcacacagttcttaccggagagtgggtggcagtaggaggcagggggggagttctgcaaatatttcgaatagctgcagagaagaaaacatgaatgacaatagtcaaattcaatttaacaaagaatatctgattataagtgctaagagctaagccatatacagtaatgagtataagtattatgcctatttacagatagtaagtcatatccctatattacagagtatgagaataggctcataaaagttatgtttctgtcccaagatgcaagtggggcaagattcactcaggtctgtggctttagattccctgcattttcaaacactgtgctacaccaaggggaaataagatgtacagaagagaatcaaaacttaccaactctgataaaagccatcaacaactatcattttcgccctagtttcgatagaatctatgagaaaggtaccaattataggggaattacccatggacctggcacagaggaagtacaaggagaaaacgggcctctacaggacaagacatcatgttccagaagggccacagtgttaaacagaattgtttctgctacataagtgtaagccaagagtaatttcaccgtgcagaaatcagagctggatgtcaacggggacaccaaaggccggctacataacacacgtgatcagggtttgatcacttacctttccatatagtccaaagactagcgccaacatcagtaccagcaccactgtgtaccagacgccggcaccaacacacgatgaacaccaggcaagccaccaaaagacaccaaacgtacaacccccacatctcaccaccgaacacatggacgccaccccaacacgagtcagaaaaaggcccggattgtgacccacc

SEQ ID NO: 641646 - DNA, 723 bp, Homo sapiens
ggtgtgagggcagatctgggggtgcccagatggaaggaggcaggcattggggacacccaaggccccctgtgcagcaccatgaactaagcaggacacctggaggggaagaactgtggggacctggaggcctccaacgactcctttcctgcttcctgggacaggactattgggttggtgcagggattccagagaagacttcttggggctccctcaactccaacccccacagccatcccccagctggggcttggctgccaaccagacaggagcccggtgccctggaggttgtccatcctcttgacgggggctctttccctcagcccttggggccttggtgagcttggtgggagaaccgcgcttggttggttggcccaaccaatcgccccaagacccgggaaaccttgcactcaccccatggtactgttctcattcttgctttgccttggccctttgttcgggaccttgcttgggtgacgcgggaagccacacggtggcttggaagaccgggccggtcattccttcctttgctggaagggccgggttgccactttggtgtggcccccgtggtgtgccggtgtgcttgcaaccaacgtcttggcacaagggctctctttgacgtgttgtactcactctgcgaggcctccctgtgcgttgtccagcccttcgtgctcccggggggcgccatcgccgtggaccatctacactctccctcttcataccagg

SEQ ID NO: 641647 - DNA, 1647 bp, Homo sapiens
  misc_feature (1033)..(1033): n is a, c, g, or t
acatcttcagctagtcaatcatagcgtctgtgtgtgttggggtgcgtatagtcctactactaccagtttgttctccctaagctggatgatcgtcttgttgtccagttccctgtcccccgcgagagggtttgcagacacaaaggttgggtggtgtagttggtggagcgctgtgtctctcgttgtgtcccaccgcaggtggaaaacgcttcgggtgtgtctcctctacacaacgccccccgcggttgtgtggggtggatcaccactgttgggcccgcgcacgcagtacagacgcgtggttactcaccgcgggggaaggttgaataatcttcctggcgctcggagaatggcgcccgcccgccgtgagccctttgtgagaggtggaaagcccttctcgtttcccacgcgtggggggcacacaaaatatggtggggcgctgttacaacaagtgcttcacaaagaaaatgggtggtcccctggtatacaacggagatgtgtttttcgttccgtgggggacaaaaaccgcatttgccctggggtgtagacgacgcccgccaagagatgtggaggccccccccgccatctgggagaggaccacggcttgggggcttatacaacacagcatacaacggtgtgaagtattagtgcgcgtggggaaccccatgtcccagggggcccgcacaattttagggcccccgcggtttattgcgccccccgttaatttgggagtttgggcacaacacacgcgcgggcgtcacaccccacatgtggcactagcgcaaagattctttttcctggagaccttgtataaggcgtatataagacagactttgtagttttccgcccgcttgtttcttcgggtatatacaagactctcgtgcaaaagaatggggcccgctgaaagatgtgtctttgaaaagtttctcgggttagagatgtcctcgccccacattgggttgaatatatggggttttccctcgggaacaagagcgccacataggtgtgtctttgaaagagagcctttttctccacgagngctatatgcccaccctctttgggggtcgccctgttgccgttgtggttttctgggtgagatatatgagaggacccacagagcacacagcgtttgtcgcgcgtgtgggtgtgtccacatgcacagaagccacagctgtgagcacacacagagaaggggcttgttctgtgagaggcttgtgccaaaggttctaccccctcgaggtcttgctcgcccacgagaaaggctccacgagaagggctataaatggagatatttattcccgctcatatatacctcgccacaccgccacactctctctataatccacagctggtgggagaagaaccgcgtgtctccacagagacactcgttgtgtgttcacaattggccacatcttaaaagtttaggtagtaaaaaagactggttataatgagtaaccacaatgcactcgtaaaacctctcacgaaaggaaaaggaggaaatgttttgtggagccccttttggttttcttttttgcgtgtggcacgttttaaagttaattatagatttttaaaatccagtactttttaatgggaaccacttgacccaaaatttgtcaccagaattttgagaccccactttaaaaagtttaatga

SEQ ID NO: 641648 - DNA, 453 bp, Homo sapiens
cctgatcttcgatcacagtgattgttaaggtgccacataggctgctgaatgataatgactcgaaccggatcaacctctattgtcaattctcttgactgctggtgtctcaggttgtccattgctctgcggagattggattcttttacctcaaaaccagccaattcagttaggatagatccaggttctggtccaacatcttccatgaataccctgccgaacagttctaaagaaaggcgccaaggtcctagcagcatatcatgggaaataaccattcccataaagctacactgtggcctggaagatgtgagaggtggcccttcactttcagtaagtgctatatctgctagtaagccactttttaattgtgcagcacgatcatgagcagatggccctggttttgaactctcagtttcttctggcagcacgggctgttcttccccttttaatatgccg

SEQ ID NO: 641649 - DNA, 652 bp, Homo sapiens
  misc_feature (22)..(22): n is a, c, g, or t
gcccatgtctagagacaacgtnatgaaccccgcttggggtgttaaaagcgctgtcgtcgattccggaagttggcgcgcgcgtgcgaggctatgcgcggggagagggcaggcctctctttgtcgcctgcctccattggtctacgggggcgggggcggacaccggcgcggggcggacagcgcgctcacgctgcgggaaagcggtgcgcgtgcagcggggtgggtgccctgtcgcgggcgactcgacagcaccccgggcgcgtcgggcctggacggcctgaggcacgcgtgagcattcctggagcaggactgtcacggtgctgggggcgctggaggccaagaccggggtggagaagcggtatctggctgcaggagccgtcactctgctaagcctgtatctgctgttcggctacggagcgtctctgctgtgcaatctcatcggatttgtgtaccccgcatatgcctcaatcaaagctatcgagagcccaagcaaggacgacgacactgtgtggctcacctactgggtggtgtacgccctgtttgggctggccgagttcttcagcgatctactcctgtcctggttccctttctactacgtgggcaagtgcgccttccagttgttctgcatggctcccaggccctggaacggggctct

SEQ ID NO: 641650 - DNA, 198 bp, Homo sapiens
cgacagcatccctaagcacgggggtgccgattacgactcaccctttacgtaaattaggaagtttaaaggaatgatctctttctttctttctttattaaagtggagtcttactctgtcgcccaggctggagtacagtggcaagatctcagctcactacaacctctgcttcctgggttcaagtgattctccagcctcaga

SEQ ID NO: 641651 - DNA, 375 bp, Homo sapiens
gatactatctctcattcggacagtttgccgaatgggagttgtaatgcgagtggtgagagagagcatacttttcttgtgccggttttcagggggaatgtctccagcttttgcacattcagtatgatattggctgtgggtttgttgtatatggctcttcttattttgaggtatgtttcttcagttcctagtttattgagaattttaaacgtgaaggaatgttgaattttattgggtgctttttctgcatctattgaggtaatcatgtgttttttttatttagttttctttatgtgatgagtcacatttgttgatttgcatatgttgaatcaaccttgcatcctggggacaaagccaattccattgtggtggatgcac

SEQ ID NO: 641652 - DNA, 162 bp, Homo sapiens
ccagttgtatgcacatagatactctcaattacttatagaccataactctgctttatatttctaagccctccattctaggggtgtagctgcagggcatttttctctattaccatctcacttcacacttttatctcctctctagcagggtatattttgtattct

SEQ ID NO: 641653 - DNA, 855 bp, Homo sapiens
cagagccccaaattaaaaaagaagcaaaaccagctatatctgaaaaagtgcaaatacacaaacaagacatagtgaaaccagaaaagactgtttctcatggtaaaccagaagaaaaagttctcaagcaggtaaaagctgtcacaatagaaaaaacagccaagcccaaaccaacaaaaaagctgaacatcgagaaagagaacctccatctataaaaacagacaaaccaaaacaatccaaaaggaacatcagaagtcacagaatcaggaacgaagaaaactgaaatatctgaaaaagaacagtacaagaaaaagcagacatgaagcatcttagagaagaaaaagtctcaacaagaaaagaacagtcttcaattacacaatgtgacaaaagcagaaaaacctgcaagagtatcacaagatgttgaagatgtaccagcttcaaagaaagctaaagaaggaactgaagatgtgtctcccacaaagcagaaaagtcccatcagtttcttccagtgtgtctactgtggatgggtacaatggtatggatttcagtttcctttcactcctgagaacgcctggagagagctctggtcaagcaaattctccaggacagaagcaccaggaccgtaacacccatgtgatgaccttacagtgctttaagacttgaccaaagggccgttcgtcccacgagtccaggcaatagaatttgcaccagagagttcggcaaacttgtccggcgggttggaggaacgggccaaggtggtggcgcacacagtcaagggccagcccaaacaggagggggcggcggggacagggggagaaatcacgccaaaggggcacctcggtcggggtcacaagggcg

SEQ ID NO: 641654 - DNA, 318 bp, Homo sapiens
  misc_feature (20)..(20): n is a, c, g, or t
  misc_feature (252)..(252): n is a, c, g, or t
  misc_feature (281)..(281): n is a, c, g, or t
gtaaaaatcatgtatatganttattttaccaagtagtattatctgcacgagacaaatttaagtattttaaaaatcatccttattaataaataatcctcatataatgcacagtattgccacaaatgcccacttcattttgtctgcatagacatattaagaatttttcaatgatgtaatttaattatcctaaaagaaatgacagattcttctgtaggaaaaaataaaaacatgaatatctcaaattataatggntaatctctaaaatatgcttaaagtaagangtttctatgttatgtggttatgttatcaataatattt

SEQ ID NO: 641655 - DNA, 199 bp, Homo sapiens
gagtgggatggggcttgcctggagtgttgggggcagcctgggaacacctccgacttaatatgcagtggttagagacagaagagggactctgctggcagcagacccagactgaactgctcggagtgtactttccttgacagtgcaatgcttgttggccagtggctctgcttgacatactacctcctagcgcagacttcag

SEQ ID NO: 641656 - DNA, 975 bp, Homo sapiens
ggtgaaagtggactccggagactcggaagtggtcgatgggcttatgctccagcaacatcactctcctcatgtgctcagcttataggaaccagactgcgtcaagcactttttgtgcgcccatccttagtagcagtagcattgcagatgacaccaggtttcaggaaagaggatgtctacagttgcttatcgcttcctacgtggtgtttatcgcagatgagttcatcttccttccaggaaacgacactagaggacgtttgaacgaaggctgttacctgctttgtagaagtgaagccatacaagtgatctactgagaagacgatcctagttacagagaaaggaaatactgtgtgagaattttgagtaggactctttaataccttttgtggaaagctatcgagataagttgcaagtagcgttttgagtgaatgaagaggaccacttcagtgaggaacagtacttgtgctgcagtcagaacagattcacaagtcagcttctcgatcacaggtacctctcaaggtgtctgatgtattatctatctgatgtgcagaaaaacgccttagcagcctgtgtgacggctcggagtagtggagaagaaagaagataaataataactagtatatttaatgtgtatgaaccgtgccacaacctaattagaagatatgcttggctgtaaggacacggataggaaaaccagtgactggaaaaacttttactactcgagcgtaactatgttatgggccaacttcggtcacgtaattgctctcatccgaaggactcattacacaaacagggaagttcatggaacgagacccattctcctcatactccctgagattctcatgaccggggacgcacatcggcaccaggatgatccttggcatgcaacagttaagtcttccccaccaacgggttaacaggggttggtactccgaacctattctgtggtcaaactaacttctggcaccacaccaataa

SEQ ID NO: 641657 - DNA, 153 bp, Homo sapiens
tcttgtttcctgcacttcgggaggggaacgagcggatcacccgaggtcgggtgatcccgctgtattgctctatatagtgagatccctatatagggtctcactctattgtccaggctggtctggcctggccaatgtggtgaagcctcatttcta

SEQ ID NO: 641658 - DNA, 218 bp, Homo sapiens
gcccagcgtgcagactattgaatccacacgatggaaagaagagaatgatttttaaattctccagagatcatgagatgcgtccggtcagttttctcatgtgagaggataggcaggccaaaaactaaaattgctatcagcccccgccgctgtctggtacgcgaggaaactttccgaggactttacaagcatagttgcaaaatgctagtaggtctgggact

SEQ ID NO: 641659 - DNA, 327 bp, Homo sapiens
atgataggtaatagctgcatataaataatttttaacatagaattatctagcaatactacatctagttatataaattactagtaagttctcaaatttaaaatatgagtgtgtgagtaaaaattacattctttttaacttctttgaaacaaactacagatacaaaaatctttctcagtacaaacaaaaccatttcttttcctccatttttacgccaaagaaaataaatacacctactgatcaaaattttagcagacaagcatcacttatataataaacgcaagatatgggccaactagaggtcaacactagaagagctatcacctgtca

SEQ ID NO: 641660 - DNA, 223 bp, Homo sapiens
  misc_feature (113)..(114): n is a, c, g, or t
  misc_feature (116)..(116): n is a, c, g, or t
gagtcaatctccacatatgacatctccacccacctggcctctcagggcattcatctacctacctacgtaggatactatacatatacaggtaaagccaagactacctaccttanngngctactacaatctagcatctaccaggtacagcatctaggaccagggtacagtatacgtaccagacaccctgacgacaggaccatatagcatgtacggcttaccaaca

SEQ ID NO: 641661 - DNA, 1594 bp, Homo sapiens
ggttgcgcgctctcgtcgctctgttgagctgaccgcgcgcgctctgttgtgtggccgcgtgttattcattgcgcgggattggctcgttggctgttggcgcctagtagccgtgttgcacagatcgggtgggttcggtcggtgtcctggggttgcttgcccgcctcggtcgacgctgttgtgggggaacccttcggggggcgccgtaggatcattttttatatttattgggccccgggggtttttacacgagtgggtccctcggtggctccggagccgccgttgttgggccaggggaccccctcgatggttgctctgccccgcccgcaccctttttctccgaggaagtagtagcgtcgctctctatataacactcgctgcgtggtgtgcacccaccaatgggggggggtatgaaccactgttttccacgggggtgcacaagagggggctgttccacgggtatcccaacgggggcggctcacacatgagtgagcccccacacaacgcggggccacggcgagacccaacgaaaggggccaccaaagagccacgaactttcttaggggggacccccagggagcacaactacgccacctggtgccgcctgagggtccccgacgcatggcccgaccgagccgctctcaaccccgtcaaggaggggtgtctctcccttccggcaagaggtgtcccgtttccggcgggtctcgttttaaggtggggaagagccccccacatgtggggcgcgtggtaaaatcccacgggggttctctccgccgtatccttaagacgtctcaagagacggtggattcttgtgccgcacaccacagggtgtatattctgcgggggagtattctctctcgcggttttattgttggggcacacacagagggcgcgcacccacagggttccagagaggcggtgtaaaaaagaggggggcgccccactgtctcactgggagcgcacacttgtgccaaaacacaatatggcgcgcacgacgaagagcggtgacacaccgacaacgtctcacacatgtctcctcttttgtttctatccccccaccctttggagggattaaaaaatagaggtctgggccaagttgttcccgccccacactgtgaactttgtgtctctcgtgtgagagagagagtttgagagttgtctcgtggtctttgggggggagagaaccccccccaccgctcccctctcctcccactctgggggcacacacagagccccacaaccacacacggcgcgggggaaatgcgtcccacacgccacacgggcacacaacaccaccacagagacccacacaataggtgggtgtgggggcacccccacacacgggtctggggccccacaatgcacggcgcctgcgtggggccggaacggtggcgtggctggtccctcatatcaccccttgttggtttcgctggcacacttttccacggtgccctgggggttgaaccacggaggccgatcaagaagagtggagcctggccacagaagtgttgagccacacacacccccatttcacgagggtaaacactccacacacgcttccccacacattttctggttgcccagtataagccttgga

SEQ ID NO: 641662 - DNA, 1184 bp, Homo sapiens
gtatttttatatcagcctgagtctcctgatgcccacatcccaggcttcaccctgaatggttccatgcctgagtggtggagcactaagccctgtcgagacacttgccttcttcacccagctaatctgtagtggctggacctatgtcctcacgtgacacactaatcgaactatgcaactacaaagcttctcatcccagtgaggtggctcatgtgccaccccttactgctggcctggaatctaccccactactagtggtgtcagtgctccattcaggatttcgccccttacccatctcttacctaacccaaccactcaaattaatacttaactttacctgcagcaccagttgggcagcactggagtgcatgaggaggcagagtggtgaagtggccagtctggtgctgcctgtggttctagtctcctttgcactgagtggccacactattcaccatgagaagcagggcctgtcgggcagcctgccaaactcactgctcaagaagacatggcagactcctgccctgttgtgtatcagatgccagatatttatctatatttacaggttgtccacatctttcaaactacagaccactaacgttcatcatgcatcatcctggactagccaactatgtcaatacaacaactcactcctgttacttcactcaccagatatcaatgtctgaattaaaaaaaatagatatatgaacttgtcttggttcgcatttgacagggtcaagaagtgcaggggactcgcgacgtcgacacacgcacatctagcttggtggttgccaacacactgcgaaccgcgcatatgacacctcgcagcccggcatccccctccccttcacacgatacctatcctcttgtcctcctgagcaccaaacacgtggttaggaccgcgtgtataccgtcgagattttcttactatccagtacattaagcgtccaaggacaattatcataaccaacatgatctacgcgtgaacacaaacacacatttttcccccaccaccccccactctcaccataaccatcataccctcatcctgtagcacccacccccatctcacccatgtccacccccccatcctcccccccccctactaatacccaaacaccaccctcccaaacctatataccctttactctaaacatatatttttcctttataacacccctccatccccc

SEQ ID NO: 641663 - DNA, 205 bp, Homo sapiens
tttcattctaaaaatcttctcaaggctggatgatgtggaatttggtctggttaaggcacttcttggctaatgatgaaccacggtgggggttttttcacaattaaccctaattctgggcccctttggccttatcaagttattaactttcctggatcccggtcgtatcattcttcctcaccagtctgatttcttgggatagtgtctc

SEQ ID NO: 641664 - DNA, 608 bp, Homo sapiens
cttcgacggtgttctgtgtatagcatttagtgaatttgtgggatattcctctgaaatagaaggtaaactaattggtctttctcccatgggcatctggaggagagttctcttccacgtgttttttctgctgggcacaatggccagaatgtcctaacaaatggatatggatgccagccaggcaacagcaaatagcacacttccaaaagtagcctgggggctgtgaaacctctagagcctgtattagtagaacccaaatatacctcgcttagtttaactgccaatcagaaaattaaaacaaattaataatctagttcataccatttataatgctggaaagcctccctcctagaataaacggactgcctaaagggctgcctaaagcaagccagagaaagaagaatataacttactggaaggggagagtttcaattgccctcttgagttacatacacacaaaaaagctccagtttagatctcagtttccaaattaaagatctgaggtgaaaggaacatatttgtgtttgcctaacataagccatataaaatatagtaaaattaagtctgagccagtcaatgtaataaaaccatgttattcttttatgggcggg

SEQ ID NO: 641665 - DNA, 1177 bp, Homo sapiens
  misc_feature (1177)..(1177): n is a, c, g, or t
cttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcaggggtgaagggaaaataattgatagaagaccagaaaggcgaccacctcgtgaacgaagattcgaaaagccacttgaaggaaaagggtgaaggaggcgaattttcacgttgatagaccgattattgaccgacctattcgaggtcgtggtggtcttggaagaggtcgagggggccgtggacgtggaatgggccgaggagatggatttgattctcgtggcaacgtgaatttgataggcatagtggaagtgatagatcttctttttcacattaccagtggcctgaagcacgaggacaaacgtggaggtagcggatctcacaatggggaaactggtcaagacgaattactggacttggatcatcagatggtgatgagggaacactggaagggtgagaacattatcagtggagacactgaaattagggaatgtagttgagaggttaaaagggagggcccaagggatgacttggctgatgtgacggattccaaaatatgggccggggacaggttaattagtatttgggaacccactagggggcttggtgacggagaaggaggttgttcaaacacgagggagcagtgatgaaaggtggtgacacatttgtcaggagacgatatggttggtgagaaatgtagagacgcgacgagaggaggagagatatgtttggacacacgaacatatgttgaacagttgaggcatattctaatataatagtagtaggagatgtaagatagaaggtcgn

SEQ ID NO: 641666 - DNA, 340 bp, Homo sapiens
ccccccccgaaacccgggggcaggggttttttttggggggaaggggaagggggcccaataagcaaaccccctttccccgggggttgggcgttttttttattcaggtgggcccccgggttttccccttggaaagggggcggtgggggccaccccatttttttgggtttggtccctcttttggcccccccgggttttccctttttggttccgggttgttttttttttggaattttgggggggtaacctttttcccccgggaaccgcttttccattttttcggttttttttcccctcccttttggggttttggcccctcgggcccaaattttgggccggggga

SEQ ID NO: 641667 - DNA, 739 bp, Homo sapiens
  misc_feature (19)..(19): n is a, c, g, or t
  misc_feature (72)..(72): n is a, c, g, or t
  misc_feature (96)..(96): n is a, c, g, or t
  misc_feature (109)..(109): n is a, c, g, or t
  misc_feature (111)..(111): n is a, c, g, or t
  misc_feature (113)..(113): n is a, c, g, or t
  misc_feature (118)..(118): n is a, c, g, or t
  misc_feature (125)..(125): n is a, c, g, or t
  misc_feature (146)..(146): n is a, c, g, or t
  misc_feature (148)..(148): n is a, c, g, or t
  misc_feature (181)..(181): n is a, c, g, or t
  misc_feature (188)..(188): n is a, c, g, or t
  misc_feature (197)..(197): n is a, c, g, or t
  misc_feature (213)..(213): n is a, c, g, or t
  misc_feature (249)..(249): n is a, c, g, or t
  misc_feature (274)..(274): n is a, c, g, or t
  misc_feature (307)..(307): n is a, c, g, or t
  misc_feature (332)..(332): n is a, c, g, or t
  misc_feature (725)..(725): n is a, c, g, or t
aggccgggtcaacttcttnaacgtggacatgttgctacttgaagaggctatttgtgtaccttcctgggtggntccaagccaccccagagagttatntttatcgaggacntnangctgnctgcaancttcgttgcacgggaactatngncacagtgtcccaccatctaagagatcagagacnatggctnctgtggctnctgctgtgctttctgngctgtgttagtcttctctgtccggatttgcttcctntcttatttgcatgtcagcgttgtgntgtctttttttttttctgtctcttcatgctgtngcagcatgtgtgggggacggctgtnatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacggggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcacggagagatgatgggtggcatgcatccgcatnctgggctgggggtg

SEQ ID NO: 641668 - DNA, 950 bp, Homo sapiens
taaggcccattggagtatttggtttccaattagggagatagtgggtattaggattaggatggtggtgaagtttagtccggatgctatggtccaatgatggtaaaagggtagcttagggtggtcctccgattcaggttaaaatgaggaggtcggcggctaggagtcaataaagtgatgggcttagggggcgaaatataatgcttggttcgttgggatatatggaggagggggatcatggctaggatgaggatggatagtaatagggcaaggacgcctcctagttcggtaaggcacggatcggagaattgtgtaggcgaaaaggaaatatcatcgggcttgacgtggggaggggtgtcaaaggggtcgcacccagggacaaacatggcccaggggctcgccatagccaggccccgctgacacactcagcgcccccggcccctccacaggccgcagacaccgcacccaacacccgtcaagcccgaggcgccctcacctcacatccgcccgccaccagggcggcaccgtcgaccacacacgccactgccaccgcgctgcccccacacgcgactgcacgagccccccgaccccccgcacacacccccagcacgacgcgccgtcgccgcccagcgcaggaccaccgcacgcgccacaccaccatccacaacgcaacaccaccgcgcaccacgggcgcacccaccccgcgaccccgccgacacccccccgcacaagcgcaccacgcccgcaacggcgaacaccccgccccccccgaccccaacggcctccccaccaccgcagcacaccctgccgcgccgcaccccaccagcccccgcacccaccgccccgcaacacacgacacgagcccaaccacctcacaaccgacgccccccaccgccccactccccgacccccccgcaccaacaccccccccccgcccaccactcagcacaccg

SEQ ID NO: 641669 - DNA, 537 bp, Homo sapiens
aaaaacaacaaggaaatatttagaattatgttcacaattttacttatgatactatagtgtaaaaacggacacaaactgaaactttcctagcttatttcacgtttaacttttacacacgtgtttaactcagtgcttgttactactgtggacgctttcgacccactacagttaactcttattctctttttttcttacaactgtcagggtatggctcctgatgtgacccagggtataaaggtgcaatggccagtggactcatgaggtattatttgcaatacacaccatcttaggagccctcacagcgaaatcatacctgtgccttagaccatcataggagatggacgtggagaaatatacggccatgtgatacccaaaccaagttgccacaagcctacattattaactaaatttcactataatatattgagcgtattaggcaaagggaacacacagatataagtgagcctaattgcgtcgacccaagaattgggggtcttaaacacatctcgtgggcctttatcaaactctctgcgcgat

SEQ ID NO: 641670 - DNA, 1401 bp, Homo sapiens
agcgggctcccgcgtgcgatgacgggcgggtaggatgtaggcagcgcaatgccaagacacgagactgctgggatggcggacgggcgaatctccgctgcaccaatgatgccatcgcgcgtccgagccctcggttatgcgggcctgactaaaacagcagggcgcctaccgcgccgtcccgtcaccaatttagcgccaccggggaccttcgggcgtcgcgggaacgtattacgccgcgtcgggcccggaggatccgagggaaacgccgtcggaggagcagatagggcgcccttagggggccggggcttcgtcataacggaagcagcgctgcaacggtaagacaggcacgactccgctactagcgaagcgccggcgttccgggggctccctagaggaagtcggggccccgaggaccgccgagccggtaaccgtggagtgccggctgtcgcggctgttttggaccatttcacgcgtgtgttgtgtgccacccaattgcgcgcgcgcgtgcccactgcgcgacgcgtgagggatagcccttcttacatgcttcggtgccgagcgttacctagagcgagccgtagacagggatagagatgtagggctagagctagactcacccgaagtgctggtaacaggagataggagatgagcctcgaagataatcggggcctcgtctggccgggggtaaccctaccaggggagccctgtggttccaagagccgaaacggaactttgtacttcgcttgtataagcgacaggacatgttggttgtatcccgcgtgagaacgatgtgcacgagagacatggaacgggggacaaacgcagacctgtgcaaggtccgaaacaagtttagggtacaccccacgattaatttgctatcgggtggggataaaccaggtgggttgaaaccatgaaggaaaagcaatccaacgacaagcgaagccaactcggttcacttaggaaaacctggggggcgcgtctcaattgaacgccccttaatgcagttcagaatttatttagaccttcggaacggggaacaaggatttctttgcgtaagcgggtaaggaccttgggccgagggaaacgttcgaccgtaggattggccaaaacccagaggccaaggggaacttggtcagcaacgttcctccattaacatacaaggccaaagttgggaagcaacgacagttccaaactgttagacctatgagaaattcacttcgtgcgcttaaagagaaacacaggtgtacgttcccacggcggaaacgttggaacacgatacagtatagcgcgcatcggctactgtctcgtttggacctatacattgccacgtagtacccacacaagagaaccgttgttgtccacagaggcaacatacatacagatccagacgcaggaaagttattc

SEQ ID NO: 641671 - DNA, 623 bp, Homo sapiens
  misc_feature (235)..(235): n is a, c, g, or t
tgcctccagttccagcgggaggaacggccctcttccccacgatcctggccacaattaggttgttgcaacggtactccccaaaattgaaaggagtgccttggaacctcctctgcaccgcacccagggcgattagttgcctgcctgcctaatcagggcaggccgccttgtgccttagggcccggccaaaccaccagggagccaatttagccctcccgccaaggagccttgcccccanccaatcaatgtttgtttttgccctgatggtgcctcaggatcccccattcccccccctgggaaaagaggggggccccatgtgcttttccagtttttttggaattggggggccccccccaaaaaatgagccccctgtttcctccatcatttgggttccttttggctttggggaaaattttaaattttgggaggtcctccctttcccaagggtgggatttgtggcagggattcccctcaaaacctctttggaatttgggcctgatgggccctcccctggattttggggttcccagccccccatgtggattttgggggggcccttttgtgtttcccccccccttcaaggactcctttctttttttcccaaaaagcccaaaattttgggggga

SEQ ID NO: 641672 - DNA, 646 bp, Homo sapiens
  misc_feature (396)..(397): n is a, c, g, or t
agtacatatccaactcagcaaggggcgccatggtcatcaagactggacgagcagcagctagcagctggttgggtacatcatggccaatgctgacgaccatccagctacttctgctacccagcacggttccccgtgcgacctggttgcgagcctagtctcccgtactgctggtcgagatcattcgcctgcaggagcccagttgccgatcgaagattgaggtggccacttatgcctacctgctaccctgacttctagcaaaggccacctgagcgctatcctggccatcaaggggaagctatccaacagtgaggtcaagcgcatccggagcatcttggacgtccagcatgggggcgcaggagccctcccggcccctattttcccttataaagcccaggnncgccgtgagcgggattcagcaatggtggaatggaagacagaactggaagagaaagaacggaaaagatgagctctcgtctggcaggggctttgagggtcctgtggcgagctgtgagcaccgccagcgttacgacgtcacatcaggtggcccacggccctacaggctgccctgcaattggggccctgagccctccctcttcatcccccaaggctcaactagagggtggtccccgagggctggtgtctactg

SEQ ID NO: 641673 - DNA, 373 bp, Homo sapiens
caaaaaaattggggggggggggggggggtgggggttttatttttaaaaggtttttattgggatccaaggcaataccataaagctctcccccttttaaaggggccaattccggggggggggggttttcataagatttttccttggggttttttcataaggcttatttccggccttttcttaactagggccctttccccgaggccttcttcataataattcccgccctttttttccccctaaaagggaaccctggaaccccttagcggtctttcccccttcctcccaccccttttttccctaatccctagaaaccccccatttgggggggttttttttttttgccccccttttttttaaagggggtcatcccata

SEQ ID NO: 641674 - DNA, 383 bp, Homo sapiens
  misc_feature (63)..(63): n is a, c, g, or t
  misc_feature (133)..(134): n is a, c, g, or t
atccccggacacctctgtccagagcccctccacagtcggcctcatgactgtcctcctcgtggnatggcgagggccctcttcagctctctggagacagggccgagcctcacccatctgccctctgcacccaggnncgccgtgagcgggattcagcaatggtggaatggaagacagaactggaagagaaagaacggaaaagatgagctctcgtctggcaggggctttgagggtcctgtggcgagctgtgagcaccgccagcgttacgacgtcacatcaggtggcccacggccctacaggctgccctgcaattggggccctgagccctccctcttcatcccccaaggctcaactagagggtggtccccgagggctggtgtctactg

SEQ ID NO: 641675 - DNA, 225 bp, Homo sapiens
gcactctcgtgctgctgcatcgcagtccttttgtagctagatcgatgtggtcattgttcacatgcccagaatttttgtcatacagcgaatccttgatggagtcatggatttgtgtttcccttatgactgccacaaacggaactacctttccaactctttgcaagagaaaatatgccaagcatgaatgataatgcttaaaccagtatacaaacagtctactcatga

SEQ ID NO: 641676 - DNA, 562 bp, Homo sapiens
caccagctcggggttgcacaccagctcggggttgccagtcccaagcaagtctgaaattcagcagggcaaattccgtggggtttcaaggcccgtgaatgctgcaactgcggctcagtgccccaccctctgcacctgcacctctgccagcctctgcctctaggcctaaggccctgaccttggagtcgttcttcctttttctcaaagggtagcacatgtttgcagctgcctgggtctgtcatcctgtttcttgcctgtagactctcagaagcccaataccttccttcatttcatcctgtctctgttcccatcaatccaagcaggcagtgtttctgctggtaaaacattctcataaaccttctgggtctcccctgtatgtcacagggagccaggccattagagagaagggttcactcggatcctccctggataatcttgtctctattcctggcttctgttgagatgagtgaatggacccatgagtcacatacctcatctctgcagagatggctttctctgcagaacacactttcctaacagtgaacctcacaaccccgagctggtg

SEQ ID NO: 641677 - DNA, 186 bp, Homo sapiens
  misc_feature (118)..(118): n is a, c, g, or t
  misc_feature (152)..(152): n is a, c, g, or t
ggtgataaagtagagcagcaaggaggaggtgcttggaggtagtagctctctgtgctggagtatgcagagggtgagaagtctggcaggatgttgaaaagatatcgaagctcagttctgngtgtggagaggggaccgagatgatcttggcgatntcttccactcttggagctggggagttgcggaagg

SEQ ID NO: 641678 - DNA, 671 bp, Homo sapiens
  misc_feature (259)..(259): n is a, c, g, or t
ttaccaacccttctccccaagacacacaccaccacaggctcaaaaattctgctgtgtgaatgaataaacaaacttaattttctctcttgacttaatcaaatgcctttactttgatttacctgcaggtgctggttattatagtcagatattttaatttttgacaatgcgataagtgtaaaatgatgtatcaggaatccaattgcattacctaataactgctaataagttgagcacctttcatatatttatttcccatggnagtttccttttcagaaaaaaaaaatgcctgctcataaatttggctcatttttctgtggtctttttcttactggatttttaaggggttttatattgttttagatatcccttcttggccagttacatgaattagtaaggttttctcgtaattgtaacttattctttcttttttctttctttcttttctgtcccaccttttgtgggtgtagtctgatgaatagaaattgaatggcagtataaccaaatataccaatcttcaattttttgccgtatggtaaggattttgtgactggtctatttctacccaagcccttaaagatattctatattttccccaacaagatttaaagatttcctttcacattttagtttttcaaccactgtggaatgattctgtgtaggatgtgaaggcg

SEQ ID NO: 641679 - DNA, 103 bp, Homo sapiens
gcggccgcctactactactactactactactgctcgaattcaagcttctaacgatgtacggggacatgtacctctgattaataaatgcttatgaaacaaaaaa

SEQ ID NO: 641680 - DNA, 134 bp, Homo sapiens
ttggagctcatcgtatgtgtgagccaccgctcttacacagctcggctgacccatactggctctttctgatcatatgccaacacaatgtgcataccagcaatgatagtctatgaatgtgtgctctgtgaccacct

SEQ ID NO: 641681 - DNA, 867 bp, Homo sapiens
gtctgaccgccagatcaacctggagctctacgcctcctacatgtactgtccactgtcttactacttggatcgcgattgatgtggcttagaagacacttcgtcctaagtactttcttcaccgatctcatggaggagagggaacatgctgacaaatcgtgatgatagctgcgatataccaatcgaggtggaccgaatgcttccttcaggatatcaagaagccatactgtgatgactgcgatagccgggcatgaatgcgatgcgattgtgcattacaatttggaaactcattgtgtaatcaggtcctgctgacgtcggtaacgtagcacaaccactggcgccacttgactaatagagatgcatccccgatctgtgttgtgacttcattggaaacacactgtgacctggaatgagcgaggtgcaacagccgatccaacgtaattgggtgagcacgtgaacgccaagctgtgctgcatagatggggatgcgcccgaatctggcttggcggaattatctctttgacaagcacaccctgggagtacagtgataatgaaagctaaggcctcgggctaattgtccccatagtgcgtggggtgacttccctggtcaccaaggcagtgcatgcatgtggggttgcctttaccttttctataagatgtagcaaaacatccacttaagttcttgtgattggtaccattccttcgacataaagaactctggtagccacgaggagggtgtccggccgaagaagacgagccgcgtgcatgggtcccgtaaaaaccgtaagaagtgacgaggcgcaacgtccccggaccgggtcctaacaaaggggaaaacgcggggccccaatggaggatacaaccggtccga

SEQ ID NO: 641682 - DNA, 255 bp, Homo sapiens
  misc_feature (59)..(59): n is a, c, g, or t
  misc_feature (75)..(75): n is a, c, g, or t
  misc_feature (105)..(106): n is a, c, g, or t
gggtttctcccgaacgagagagaagtggacgagacaagatgtcgtgtgatggtcttctntcgtctttacttttcntaaatgaaacaccgacctaataaacattannaccatgttccgtcgaccgttgcaagggaagttctgtgtctcctctttaggtctagtaagagtcgaagggtccgtctgggtgagtcactaggactagtctacttgctcctgttgcggctaagtgtcccgtgtaagtggtacctgatgtgc

SEQ ID NO: 641683 - DNA, 380 bp, Homo sapiens
ggcaagagcagatgccagtcatggatgaccaacgcgaccttatctccaacaatgagcaactgcccatgctgtgccgtcgccctgatgccccggagagcaagtgcagccgcgaagccctgtacacacgctcatccatcctgaggactctgcttctcgctgggcaggtcaccaccgtctacttcctgtaccagaagcaaggccgcctggacacactgacagtcacactctcagaacctgcagctgtagaacctgcgcatgaagcttcccaaggctaccaagcctgtgagcaagatgcgcatggccacacccgctgctgatgcacgcgctggccatgggagccctgtgtcagacgcccatgcacaatgccaccaagttgtgcc

SEQ ID NO: 641684 - DNA, 1339 bp, Homo sapiens
agtgcggccgggaactgtgtgcgtgtggtggatgctgtacgtgagctggcccatgcccttctgcctgtgtcctgtgctgcctgcatgtcggtgtcgctgtgggtccgtgccctgaacgtgcgctcatagcgtgtcctcgtgcagcatgcttgctagatgtgcctgatgggtagcatcgtcgtgggccgtgtcactctgcgatgtggagccgtgcctgtgactgagcccctgatgttatgtggtgtgctgtattgcacatttgtgtctgaacatggcactatctaccacggcatagcttgactgtgggggtgtgctgtgttggtgctagggcccacgattgagtgacgcgcgatgcgggcttgaggtcttcacttaggggcccccacgccctctacacctctttacttcctccccctttgggaagctttggggagtttgggagtccctcggaacgctttgcgtgggggcgaaacgagtcgcactgggggttgtttgcaccgtcattgccgtactccttgcgcactttggtttctacggtgtggtcttaaggccaccgctttcttagggaggcatctttgggagggctatcgccttcggagttttgcgcgtctccgggtcatgttacttaagccgttttaccgaggaaggaattgctcaaatcgaaaatatcagggttaggcgtttagggtggatttcccgtccaccgattttaaatttattaacgttcaccccgttggatttgtgataggtttcgccccgggcgtatacgatctcctatggcgttcgtcaactaaatttccgagacccatatgaaaccaacgcgtatgggttggaggtcatcgaccaggggcatttgtgggccttgacaatttccccaagtttgtgccgaggagtccacgattggtgttaggtatccctactacgcctatcaccctagaaagtaagggggttaagttcaagttgaagcattatacggcgagtgtatgcattgaggggctttacttggcaggttggcgcgattagtttgccgcaacaagaggcgcagctaggaattttccacttcgcttccaggggagaacgcccacatccggaagttttcccacatctaccgtaaagagggcgttaaaaattgggcgcggagccgattgtggaggaatttggggacttaagcgttttaacgcagttgtatttgtccgagccgtgtgtatgttcaatccgacgatagagttaagcccgagattaggggtacaaaaaaggtcagctgggggagttacttaaagggcccagggtggattgtgtccagcacaaggcttgataggaagttgattggaggggttcg

SEQ ID NO: 641685 - DNA, 509 bp, Homo sapiens
tcgctcatgactcgcttgccccaggtcctggcatacatcatactactacagtttctatgattcttgaatacttcgtaagtgtagaatcgtaccttatttgtcctttcctggctggcttatttcacttagaataatatctttaattttcatccatgttgtagcatgtgtcagcatttcctcctttttaagtgctgaataatatttgatagtctggatatactacattttgtttatacattcatctgtccatggacacttagattatttccaccttttggctgtttatgctgctataaacataggtatactgtggtagaatatagatatatctgtccatggccctgctttcagttgtttagggtatatacccagaggtggaattccttgatcatgtagtaattctatttataattttttgggggaatctcgccatactgttttccagagtgactacactgcgttatattcctacctgtagtgcagaggggctccaatttctccacatcctc

SEQ ID NO: 641686 - DNA, 852 bp, Homo sapiens
tcactaacatgtgtaggattgacggtcggagggaatttgagattgtatgtttgtcatataatcactgttgctgaacattgatgagtcttccaaaatggaatcactagtaggtgcactgaatactgaaagtatgctgtctgggagagcatatagtcgtgtagctagaattcttataaccgtaattccagaattcacaaagtcaagagatctgctgtttgatagaggccttttaaaaagactatataacatttctattggctgtttatgtgaatgctcagggaatttggacatgtgtttatacagaagtggcttttatatttcttcaagtgataaattagcattaggacatatcagatagaacaggccagtttcctgatgagatgctagagatgttacggtaggttcatccttcctttttccatgttatatgtggagaagtgttaaacttgctcaagcaaatgggagtaggagataggtgaaaatagagattgtacaccattctatttgtttcatgcctgttttttctccaagtcctatatggaccttttgagaaatggcccacaaatctgagagggatagagtaaaaagaggcttaatgtatgtactcacaagttagacctattttgtgtaaaataggtctggtctgccataggtcataggaatgtgtagttgacgttctggagaaagagtcagactagatttgattgggagccactgcggggagtgcgcatacccaaccaaaggtcagtataaaatttctggagatccccttgcttttgaattgatgctgaccgacatggccagtttatctggcaagaagaaaagtgtgacaggccacatacgtggcacaaa

SEQ ID NO: 641687 - DNA, 472 bp, Homo sapiens
  misc_feature (65)..(65): n is a, c, g, or t
ctatcaataggagctgtatttcccatcataggaggcttcattcactgtttcccctattctcaggntaccccctaggccaaacctacgccaaaatccctttcactatcatattcatcggcgtaaatctaactttcttcccccaacactttctcggcctatccggaatgccccgacgttactcggactaccccgatgcaaaccccccatgaaacatcctatcatctggagggtcattcatttctctaacaccagtaatattaaaaattttcatgatttgagaagccttcgcttcgaagcgaaaagtcctaatagtaaaagaaccccccataaacctggagtggttaaatggatgccccccccccccccccccatttgaaaaacccgtatacataaaatttagacaaaaaaggaaggaatcgaaccccccaaaactggtttcaaaccaaccccctggcccccatgactttttcca

SEQ ID NO: 641688 - DNA, 521 bp, Homo sapiens
ctcaagcagtagttgtaactcctgaggagatccttccattttcttgttagctgtattcctaggtattttattctcttgtagcaattgtaaatgggagttcattcatgatttggctctccacttttctgttgttggtgtataggaatgctcgtgatttttgcacattgattttgtatcttgagactttcctgaagttgcttatcagcttaagaagattttgagctgagatgacagggttttctagatataggatcatatcatctgcaaacaaagatagtttgacttcctctcttcctatttgaatatgctttatttctttctcttgctggactgccctggccagaacttccaatactacgttgaataggagtggtgagagagggcatccttgtcctctgccagttttcaaaaggaaattcttccagcttttcccattcaatataatattggctgaagatgtgttatagatggcacctgttattttgaggaatgtttcttcaatacctcatttattgggagtt

SEQ ID NO: 641689 - DNA, 269 bp, Homo sapiens
gggaagctcagtaggagcgtcagagggaaaccaagatcgggttggggccacacactcaggatatattttagaccttcaagtggaagtgcagtgtaagttgttggatatgagagggttggcggcaaagatctcaatttgtggagtcaccgtcggagtctacaatccttgtggactaaactgaaggtcagcgtaggcgtgctgtgatgcacaactggaaacgcttcagtgtttagctggaggaggagtgtgatgaggggctgccagagagg

SEQ ID NO: 641690 - DNA, 235 bp, Homo sapiens
aggattaagtctacgctgcactgtctccgtgtgtaactactaatgattatctatcagaccctggaaaaccacactataaaatagggcactggcatcacaagttcgtttggttaaaaaaaaaaaaagtgggggcggcgggccaaagaagaggtttacctgtggatgatttccatgcccgatccgcagctgtaacattcctatagactggtgacccagcccttttgttcatcttttc

SEQ ID NO: 641691 - DNA, 246 bp, Homo sapiens
  misc_feature (41)..(41): n is a, c, g, or t
  misc_feature (152)..(152): n is a, c, g, or t
cagagtgaatgtcacaatatttcaggcttgcctccagaatntcctacaattttgagttgcattgtgaacgatgggaagaaaatacgtgtgagtgggatggtggaagggaaacacacttggagacaaacttcactttaaaatctgaatgggcnacacaccagtttgctgattgcaaagcaaaacgtgacacccccacctcatgcactgttgattattctaccgtgtattttgtcaactttgaagtcc

SEQ ID NO: 641692 - DNA, 380 bp, Homo sapiens
  misc_feature (380)..(380): n is a, c, g, or t
gtatcaacgcagagttgccattacggccggggggggtaaaaaaaaaaaaaaaaaaaaaaaaaaattgtgggccgcttgggccccaaaaattaaaacaattctggtggggcgcgcggcgggcgcccaggtatgtataagttagacctgcgcgcatctaccgttgtctcctaagaaaaaatccggggcacgagcactacgttgctgggggttctcctaccaaaatataaaaaaccgcgccggggggcgaaccccgggcgcggtttttggaacaaaatttcacaaaatgagcttacagacgcgccagtaacggggatctaaactaaacgcggagacgatccacagcggacctcgaatttaaaattaacgcccgcccgggagan

SEQ ID NO: 641693 - DNA, 172 bp, Homo sapiens
atgtgatcgaggaatcagctcatactgaagatacagagcagttcagtattcccctgaacctcggcccacatatactttgaaaaagatttactttgtgagagacagcatctcactctgtcacccaggctggagcacagtggtgccaccagagctcactgtggccttgaactcc

SEQ ID NO: 641694 - DNA, 1632 bp, Homo sapiens
  misc_feature (626)..(626): n is a, c, g, or t
  misc_feature (967)..(967): n is a, c, g, or t
  misc_feature (1432)..(1432): n is a, c, g, or t
ttccccccgagagcaaaatgatatcttgttcggcggtggtgacatcagatgctgcccccccccccgcggaaatatgtgtcgaatcgacgagaggacccctcttgtgccccgatagagtagtctgttgtgctcccgacaatgatacgatcaacaatgtggtgggaccaccatcattagtgtggtgccgtccccgttcccaacagagttggtggcgaccccagaattgtgtgtcaccccaaaccccccgacgagtgtgtgaaaaccatttgggaatgtgttgtctgcgagagacgatgtcttctctctttgggggggtgtgtcgttctccacccatgtgttgtaagacgccccactgcatagggttagggtgagaaatataatatagtggggggtgtgtttgctgttcgcgcggaccccacaagagtgtcacgcgtgttatatgtgtgtgtgacccgaacaattagcgtgttgggtgtgttgcccccgcggcaataagttttggagaggaagtttttggtgcccccgcaacgagagggtgtgtcttgggcgcccccctttgtctccgggaggggaccctctgtcgaattgttgcgggttgtagagcccccgccagccaccttttgggnccgttcgtgttcctccacgaacggttgacccccaccgccttctcaccggggtgttcgtgagaggccttcttctcggttgtgtgggggcctaattatcgcccctcacactagtgatctcccgcggcgcccaccgcggttttaattattccgcgcccacctttttggggagagcccccggcggagcccacgcccaccgcttttcttttcgctgattttatcccacccgtggggcacacttccgcccctctgtcccacgcgagagagatataaggggcccacacactatattttggttgggcgctttatagagcacacccacacatctccccccacacagtggncttctttgcggaggtggagaagtttttataagacccacgcgagagtgtagaagagagagagccacagagaatttctctcgcacatagccccattcgcgatcacccaataatatagtgggaccttgggagacacacactctgggcgcgcgagagtgatagtgaagagatattgggataaaagagtgtggagagggcccactcgcttttgggaggggaaggtctccctcgcgagtgttactctcgcctcgagggccacgaagaaagaaaggagaatgggttgtaggagaacctgagctgaagggttttctaatcacgcctctctgagatggcctctgttttccctctttccgcagcgagtataacgctatagaccacgagaggctataataaggaatgtgtgttggcgctaccacttgtcggcttccctcccgcgtttctgtctgctgagccacacagttgttgatntgaagcctcgtcgagcgcaaactgggagatcactcctcgcgctcacatatcgaacccttcggcttttccaccccctgagttttaccacacccccgttttttggcttgcttatgtgtaggtgaaccacctcacacccctgaaaactttgaggataacttttttaaaaaattaacccgtatctcttaatccctggatcccca

SEQ ID NO: 641695 - DNA, 1040 bp, Homo sapiens
  misc_feature (323)..(323): n is a, c, g, or t
  misc_feature (772)..(772): n is a, c, g, or t
gcgggtcctgatccggaacctgatcctgcctcccaacgctcaaccggctcgccaacaatgcgccagactctgatacagactgtcgggtgcgagagcctgtgactgtaagctaagaatcaggccttattgtatacatccaagctgaggtcgtacgagctactatcgccaggaacacaaaggaaactcatgcatcagaaaaggtgactaattgaaaggtaccacgaaggaaactatggtctgtcatcgataagtaccacgaatctgtatcatgagtatagaacgaaatcttaggggaatgtgtctgtggagctagcattaaactntacacgagatctcgcttgtttcggactggtgttaaaagatttcatcaacatgataaagctaaagctctgaaggagactcaccctgttcacgtaaccgattgcttaccatgcaatgtaatttagcacagatgatacaaccgagtatccatgagattccacggaatatcatactctcaggagaatgaagcctctggcagaccacgagtcaggagtccttggtctgggcacgtatagaaaaagtcctgatgcgcactgaacgttttgatcgacgacgattgacaggagctgctttattcggaactgaggactcatctgatgtgcatccccgtgatcatgcacgtattctgcatgttcggacatctgtctagtagacttgtctgagcgacaatggaactcgcatgcgcgataactgtgctgcgtatgtaccaggaagtcatcacaaatagaangtcctgatgtgcagtcgaacgctagtcagatgtgaccatggctgcgaccgtgcctattgagtcaggcagtttcggtcctctgagttgccaactaagcatagtgctccaattgtgcctgtgacctgatagggccccgtgtgttgggtgtgctgccagggcaacctgtttccaagtccttgtggccctcgggaacaacaagggagcctttctggggggaaagaaaacgcggcccagctttcctaggaagagacggcgcaaaacctataat

SEQ ID NO: 641696 - DNA, 119 bp, Homo sapiens
tggaaacagttatagtgatttgggtcaggatctctaatgaagtaacaaagatatcagggggggctgcagtcatcgtgaagggtggggagtgggaggatggcttgcaagggtggcttact

SEQ ID NO: 641697 - DNA, 234 bp, Homo sapiens
gtatagatgagacagaatcaccgacaaaaatgctgaagacccgaactgtcaggatgcctcttctccaaatgatcgcagcgtctctccatcaaggtgcacagaactgggaagtagaaattgaaagagaagtgctcttagaaaagttcatcaatggtgctaaggaaatttgctatggcttatatttactgagtttagaacattgtatatatatgtaggtgtatccgtaacagctgc

SEQ ID NO: 641698 - DNA, 431 bp, Homo sapiens
gcgtcgtctctacacggatccccttcatttaggcaatctcattgaccacacctgtctcttcctttattgcagtcactcttattttactagaatgtgggaatcattggcctcttggagagcctaagaagtctccattctgcgttcagctgtattcatttgttgcttttctgtctatattgttagtgttgtcaatgattcacatgataagccatagtttgatgtaatatagtgtgggggcttccatattccacaagtccatgtacaaccatttgcttatgtttgggtatgaaacttattaatcttgcaatttgccctggcttaattcatttaaggcaagtccattggtcgaactgttttgagctgctcttgttgtattcctccctttttattccctttttctcttcctcactttgttgcataagtttttcctg

SEQ ID NO: 641699 - DNA, 125 bp, Homo sapiens
gacagacagcacctcaatctgatacactcccgaataccagataaagaactcctctcgctctgatgggacattggtaaccctattttacatagtgaaattgtgtcatcaggctatagatctagacc

SEQ ID NO: 641700 - DNA, 398 bp, Homo sapiens
  misc_feature (56)..(56): n is a, c, g, or t
gagtattgctaacatgaactttgcaggtaaggtatgtctgtgaaaaatacgttcgnatgcgagataatgaacatctaatacattttgctcatcttcctcaataaactgttttatatcttcgaaacagatttaaaacaatccgatcggttgggtgcggtggctcacgcctgtggtcccagcactttgggaggccgaggcgggcggatcacctgaggtcaggagttcaggactagcctgaccaatatggtgaaaccccgtctctactgggagtgcaaaaattggccgggtgtggtggtgggcgcctgtagtcccagctgcttgggaggctgagacaggagagttgcttgattctcctgggggatggaggttgcagtgggtgccagagaggggcggagcag

SEQ ID NO: 641701 - DNA, 667 bp, Homo sapiens
  misc_feature (24)..(24): n is a, c, g, or t
  misc_feature (64)..(65): n is a, c, g, or t
  misc_feature (67)..(67): n is a, c, g, or t
  misc_feature (70)..(71): n is a, c, g, or t
  misc_feature (95)..(95): n is a, c, g, or t
  misc_feature (98)..(98): n is a, c, g, or t
  misc_feature (100)..(100): n is a, c, g, or t
  misc_feature (110)..(110): n is a, c, g, or t
  misc_feature (164)..(165): n is a, c, g, or t
  misc_feature (215)..(215): n is a, c, g, or t
  misc_feature (227)..(227): n is a, c, g, or t
  misc_feature (316)..(316): n is a, c, g, or t
  misc_feature (334)..(334): n is a, c, g, or t
  misc_feature (416)..(416): n is a, c, g, or t
  misc_feature (485)..(485): n is a, c, g, or t
  misc_feature (513)..(513): n is a, c, g, or t
  misc_feature (524)..(524): n is a, c, g, or t
  misc_feature (544)..(544): n is a, c, g, or t
  misc_feature (598)..(598): n is a, c, g, or t
  misc_feature (642)..(642): n is a, c, g, or t
aaacaatttcttggtattgttcgnaacattaatgcacgcaattatctcataagactttttttcnntnttnnggaaaatttccaattttggttttnatnanaatggcaatncagtaagctacattagagatcagatataatatacagcctatgcagctacatganntatagtttttgctgctttgttattacacaggtagttgcttccttcagctnaagcctggagtnttgtatttcttttatgcatattgggtttgcgttctattacttggcagtgagattgtactcccctgagttagctgtgttcatgtggtcanaataaattccagcatctnacaccaattccattaatcacagataagcttgaataagtgtaagataatagaaaaaaatatctagtgaatggcgaacattgtntatgtatgtatgctattcagtaatacagtagaagagcatcgtgggatattgagtctcaagatgatatgnaactgtctatgaaaaaggatcaaaagtnctcctacatgnaatactttaattcaggcaanaggtgtatgaaccaagtaaatctccaccctgaaagaacttaaatttccatgtgnagccatctttatttccttctttatttccaaataattggccactnagaaagtgtggacatttcatgatcg

SEQ ID NO: 641702 - DNA, 138 bp, Homo sapiens
aaaaattaaaaaaacccctttttttgggaaaaaccccccccaaaaaaaaaaattttttttttttcccctttacccaaaaaccctggggggcccgggccggcccttccggggggggccaaaaaaaaaacccccccttta

SEQ ID NO: 641703 - DNA, 331 bp, Homo sapiens
agcgctgcttttttgctcataagaggggcttcgctggcagtctgtacggcaagcttgagtcaggacccttcaaaactgtcctcaattggctggagggcagatctcgcgagtagggcagcgcgatgaagacattgcttcggtgggtgacgcggtacagctgcccaagggcgtacgtaacgggaatgccgaagcgtgtgacaaaggcagcggcggcggaagacggagatgagctcacgacagagccagaggccaggaagagtaagacggccgcgacgaagactgacaaagtggctgcagtagagggcccagccctgtatgaggaccccccaga

SEQ ID NO: 641704 - DNA, 449 bp, Homo sapiens
ggctgccttctccctgtactcctagaactaagggtagacagctctgcttcaagtgagttagcacagctttttcaattcatacagtattcaaaacaagatgcagacatttcatgttcaaaatgtgatattcttttttgttgttgttgagatggagtctcgctttgtcgcccaggctggagtgcagtggcacgatctcgactcactgcaacctccgcctcccacattcaagcgattctcgtacttcagcctcccgagtagctcggactacaagtgtgtgccaccatgcccagctaatttttgtatttttagtagacatggggtttcaccatattggccaggctggtcacgaactcttgaccttgtgatcagcccaccttggcctctcaaagtgctaggattataggcatgagccaccgcacccgaccctcttaaattcttaaataggtaca

SEQ ID NO: 641705 - DNA, 1070 bp, Homo sapiens
ccgacgccgtgctcgcagctcgcaggcgcctgtgtagccgtcgccaccgacgacagcccgtgcgccctcggctgctgtaccctgcctgctgctcccattcccctgcctgcctggccatgggtgctgctgctctggcctgcccctgtgacatgtgtccctgctgctggctcctgcggcgatggccaccaagatcgacaaagatggcttgcctgtggctggctgtacaaccgtggtgctgctgacgacggctcggccgtcatcttgggtgacttttaacatatgactggctccaccatctgtcccctggctgagcagggagcggagtaccaagcacttcatccagcatgtgcacagatgacagtccggttgtatggccattcgtgcgcttcaccacctggggatgccatgagcaagaggtccaagattagccctcatcacgtggatcggtgagaacgtcagcgggctgcaagcgcgccaaaaccggggacggacaagaccctggtgaccgaggtcgacagactttcgctaaggagctcggagatcctgtgactccgacaggagctggagtgaccgattcatcaagcagcgagcctgaagaagcgcggagaggagccaattacagacgccccagacggacactaaccccaaggacccgaccaaaccacccccttccacaggtcaatctgaccggcaccccgggggacgacggaccgcacagccacagagtacactaaccacacaagacacaaccgagcaaacgaacaagccacgagaaggcagggacacgaacccgtgggcacaacacaacacaacagacagaaatacttagaaactgtacagttccaatcgaggagagcaatgaacgtatatatgaaaataaaagataacacaccccaataaagaggaacagaacggcaaaaaccacaacgagcaacagacaaacacaacaagaccaaggaaccccgacaaggcaaaacacacgagcacagaacagaagaaacgaccaaaacagaaaacagaaacatgagcaccgccagccgcgacagaccgaacacagagaccccaaaaag

SEQ ID NO: 641706 - DNA, 203 bp, Homo sapiens
tatcgagctcggtacctcaaaaactgactctgtcgagggctacatgtcagctcacaacaggttcagtaggttataaaaacaggatggacatctggacagaaactgtagaggcagctgcaggttgtcctttagtgtctgaagctgccgaacatcataacagagactgacatgtagccctcgacagagtcagtttttgaatgtta

SEQ ID NO: 641707 - DNA, 262 bp, Homo sapiens
  misc_feature (8)..(8): n is a, c, g, or t
aatacaangctctccgtaatgctgtggccaaagctgtcctcgagtgcaagccactgggcattaagactgctctgaaggtaggatgggcccgtggcttctctctgataccaggtggcatcccttggagcctgcatgttccctgatttatgtcaaatgatgcagggtgatggaccactgatgcggaccatcacgtgacactgtattggaagtcacgtgcccacagcctccagtgcgcacctgactagtgtgcgtgaaccagtgg

SEQ ID NO: 641708 - DNA, 129 bp, Homo sapiens
tagtgccatgtgaatatgggggtacacaactccaagtgtaacattaattaaaggcttgctatgtactaagcactcttctaagttatcacctgtattgtctcatttaactttcacaatggccctatcggg

SEQ ID NO: 641709 - DNA, 572 bp, Homo sapiens
aggtctgtattttattttattttatttttttaggtatttccccttaatttttaccctataattactactctcactttgttctttcttccctgagacttcatagggcagaccaaattgtaatttcccttggtgtagtccctaaaatgtttcaagacagtttttctaatgttaggagtccttttttgtcaagacccatcattgtcaatttgtaaaacttgttcctttgaatttcttgagggaaggggcttatatgcattattggaagagggagaatgctcagcaacctgttttccttgaatcttcaggagggttacataagaaggaagcagaaactgtaattgaacataagaactgtggcaacacttgtatatatattgcagagcgccttggtgggtaaaaggtttagacgattcttgtcactctagagtaattttatgatgaagcggcaccaaagacacgctacacagcactcacaagtgagtttatattctattatatcatatattatgttcattcttatggcgtgacaaagaggtgatgtccacatgttctaaacaaaaaaagaaaaaaag

SEQ ID NO: 641710 - DNA, 420 bp, Homo sapiens
  misc_feature (225)..(225): n is a, c, g, or t
agcccaggggcaatggtttgggtgctcacttcccctttaggtggtccagggggtggaggcccctaaaaaaagatcagtaagccccagtgtccccccagcccccatgtttatgtgaacatgcgttgtgtgctgcttgctttggaaactgggcctgggtccaggcctagggtgagctccctgtccgtccaaacccaagatcagggttgagggtaaggaaaaaaaaancctaggaaagctgggcccaaaattggagactgtttgtctttcctggaaatgcaaaactgggcccgtggaacaccagtgtcagcatcaggggggaacccttaaaacaacagggggggggcccaggcccccaaatttttcttagggccccacccaggaaaaatggcggtttttaaaggagaaaatgtttgggcccca

SEQ ID NO: 641711 - DNA, 451 bp, Homo sapiens
  misc_feature (36)..(36): n is a, c, g, or t
  misc_feature (118)..(118): n is a, c, g, or t
aataataccaatttttaagggggcttaataacaccngtatattttaggttttaggttccctaataggcttccctgtctgaaatagtctccagtggcctcctagaggaagattacattncattaattaattcaacttcatctgtggtgattttgcattttaaaatattatgttgttaacattgccaaattatttagattcattatgtcagaatatcctgttttctcttaaaccttatttagaaatattaaattttaatgaaaaaatcagtaaaacccattttatagatttaaattaagaaaattagagatctaattattttatccttcatttcctatattgaagctattgtgaaatttattacagaaaatgttgaggcttattcaaaatactccaaattattattctattgtctattttatgtccacttaggatcactttttaaaggaaaac

SEQ ID NO: 641712 - DNA, 998 bp, Homo sapiens
gctggggagctcggcatggtggtccccggtgtagccatggggccctcgtcgttgggacagaggcggcccggttcgatggccccgtggtgctcaggtgagcagcggccgtcgggctacgtgcttgggatgcaggagctgttccggggccatagtaggacgcgcgagattcctggcgcacagtgccatggtgcgactctggtggcctggagttgcagacgggcgtctgcctagctctcgagggtccttctgacagaggagggccacgggtcttcttgtctggagaagggaccggttgtgtcacaatgaaacaacaagtttatcggaggcaccatggggataggttgtggaccagactttgttggctagtccaacgtaatcgctgatcctattgtgtgtactgtgcctgtcacgcgatgataaaaggcatgtcgcttctggtgatgtgaggacctacaaaagtgtattgactattgtggaacactagaggggagaacattgatatctgtgggagtgctgatgggcaaatcaatatgctgtaggtaacaaggatgatgtggggatcttgattgatgcaagatagacgttctgagagaagaagatacagtgtaaagttcggggatcaggaaatgtctctgtgaacaatgaaaatagatatgttcttctgacagaatggtagtgtgttgtatccaacatctacagtgagccaggaatgacaggcgtgtgtcacgtccgaacattgacattgttttctaatggatctgtatcgggtttggcccatgcggaattattttgcccggaagtgctgtgcttgtgtccgcctgcgaggtgacgcgtagggttgacggggcttgcggaagaatagggggaaaggccgcaaatcagagagaatcgcaatgtcggggcctcaggaatctggtgctcgcaggggccgaagaccagggggacgtgccttaagcagggtagccaaggctgattcataaaaaaaaagaggagaagaa

SEQ ID NO: 641713 - DNA, 211 bp, Homo sapiens
aaactacaacatctgagataataaattcactggatgcaattaacagcagattagacactgcagaaaaaaagattatgaaacacaaagccgccgggcgccgtggctcaggcctgtaatcccagcactttgggaggcggaggcgggtggatcacgatgtccagagatagagcccatcctggctaaaacagtgagacccccgtctttacaaaaa

SEQ ID NO: 641714 - DNA, 453 bp, Homo sapiens
  misc_feature (424)..(424): n is a, c, g, or t
ggggtcttactgtcacctaggctggagtgcaatggcatgatcatggctcactgcagccttgacctccccaggctcaggtgatcctcctacctcagcctcccaagtagctgggactgcaagtgcatgccaccacgcccagctaacttttgtattttttttagaggtggggttttgccatgttgaccaggctggtctcaaactcctgggctcaagccatccgcctgcctcggcctcccaaattgctgagattgcaggcgtgaaccactgcacctgggccccattttcttacatttaaatatttacgtttacctacatgtttttttaatgtgggctagtactgttccttccccccaccaagagacatattgggaaatataggagttctttataggttattcaccgtggattgaggaagttcactaantgggtatttcatttgcttcaggaaggcca

SEQ ID NO: 641715 - DNA, 402 bp, Homo sapiens
atagaaattagaaaatagtcagaggacaagcttcatacagtatgtatgtaccagtggaacgtacaagtatagtttcagagtaaaaagtgctacagtaacaaacccacatttaagaaagagacttagtcagagaaacaataagacaaaatcaccaacacgtagtacacaacaaatatatgtctcagctacatgatctaaaagttaaaggtcccaggagccccatcctgaacttggaaagtgtagccttcagaggtagtttctggtacaacgtatagatcttcctcttcctctacagagaaatacttctcaattaagcttaacgaagccttatacacagactcatttacatggttttgtagagcttcaattatgtctaagcctccacaatctgtcaatcataat

SEQ ID NO: 641716 - DNA, 368 bp, Homo sapiens
gtagcttctccggccgcccgccaacctcgtgccaggcacctcaccatgccggatgttagagcttgccggatggcgcagttgcccgtggtgggttgccagtgtgcccaggcagcattccgaggatgttacgttgggcaggggaattcagagtctggcagaggaggccctggggtcgcacgcggatctcctggctgctggtttggtaaggtccaatgtccgggggtaaaggatctaggccgtgtggtgagggttccggcagcttgtcctccgggtggcagaatctgatatcacggaggagggtgtgctggtcgggacttgttccctgttcccggagggagcgctttgggaactgacggttcagtgctgag

SEQ ID NO: 641717 - DNA, 646 bp, Homo sapiens
  misc_feature (1)..(1): n is a, c, g, or t
  misc_feature (138)..(138): n is a, c, g, or t
  misc_feature (371)..(371): n is a, c, g, or t
ngaacttcgcaatcagggagactgcacactgagctcgtttggcaaacggagcctcccttcatccggaaggtcatcgagcttggcacagggcaggcagctttaccagcagcttgcaacaatctgtaaagcagcttaatncctttagcaaagaaaaggagtcccgggcattaaagtagatggtctctggcaatttcaaataagtatttttcaaaaatgtttctcaatgtcataaaagcagtcacatcacatcactctgggtctcaccatccggggagggttgggttgtcatcttgtgtgcaagaagcatcaattctctcaggttcttgtttgcacagcagtcagccattcacattaggttcacgaagagtgcnacttgtgcatatttgtctccaaaaaggtatgagtgattgtcacaatttcagctgactcatcagcaacacatgttttgcaaatcagttcttcattccctaatttacatgtcttcaaatgacactgctgagatctgagcaaggcatccacacaaggcttgaattttcttctcccaatctttaacgatgacacctcactctgtggcactgacgaacccccctgaataacgagctaaagagaaaagaaggaaataagggtaccccttcatggccaaagc

SEQ ID NO: 641718 - DNA, 998 bp, Homo sapiens
  misc_feature (44)..(44): n is a, c, g, or t
  misc_feature (62)..(62): n is a, c, g, or t
  misc_feature (74)..(74): n is a, c, g, or t
  misc_feature (85)..(85): n is a, c, g, or t
  misc_feature (87)..(89): n is a, c, g, or t
  misc_feature (91)..(91): n is a, c, g, or t
  misc_feature (98)..(100): n is a, c, g, or t
  misc_feature (195)..(195): n is a, c, g, or t
  misc_feature (233)..(233): n is a, c, g, or t
  misc_feature (275)..(275): n is a, c, g, or t
  misc_feature (313)..(313): n is a, c, g, or t
  misc_feature (320)..(320): n is a, c, g, or t
  misc_feature (329)..(329): n is a, c, g, or t
  misc_feature (358)..(358): n is a, c, g, or t
  misc_feature (368)..(368): n is a, c, g, or t
  misc_feature (384)..(384): n is a, c, g, or t
  misc_feature (524)..(524): n is a, c, g, or t
  misc_feature (578)..(578): n is a, c, g, or t
  misc_feature (626)..(626): n is a, c, g, or t
  misc_feature (929)..(929): n is a, c, g, or t
aaaaaaaaaaagaaaaaaaaaaaaaaaaaaaaaaaacaaaaatnaataataaaaagattganggcaatataatnaaacaattttnannnanataaagnnnaaagtggctgaacacaatgattagctcagacttcactttcacaagaaggctatttttggagttacatattttaattgttgataatgaaggctgtnacagaaagaatgcccagtcaatatgtaaaatgatagcnatttactataacaaccataacatcatcaggctactgacagcnggagacattccacatgctaagcaactcacctccaaagncatattngaggtttgncatgaaaaatacacttgatcctgttattnatttagacangcctcactgcacgtanggctacagcggtcaccaggacacaaagcaaatgtcgggttaccagaagtgcagttatcagccacagtgatttattgagtgctttaataatacaagtgtacatcaactgatccacagtcaaaagtggcaggtccctaaganatttacaagcactttaagtaaatcaaaatacatattattttgttcaatccaacngtcttctgcgggagggacagaaggctagtgataaacagagtctcagtnatgcacagtgattctgattgaagcttttgtacaaaaacttgttcccagtagcatgcacccaccaataaagacttcagtacaaaaaattaaccctaagcactacatttaagtagaaacgagatataattctgaatgtgttttcccaaagatcacataaaagaaaaaaaaatcaaaatcaaataaaccacgacaaaaaaaacaaaaccacacagtaatacaaagctttgtaagaaagctcttactattacagctccaacattgtttgcactgaaaacaaaagttcccatctatgatgaggtgggnaaaaatcccaaatctttcaagttaacagatatcaacaagggaataaaatgagagataaaagagagcgtg

SEQ ID NO: 641719 - DNA, 106 bp, Homo sapiens
tgcaaacacgcaatctggaatattggcagaattattataacgtgacacagagaccaggtgctgtggctcatgcctgtaatcccagcactttgaaaggctgaggtgg

SEQ ID NO: 641720 - DNA, 207 bp, Homo sapiens
cacacttcgatcgcggagaaagcaagcagcgagtcttgatgctctgtttggtgctttggatcctttctgtcggtccttacagcctgctcgtcagactccagcagcctagatggtggagcagatcgagagcgagactgcttttcaggaagccttggacgctgcaggtgataaacttctagtagttgacttctccgcgatcgaagtgtg

SEQ ID NO: 641721 - DNA, 567 bp, Homo sapiens
  misc_feature (408)..(408): n is a, c, g, or t
aggccttgtcttagctgtccctcgcccctgtaatccatttggggttcttaaaatcaattatcagcttacatcattttggatcctacatctttctcaccaaatttgtctcgcctcattaaagttctgtcagatacacttcaatggaaacaatgatgttcatctagattgaaaacttttctcagatggattgataaccgcattcatcttgtgttttatatgagaaggtgcctcaagaatttcctgttggatttgtttaaaaggatttttatctttcgtgataaactttgctgtgttccaggaactataaaaacaaaaacttgttactaaagaaaatatctgaaatgtgataagtttttatggcatgttaatttcccgccccccctcccccccccccccgcaatatttcantatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaaaaaaaa

SEQ ID NO: 641722 - DNA, 772 bp, Homo sapiens
  misc_feature (219)..(219): n is a, c, g, or t
  misc_feature (285)..(285): n is a, c, g, or t
  misc_feature (364)..(364): n is a, c, g, or t
  misc_feature (614)..(614): n is a, c, g, or t
  misc_feature (661)..(661): n is a, c, g, or t
  misc_feature (688)..(688): n is a, c, g, or t
gactgtcgccatgaacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcagaagagcaataagaggagaaagagattcctattgaaggactggagttcatgggccatggcaanagaaaagcctgaaaattcttcttgaccttgacagtcaccttgaaggatttcgcaagtccagaaatngaggactctggatttttgtcaactaactctgtgaacatagccatcagatttgatgaggaacttaggagagaggagtttnatttcctccttcgatgtgtttcctctcagttgtaaaagatgaactcttggagatgatttctcacctgctgtggtatcttgcaggaactgtgtgctaaaatttgaacaatttgttggagattatggttgcaatacttggcggtggaatcagctttacataaatatacccttgtatgcaaacgatgataaactagtcaggatgagcagagctgcctgacctcttgatttctgctgcaaaagacatatacagntgtactggggtcactatttatgaaaagcaatgggttaggacctcttntttcctctcagggaactaatgctctgnaaagggatctgggacacagacagttatcggtgagtgctttgtgagcatactttcatagtagatagtaagtaatggttaagattg

SEQ ID NO: 641723 - DNA, 138 bp, Homo sapiens
  misc_feature (3)..(3): n is a, c, g, or t
tgnttttccgcctcgacctcgtacggttgtactcggtgtccatgaagacatacatcgggtcggcgaagtaggtgtaggtgcactccttcttgtcgaggatgatctgctccatcttgtcgtcggccttgaacaccagtt

SEQ ID NO: 641724 - DNA, 441 bp, Homo sapiens
tttgttgtttgctgtcctgaaaacatgaaagactaatagatgccattttggtcttacaagttggcttatttgaaatttaccttttaaattaagctctaacttcattgtgggtcacattggtttttctctatattcactcttgtttatttagagagaccagggtgacaggtcttctgaagctaccattggcaaagagtaaggttatagaatttgctggctagtcactgttagataattgctctttgtgaagacattactttgaggccaaacagaaccagggatttaaaactggtccagggacaaggtgctacagtctcaggctctggaaatgtcagtcatttgtgtgttccaggtgtacttttgtaattatgtatgtgagagatatgtacataattgtctgcctctcaggaagtaggaaaactagaagatactatgacctca

SEQ ID NO: 641725 - DNA, 119 bp, Homo sapiens
tactgattgaatctgtatctgaacaaaggtgattttgttatgagcctgggactcaagaagaggccagacatgaggtcgaacagtacagagctagtcctgctggctctgatctgaggcag

SEQ ID NO: 641726 - DNA, 369 bp, Homo sapiens
  misc_feature (27)..(27): n is a, c, g, or t
  misc_feature (75)..(75): n is a, c, g, or t
  misc_feature (113)..(113): n is a, c, g, or t
aatggctgtagataccccaaccctggnaattaaaaggaaaatatattaattcaaactctatggaaacttaatacntctctctaccaggaattggcttattctgtaaattttcnttttgagagtgttgcccaggctgcagtgcagtggtgcaattatggctcattgaagcctcaaccaatcctcccacctcagtttcctaagtagctgggactataggcacgtgccgccacagcccactaatttttaaatttttttgtagagacagggtctccctgcctaggctaatctcaaactcctcgcttcaaatggcccttccacctcaccctcccaaagtgctgggattacaggtgtgacgaccatacgtggctt

SEQ ID NO: 641727 - DNA, 835 bp, Homo sapiens
agttaccaaggaagttgtgggaatgtgcaacaacaagccgagagactatacctagcacagctggattgccctcacacgacgtccttcgaagactgttttccatcacagacacgctccttgcgcacctcatgatacttgccatggaagatacaattggccagatctgctgttttctggaaggattcagtgactctgcatttcgggaaagcacaatggcagatcacgtcgttagaccaatcgacaaccaatagagatcatttgcctaagtattctgacggttactaatatacctgtctttagttcctgtgagcccaaccagtaattagtaaagaacactttcccttttaaggaaacaaaagtgtgataccatattgtttttactgtacatagctgtgcgctttcttgcctgtcctgcctctagtttctacttgctggatgataccatcaatgtatcaaggagcgtccatggatacaagataagatgtcgtaccttagtagaatacagagctttggtaattacatgtaatcagcttaaggaaatagccatatacaatcaaatacactatgccatttttatttgaatatgatgagtatattttgcttcggacataatataggaaggaaatgctcatagtaagtagtatggtatcagttaattccagtctgagcttctctgttcaacttcagtttctctctcagtttaatgatttaataatagtccagctttttgtgtgtgtttcttatactgcacattaataatgattcacttcccgtttggaacagaatggtttgcataataatggtaagagtgaatggcaccatacgccgtacctaa

SEQ ID NO: 641728 - DNA, 1052 bp, Homo sapiens
  misc_feature (985)..(985): n is a, c, g, or t
gggtacttgtgtggaaaatagtcactttttcacggctatttatatattgctgcccagtaacactatagatttgctatggaagagtgttcttttaacctaatggcttctagttgtacagtcaagtgtaattttcatcacaactatgactttctggtatgttaaattgtgtatttaaagcagctacaaagagagttagcgaaattaccgtacagtgtctgtagtctagtagagccaagtcttgagtggtggtgtgtggcattatgtgctcactttattggagcctgatgttagatttcttgtagcgatgctccccctaaattggaaatagtgagtgtagtaaatattcagaagcgagatccgttttagcatttgaacctaaccaaggaaacgggccacacgaccttggttaaagggatgttgtgatcagcttagccttccaggtttttaagaaagtgcttcctataactgctgtcaaccatctgtcattgtctttaatgaaacactgttgtatcccagtcctaattctttgtaccggcaattattcgtcaggaacacgttgctcaaaatatgtgctaatgcaagtttctctaattggggggcataatgtactaaggaaatccagtgctgtatattacgaattagattgtaacagtgagtccagcagggattatccaaacaaaggataggtttgatgagaaaggctggattaaggagaaaaacaagtaaagttgggtatcgaaatctggtgtgttaccccagagattagggggggggtaaaaataagaaaaaaacgggagagagggcaaattcaacgggaaataatttcacagggacgcgggagaagggaaaaaatcggcacgacagtggtgtttatcaagacgcagcatagaaaaaaattttaaagggagcggtccataaaatggaataaaatcttcctaaaattgctgatagaacacaaaaaagtggcgcgacaagagggcgaggntcaatgttctccttcttgtttctctttcctgttccttccctctcatccgtgtaagaggggggaggaa

SEQ ID NO: 641729 - DNA, 322 bp, Homo sapiens
cgggcctgtgagcagaggaaccttggcgacatcatcgaatcttggagtactcaagcaagaagaggctgcagcaattgaaatctgagcttcaggagtgggaagaaacgaagaaatgcaagatgagctatcttgagcagcagcgcagcagcagatgaatgccaagcattgagcaagcaccaggcaggacgtgaacttcctgagcacttacatggaccatgcagtatccatcaagtctgtccagatctccaatcttatgcgcccactgcagcgggttcaggcccgacttgatggcatactcatggtccatgtaaggggaccgcat

SEQ ID NO: 641730 - DNA, 188 bp, Homo sapiens
cagcgattgcatctgcagatggtaatgaaacttgagtaaggcttgtgttgtggcacaaaagacaaggtagtattgtagaattgtgacattcacactagtggaatggccatgacaacaatttatcctgacattgatccagcagccgaataagcctgcagagaatggcgactcttggcagacaggtgtcc

SEQ ID NO: 641731 - DNA, 105 bp, Homo sapiens
gcaccttactaccagacaaccttagccaaaccatttacccgaatcagtataggcgataggaattggaacctggcgcaatagatatagtacccctagggcaagatg

SEQ ID NO: 641732 - DNA, 157 bp, Homo sapiens
aatcaagcacatggggcaatggcaccagcacgggcagcagctggcacctttttgtccaacaacatgtccctgatctcaatgaggggcttctttttgaacacaaaacccacattcccccggatatgaggcagaagtttcttcagagctgggttgtttt

SEQ ID NO: 641733 - DNA, 441 bp, Homo sapiens
tccgacccctcataatgagtgcccagggaccttctggacagaaaaggacgggtccctggtgaagtccctatcctcaagccaaagagcctggaactgcagcccaaagtgagaacttatgctcctgttttctgctccaatgttgccttttccaaaaccacccatggccctgcccccaacccccatcctgtgcctataaaaaccccagagctctgccagcagaggggagaagcagctggacatcggagactatggttggatgtcggaaagaagcagcttaacctcggagggacagtttgatgatgttgctttggagaggattctggccaggacggctggactccaagggaacattaccttcctgccctgtccctttttcatctccccttcgcgctgagagccactttcaccaggaataaaatcccttgcatttaccgtcttcag

SEQ ID NO: 641734 - DNA, 535 bp, Homo sapiens
  misc_feature (13)..(13): n is a, c, g, or t
ggatcgtttaggnccggagtttaaagcccagcttagccaccagatccagacccttgtccctacaaaaattaataagctaggtgtggtggcgtacacctttggtcccagctactctagaggctgaggaaggaggaggattgctggagcccaggaggttgaggctgcagtgagccatgactgtgacactgcactcctgcctgggcaacagagtgagaccctgtcttaaaaaaaaacagaaaacatgaccaggcatggtggctcacgtctgtcatcccagcactttgggaagctgaggtgggtggatcacttgaggttacgagtttgagaccagcctggccaacatggcgaaaccccgtctctactaaaaacacaaaaattagctgggcgtggtggcacacacctgtaatcccggctactcaggaggctgaggcaggagaatcgcttgaacccaggaggtggagtttgcagtaggccaagatcgcaccactgcactccagcctgggagacagagcaagactccatctcaaaaagaaac

SEQ ID NO: 641735 - DNA, 358 bp, Homo sapiens
cagtgtcttcaagatatctggactggaatgaataattattcactaccttatttatttgctgtgaggcgagaataattccagaacacaggcctttatactttcacagtaatttatgttcaagaagatatatagtcagtgcattttttttgtttctttcctctgtgcaatgtttagctctcaccccgactcccaagtgccataatttgaaataatactggtttggagaattattacagattggtcataaatgccgcataatgtccgtaagacctcggtaaaggtttttccaaatggcgtagtagtgcactgcagctgtcgtgactgggaacaggtgtcccgatggcgtgggcaaatggaa

SEQ ID NO: 641736 - DNA, 370 bp, Homo sapiens
tggtggttgactcttgtgtatcccccgtgtgttgccctactcccacacacatccctgcaggcccgtgtcaggccttcgatcaccctggtcgtccgcggagagtcgctcgtcctggtgggcccctgtagtcgtgcgaggtgaacagtctgggtgccgtccagcaaagaacagtcgtgatggtatctgaacaaagtccccaacgcttgagtggtctcattgcaggtctcagatggccgggacagtgtccatgaggggcatcacatccgcagggttgtggaagtcaatgacatggacgttgaagattagcacggcagagccagggatcttgtctccagttccattctccccataggcgaggtgcggggggata

SEQ ID NO: 641737 - DNA, 1840 bp, Homo sapiens
gagcacgcgttcggtttcccttgggcagtccctgtcacttccatttccccccattgtctcagatgatggctgagaactcactagtttgtgcattcttgtgactccacaactcacccaagatccctagctatgaactacatcttgtcctcatgtttctttcaccgacaatgcgtgcataccataaagctagcatcgacctatcatgttctacatccacacgaaggaagctgcctgacacctaggaccatatcgacagcacagggaatccctagcattatgtccccttgtccactctgacctgcatgcagtaggtcctctagcctgtgccacagggtttatcatacacacttgaaaaaccggctcatattctcatttatgccttgcattgcaggggtcgaacaaatggcacagcgtgataacccagacgagatagatcacgactggcggtccaccggcggctcaacgagcaaagccacttcctggagcgaaactaagacgggtgcacctacgacatgaaattgccgtacagggaaagaacgcagaatgacactacagggacaaaagcaaagtaaaggacgcaaggaggcgagaccgttgcacgacgagggagagagcgtggaaccaatggaggtggccaagtgacgacccaacacgtaatggggccgaagcacaggggcaccaacaaatgcaccaaaagagagagcatccccagggggaccaagcggtagaccacatgacaccgcggatggtggcattacaacgggaggcgcagaaaaaagggacattagacaggtccgcagggagtaacagcggtcatccaacagcgccatttggtaggcgatagaaatgagacgacaccaccagcagacgcacgcgcccatcagtagatgaccccaattatgtagtgtgcaaaatggctggtgtacagatttcacttggatatgagcttcgagatgccacgatgaacacgtcaagacgagtacctcggataatggaagtgcaccaccgatatgagacagtgcacaaaatggtccacaattggtcacaaaggtggaggagaagcagcgttgcacactgtggttgcagacgtgtcattggcgatcggaatacaccgagagaactttctacagttgtacctggacggtgctgccacagctcttacatgtcataggtgaacacgaaaaatgatggggaagctagaacgaaaaggggatatagaaacagctggcgctgacccgcagtagagggctgaacccaccatgggtcacgcctagggcaacgagttagcgcacacaattagcatagatggccgaaggagagcaggtgtcccagaaggagagcaacagcgagcgacgatgttaaccacactaggagagagagggacaaccaccaaaggaggaggaaccagcacgaggacaagactacacagggcgccatacgggcgacataggaaacgtcggtgaggaagagcctcccgacgagctgtgaatcccgccgagtagtgcaagggcaacaccaaagaacgagaccagagcagagggagaccaaaaaaagaaagcaaaaaaagaacgggagccgcagcgaaccacgggcagagcagaacgacagcgacaagaggaaagcgacacagagagtagaggagagagagaagacagcgcgagagacaagagcgacggcccaggggcgatagaccagcccagcagggcgaccgcgtacgtactaccaatcacagcgacgaccaagacacgcaaggacacagcccagcagcacgcctgcaagcaggggggcgcgagagcgggcaggaagagaacgggggcggagccgggagggagacggaggg

SEQ ID NO: 641738 - DNA, 205 bp, Homo sapiens
cggaccggggagaaaaaattttttttcctccccggacccgcccgaaaatggggtttttccaaaaaaaaccccctttttttgtttcctttttttggggcccgaattttttcccccccccccccgggggccccccccccaaaggggggggggggggaacttttttttataaaaaatttttttttttttttaaaaaaaactcttccca

SEQ ID NO: 641739 - DNA, 261 bp, Homo sapiens
  misc_feature (164)..(164): n is a, c, g, or t
  misc_feature (238)..(238): n is a, c, g, or t
ggcgcttggcccccaaaagggcctggatcccagttaactctgcagcacctcggggcatctttcactgttgaggagggaaatctgcttcacacttaattaacaaatccagatctcacactgctattaaaagaagttatttcaattaagcccaggaaattggaggnaaatgccaacaacgaggcaggacatctgctgccatttgatcgttccagggcagccagcaggcaggagggttagnatggaggccacagccacactctg

SEQ ID NO: 641740 - DNA, 154 bp, Homo sapiens
aagaggatcccccagcttatgcgtgcggtaagggtgattaggttctaatgagatggtcaggggtgcatgatcggtcaccaagagagggagtagaggtatcttatacttgtgggttaaggtggggggatacaacgaggagggatgccacaggagg

SEQ ID NO: 641741 - DNA, 774 bp, Homo sapiens
  misc_feature (378)..(378): n is a, c, g, or t
  misc_feature (658)..(658): n is a, c, g, or t
gggtttctccttcaggggattctctaaaaacacggcctacactttatgaaaactacatagtattcaccggtgacaggtaaagtttatcactattaattttatgggggctatttattactttccagtggctttccacttagaacaagctaagagtaagggctggctaactttaattcctggcctggattttatggtacaggtggcacaagcacaatgggtatgctggtatatagaaactaaaaatactatgaagtacataagttccctagggttatgggagagtatttataattaactttatgggtagggctagtatggaatacctttttaacaatggtggtggctattacaacaatggaagattcaaatggactccgnttggaaggatggttctctatatgggtaacaatatttttgaagaagtctggatcacgtgaagatcactggatcagaatactccactgtattcgttcacattaccactaagcatattatcagtaaacctattaactgatggacatttattgtaatacgtggtactttggtcgaattcaccgaaagtcctcccatttcatactactaattttcaagtggattccggtctaccatcctggggagttcttataacttggctctgtgatggcaacatagtgtacgnctcgtcaagggtaccttcattcaataataacacgtgggcacggggtcaccactttacggtaacatttttacacctaacccttcttttcggaaggttaaatccagcacttggggaaa

SEQ ID NO: 641742 - DNA, 933 bp, Homo sapiens
ggctctcgggcggcgggagtagtgcgcagtggataggcagccagtttcgcgactgtagttggggcgcgcgctccggagaccccggggacgcgccatcaccggagggcacccgggcatcgcggcctgtcgccggctggacaaagatggctccaggacggagggtcaggcccctgtagaaggcagccgggcagacggaagcgcgcccatggggacgatccggcagcggagagcaagcatagagactccggcgaaagttgggcaaagctgcgcccggagaaaagtggggtcgagggagggataatcctccaaggcaacagagcccgtgcgaagccccaagcgggggagtaccgggggcactcgtgacgcggaaaaggcaggcacgagattgtgtgctcacccgaaggaggattgggagaaggacgttaaacttgtggaggggccggagggggggggccgatctccgagctcgcagggggccagtccggaggcactcattgaggcgaccgtccggaatcgatagataaagcgctgtggtctgatgtaggatgacacgcgtatggccatggcactttgacagaggtgggtcgccgtggcatcaccgtgtttggtgacaagtcgaagggggacatatcggattcaccttatactgcaatggtggcacgccgtggagacgtcagatgcaagaagagcatctgagcgagggggcggaaacccgactggcgtcggcagtggccaagggggaagatgcgttcatcacgaggggggacgcactggcagggcgaaatgttgggcaacaccagacaataggggggcccaggatgacgggcgacctagcggcccggtgcaggaacatgcccaagagggggagggacaccaccagagatacacggggacagtgcgggggaaacgcgcgaaaggcgacatgcggactcg

SEQ ID NO: 641743 - DNA, 157 bp, Homo sapiens
catggaaatcatttcaaatgtgggtaataaaaaattttgtagtacagtgggtgaaccataattttccccatgtcatttgaacaggaaccgatacgatgtcacttagtcccaactgggatcctttacttccaccgcccaaattccattatgaaagggg

SEQ ID NO: 641744 - DNA, 235 bp, Homo sapiens
agggaagggaaaaaaaaataaataatgaggagaactataaggccctggattcaggtttttgaaactgttttttttttttcaaccctcggaggacaatcagcttttcctgaatccaaaaaagcccatcaaaaatgcccaatgacagcccccagccaaatatggcagggcaaactgatttggttttgcgatttccattttcctctccccatccgaaaaatgccttcagctactgcta

SEQ ID NO: 641745 - DNA, 512 bp, Homo sapiens
  misc_feature (512)..(512): n is a, c, g, or t
cttatattttattttattttgttttttgaattttaaatttttgttgtatagactttattttttagaacagttgtaggttcacaacaaagttgagcagaaagtacagaaagttctcacataccctctccccactcccacatacagactccccaaccatcaatatccagcaccagttacaatccatgaaccaacattgatacatcattatcaaccaaagtctaaaatgctcattagcatcctctttgtgtgttgtacagactatgggttttgacaagtttacagagacatatatccaccattatataatcatacaaaatagtttcaaagcactgaaaaaaatcacctctgcaccacccattcatctttctgatgatagcccctggggatgttgtttatataactaagtcatctaacacaacctgttaagagaaagttagattctttctgaaatgggtagatagatatggtagagatggctcccaatggctacagtggaactctggactgatatn

SEQ ID NO: 641746 - DNA, 183 bp, Homo sapiens
accgtgaaaccccgtgtctgctagatatacattattacccgggtgttgtggcgcgcgcgtggggtccgagatactcgggaggctgaggcgggagaatgcttgaacccgggaggcggaggttgctgtgagccgagatcgctccattgcactccagcctgtgcaacaagagcgaggctccgtctc

SEQ ID NO: 641747 - DNA, 534 bp, Homo sapiens
atatacaaagctggggaaaggtaaatacaggttcagtatctatcagtaccaagaattaagtaaacatgaaatttaaaaagcgccaacatataccattcccactttactcttactataagggccagagtcggcagcatcagtcccaccttaactaacagagcaacagcacattaaccacatgcttgacttgagccctctggatagacaaacacatggcaaaagtaacacaaatgagagaatcagggatttcttagataaacagcaacacatatcagataatacaatactttaaaaagcaaagatcaaacatgctactcaatcctacttgatacgctgcctccataaccaaggtaaaagatggatcaaagtaaaacccacaatctgattattccatgaactctctcatccactatttgccatagggtctacagtactataatacggatatgggtggaatagtgaaggaatataatagactttactcaagccatagttcatgtctacaagaaacttgtaagctaacacaatgaatag

SEQ ID NO: 641748 - DNA, 268 bp, Homo sapiens
gcaatacatgtacaggcgcataggaaacatagggacagatactaagtctctgactctccctactactctccttttacttagtagcttgacacaaaaggatagggggccccaggatcatctggacatggatcagtgtcttcatgtgtgagctatacaaagcactggcagcaaaaggtgtcattaacacgtcagcaagtcattcaatcacaccccatcttttcatcacaaagtcatcagcagagcaacaaggctactgtcatggtaaact

SEQ ID NO: 641749 - DNA, 972 bp, Homo sapiens
  misc_feature (246)..(246): n is a, c, g, or t
  misc_feature (282)..(282): n is a, c, g, or t
  misc_feature (289)..(289): n is a, c, g, or t
  misc_feature (369)..(369): n is a, c, g, or t
  misc_feature (972)..(972): n is a, c, g, or t
ggacagtgctgacacttacaaggctctggagctcctgggcacttcgagacatcatgagttggtccttgtcactccaccggaatttaatttctctacattctatgcatcttcttatgttctctcattcaaacatgctgtagccatatgttgcatacgccagaagactgaacatgcatgactatactgtagatgcagaagattcgtgtcagcttaatgtgtcctatactaccattgtggcagattgcnagtatttccgtgttcatacatgtatccaaatcgccnaaacgtnacgactaaaggtactcataccagctcatcttgggaacacgacgagtccttcagcaatctatatgttcgagaagaacgatnacacaatacacgcagagtacgaggaacaggcttgcattacataaatgcaaatcccaaaccttacaccttgtaattagatttccccttgcagtgggaaattcattcgaggaacaccctacatattaattgaattacggatcgggcgtaggcgttaccctttgtagcacacgtttcccaaggggaacaacacatttgtttttagggatccgcaaacaatttgagtgggcaaccattcattggcacacgtccattcttggactttttggtcaaaacaaacgcaattgcgaacgtcccaacaggcttcaatttcccgcaagtcaatttttcgggcgaagggcatcagatctcatcgattcataatttgccatagatcaaatcccaacagaggcattgggtaccacaccccttgagcacacgactgaaacggggtacggccccccaatgccgtatggaagctggccacccaagttggccgccatgggaaagcccttttggccacagaaggaatcaacagaggttggtccaagaataagttcccaattcgaagtacttcgagccttgcgcggacaaccgaatcttggttcaaagaaccaattttgcccn

SEQ ID NO: 641750 - DNA, 531 bp, Homo sapiens
  misc_feature (493)..(493): n is a, c, g, or t
taggtggacagcgaggtgaataagatgaagggcttagcggggctaacccacggttacgagctaaatggtctcctcctccctcccccaattcgtatctggaactcctaacccgttctaactcagaaggtgacggtagtgactgtaagaaggtaattaagttatatgaggtcatctgagggggccctaatccaatacaacagtgtccttataaaaaggcaaaatatggacacagatacatacaggggaaagaccacgtgaagatgcagggaaaggcagccatcggggagccaaggagacaggccttagaacaaacccactctgatcacacctggatctcagacttctaacctacagaatggacaaaataaatttctattatttaagccatccaatctgtggtacttggtaatggccatcagagcaaattaatatactcatctagtactaagaatgaaatatcaggggtataagagaggctgcagggcacaagatnggatggatatgatatctcaatgaattgtcaattatatg

SEQ ID NO: 641751 - DNA, 244 bp, Homo sapiens
ataatgggatgaaatatgagcactataagaatatccacaccttgctccatctggcacttaattggataacatgagattgataactcgaccgcctacagaagaatgtcgaaatatcctagacatcattctttcaatctgatgactccttcctataaactctctggaagatcttatgccataatttcctctatatccgatattggtgactttaaaagaggcacggtaatagaaagacttactcatc

SEQ ID NO: 641752 - DNA, 716 bp, Homo sapiens
ggggatacgacacatattagctatacatttagctgttgtcataagttatgtggctttaaacttagtgttcaccttcctcgtttaatgcacgatcagtctgtatgtaatatctggaaagattacacatactccatgccacctcgacctgattggctatcttgcggccatgtccccttcttgctgcacacaggactgaatcaaagtagttgagactttgtctatggagaaagctgtgtaatctgttctttatctccccttctcacggaccagtcagccactggtcaatcaggctgatcatggaacatctaggaattctccaattaagggagcataaagtccagggacttagttatatcttcagaccagtgcagctgggacacacaaagttctcctgtctcaccatctgatatggtttggatgctcgtcccctccaaatctcatgttgaaactgtaattcccagtgttggaagtggagcctggtgggaagtatttggatcatgagagaggatccttcatgaatggctgcagcaccatgctccttggatgagtgagtgagttctcactcaattgcacatagagtatggttgtttaaaagagtctgagacctctcccctctttactcggccatgtgatacgccggctccccattcaccttccgcctttactgtaagcttcctgaggccctcaccagaagctataacacgtggggccagctc

SEQ ID NO: 641753 - DNA, 172 bp, Homo sapiens
atcaagatcgagtcgaggaggcgggcataggactgtctcggatcgcttcgtcaaacactcgtcttgagctcctccagacagctgtgagcgccgagcactccaggtattttacagcaccaatctccttagccatggctagaccctgcggataggtgatgggagtcagcttctt

SEQ ID NO: 641754 - DNA, 677 bp, Homo sapiens
  misc_feature (490)..(490): n is a, c, g, or t
  misc_feature (677)..(677): n is a, c, g, or t
gtgttacatggtattttctgccctacccatccctcaccggttctcatatattgtcttttccatgacctctttacctttgacagagtctccctttgtagaccgggctggtgtgcagaggggcaaacaaggctacctggaacctatagcttccaggtacaggtgattgtgccagctcagcctgccgagaagctgggactacaggcacaagccaccacaccccattaattttttatatggccagtagaagcagaggttaaccatgttgactgaactccgtttgaactcctgagctcaaatgattctggctgctaccaaagagctgggattacaggcgtgagtcactgcggtgctccagggctagatatttcacacatataactaatgaagcgttcatatctagaaactgtatggagtttctattaagcaggacgggtactatagtctaccacatagtagatatgctctcaaaagatatctaagagaccagcangatgcttaacatcactagtcatcacgaaaatgagcactaaaacctcactatgatactattactggacacctgtcagcatggctaaaaattagaactttgagatatgcagggttgtcaaaatattgagcaacaggagtgcctctacatgctggcggtagccattagtgtgataacccctggttttttn

SEQ ID NO: 641755 - DNA, 421 bp, Homo sapiens
ctgcatctgcttcagggaagaacttggcgattgggccagaaataccatcagcggttacctttaaccaagctaagccctttgcgccaaagcgttcaatatattgcgcaagttgtcaatatctttacgtgagtagtgcgccgcaccaccaggaacggcaatcgctttgacaactccaccaccatctttgaccgcattcgcaaagacaccaaattcagaatccttgaccgctttcagacaaatccttaagttcgtagggaatacgcaaatcaggcttatccgtccaaaacgcgtcatcgcttcttcccaagtaagtgtttgaattgcatcagtgtcaagatcataaccgatgacatcatgcatcatcgtcttcaccactcattcactaaggccgatttcatcagccgcataaatgatgttctag

SEQ ID NO: 641756 - DNA, 572 bp, Homo sapiens
gggcgtacggccgaattcggattattattgggagtaaagtccttgaagagaatcctattactttttacactgtgcttgataattttttacttggaaacctcatcttttggcgtttttttttttggagctatttctctagtgtggctattggatttaatttctgaccttcattttggttcccaaccttttttttggttggatagtgaggggttccgtgactggaggttcttgagctggctgttggatggtgctatacctccttgcaattctcagctatcaagggggaaaacaactggcagaggatggggaaattgctatactggccatgcctgggaaacacccacgggaaaattaccagtttggagctggctcaactggcaagaaaacactggagggagacagaagcagccagggacaacaattaatcaacagagggggcacctatgggtgagagagcacacgactggtgactctctggaccaagagaaacgggtggctacatcagctcccgagaaatcaccaggtcatgaacagagggaacaattcatggacagatttttctccagagaagg

SEQ ID NO: 641757 - DNA, 152 bp, Homo sapiens
cgggttgggatgagtcacgtatttaagaaatgaggaacagcatttcagggcgagaaaagcatagtgaagtccctgaggttgataggcatagagcagatttaagggactttttttttgggagacggactttccatcttgaggcccaggcttgg

SEQ ID NO: 641758 - DNA, 1171 bp, Homo sapiens
  misc_feature (315)..(315): n is a, c, g, or t
  misc_feature (376)..(376): n is a, c, g, or t
  misc_feature (563)..(563): n is a, c, g, or t
agcgggaatcccaggtcacgttgggaggcctgggtcgtggcggatctctacagcggcctcacatgacctgataggcaagagatgaaccttcagtcgctcaaggctgcgcaattctacttcctgtgcagagagacgctagtgccatctaggcaaagtcatagagcgcccagcccgggcaggggactactctagcgaagccggacacacgtgcagtctgaacgcgtttgacaacgttagtgcaagacgcctctcgacagatcgtagcatacctccgaggcagctgacgtagaaccacgctgaatcctcgggagttanaaaccaatggcgcgtggaatgtgtgcgcagaaagtctctccagacagggtcaggacactgnacacgctctcgcagcatcctcgacagctccaggattagtaagcgaagcagactagctatggtaagacgggagctccatgcttatatgaaggacctctgttgcgtacgatactatagcacctgcaggtctctcctgcacgagacgtgcatatcccatggccctagacatacatgaactgcacacgtcntgacgcgcggacttggacaggactcttgggatggcaacgcaggacgcaagggacgtgctatacccgtggtacgcttctcagaaagcagagactcgcaagagggagtcgaacgcgagacaacatctagtgggcacacggatggttagctccacgttggagaaacacaacggtccataggctcccgcaccctagatgacaactaggagtggcccacttgggcccctaggaaggggacccaagtaagcgtggcccctggggcgggtgtgcgtctttgtgttcttgtggttccggcgtcctggtcatctctttcgcgccccactttcatgccaaagcgggcgaataccccaagcaagggtccttggtcccttcgtctcccacgtctctcatactgggactctggaccaggataggggacaggccttctccaactttatgtttggtccatagagcaacctttccaacttgggggggcccccaaggattacccctggaaaatgacaccactttcctttgtatcccagagggccctggaaactctgtgtgcaagcatgggcttgtccccgggtggaactgtgacaagggagcctccaccgtcccactgggaagtc

SEQ ID NO: 641759 - DNA, 559 bp, Homo sapiens
aattccattccagcgtacaatcagttcgcagctatattcaattccattccagcgtagctttactagtgctttaagaggtgtttctcacttaatggtgagaccttcagatttatacaagaatcctaccttatctttccaaaataatttcacatggtttctgtaaaatctagaaaataagaaaaaaaaaaaatccgcggatgaaaatagtactttactattggtagatgtacgggttactttaaaagattaagagaatgttggcgggcggggtgcaggggctcatgcctctaattccagcacttgggaaggccagggcaggcagatcactggagccccggagtctgagaccagccggggcaacatggcgagaccccacctctactaaaaataccaaaattagccgggcatgatggtgctggctgggggtcaagggctgctggggaggctgagggggggaggatggttaaagcccaggaggcagaggtggctgtgagccgagactgtgctgctgcactccagcttgtgtgacagagcgagaccaggtcccaaaaataaaaaa

SEQ ID NO: 641760 - DNA, 261 bp, Homo sapiens
tgcaccatgctataaaagtgagctctccatccgtattcaaagtatgcgtgtttatgtgtatttatgtgtgtagatggtgatatgacaaattaatcattttgctacactcataaccctgtacatacttcttcccgtgtcgatttcaatacaagtacccctttagatcacttagcaaatctgaccttgacgagggttagggttgtgatatccatgtaagcgacagtattgctttggaagtctctggttaaattaatactcttt

SEQ ID NO: 641761 - DNA, 815 bp, Homo sapiens
aaatattatctagtaattcactacagtattacttttggtaagagatgcccgataagtaattctgaaggatgatgttcacataaaacagttacctaaagatacagtcataacattgaatattccacattcataaccctttgaggatgagaacaatacagcttaatggtgcttttatacattttatatagtgtgcttttatatgtttatttttcatgtgtgccttaagatatagagactcctttggaattggatgctagtgcttgttagaacagatgtttatcaaaattaatgcctcattgggtgacatggggaaaaaattactgatatcttgcctttagcctgatccagatcttttgaaggatagcacttttatcgtatagttgtcgtacagtttaggagacagagtctcactctgccacccgggctggagtgcagtggcacagtcgtggctcacctgcagactttgaactacctcccaggcttaggttatcctccacacacctacagctcccaagttgctgctgggactacaggtgtacgccatcacacctgtctaatttcaagtaatataattgagacaggggtaccccatgtagtccaggctgatctagaaatccatgggttcagagcgatctgaccgaatatgactcccaaaagtgctgggatatcaggcatgaaccactaaactggataaggctccaacctttagaaaaatagatacaaaacataagatcaaaggaagacaataagaatgacaatgagatccagatagcatctacgacaactaaggaaactgcaaagggtagacaacgcaa

SEQ ID NO: 641762 - DNA, 456 bp, Homo sapiens
gtagtcagaacatataagaaatacccagtttatattacattccaaaaggtatcgaattgtataacagcttgcccaaggtcacatagacggctagtgacaggaagtgacccagtgtgtagattctagtcaaatacctagcccaggtttgctttccatgtataaaatacgtaaaggttagaatcacaggtactggtgtaaaatcacctgggttcaaattctagctccgtcacttcctagagctgtggaacttaagcaaattacttaatcatcctgtgcctcagtttcctctggtaataacagggaaatacatcatcattgtaactccctgggttgttgcaagaatgaaattagttaatgcatatagttcctagaacaccaaacaacaccgaatgagcacggcccaccctgctactgttgtcctcgtcatagtcattggcatcatgatcttcatatagt

SEQ ID NO: 641763 - DNA, 246 bp, Homo sapiens
acttcagtcttgatcttccgggctcaagcagctcttctcaccccagcctcttgactagctgacaccacaggtgcactccaccacccctggctacatttttgtatttcttgtggaaacaaggtctcgccatgttgcccaagctggtcttgaactcccaggctgaagcgatctgcccacctcagcctcccaaagtgctgggatcacaggcatcagcaccttgcccagccactgttctttctttctgtc

SEQ ID NO: 641764 - DNA, 450 bp, Homo sapiens
accaaacagggcctatgatgcagatgaatgcattggacaatatatttcaatcaagtcacagactcacttccccacttccatgaaatataacaaaggactaagaaacattaaaaataacgtatcaaacttcccacaaaccaaaagcatacaatgggaaaataacagtcttttcaataaatgctgctgggaaaactggataaccatatgcagaataaaactagatgccatctctcagcataaaaaaaaaagtcaaaacagattaaagacttacatctaacacctgaaactataaaactagtagaggaagacccttgggaaacaatccagggcattggtctgggtaaagatttcttgggaagatctcaaaagcacaggcaacaagagcaaaaacaaacatatgagattacatcaagctaaaaagcttctccacagcaaaagatacaatcaaca

SEQ ID NO: 641765 - DNA, 250 bp, Homo sapiens
  misc_feature (14)..(14): n is a, c, g, or t
  misc_feature (203)..(203): n is a, c, g, or t
taattaattttttnatttctattaagctagccaggcatctcatttctatgtactgggcaattatatgccaaacactgctgggtgccggagatagtgatgttcgagttcattaactaatagaagacagacaagtaaaccagttgtcacactagggtgttcattaacagaaatatgtatgagatacgtaatagatatcagatctnttaacaatcttgagtgtgaagcccaataaagtgctcttttcataagt

SEQ ID NO: 641766 - DNA, 336 bp, Homo sapiens
cccccggagggttttcccgagcccaggacgggtgggggtcatttccaaaacccccccacccctttggggggcccctggttttttggggccccgccctttttgggcccccggggccccccccggtaaattaaaggggttttttttattttggggccccccccccgggggtttttccgggggaaaaaaacggtttgcccccccggggttttttttttggcccccccccccttttggggcccggggtttccccccccccggggttttttttttaaactttggcccccgaagggcccgggggggttttttttttccccttaaattttgggttccccccca

SEQ ID NO: 641767 - DNA, 995 bp, Homo sapiens
cagcatattagatttgacaacgttgagtacttatttaagggtctcgccctctggtctgtactgaatctttgacagatatccaactttcggcgcaagataattcgtaagtggaataacaaaacagaacatagggcatttcacactgagaacagtccttgaaatcattcctagagactatcttaaaatatagcactgagatgacattctttccacacaggcattgcatcctgcctctatctgccatcacctgtttgggcactgccaaatagaacactgtaataatttaaaagtagtaaacaagtgtatctttatcaggtaacacgtatcaacaagaacagtgacaaaataagtggttcaacacgtgcaaccccttgcggagagaacttgcacgttggaccagtttctagctatgctctatatgttacagaatttccttcaaagctcatatggacaaacctaagaacagttagaaaaacactgttaaaacaaacaacacacggtggcgcacggcggagcgacctgagggcaggacccaatgcccactacacttaaaaccccaacacgccctggcgccactctaacaaccaagtgcgcgccctaggtgccctgacctaacatagagccactgacaataagacacccgcatccccgcagaaccagcaagccagatccccccgccacactacctctcgaccggatcctcaccatccagatccaaggtacgccctccccaaattccgatccaaggacacaaaccagaacaggtccatcacccaaccactcgggcccaacctgggcctataaaaaccaccccgccgccacacccactcgaggcctacacacccgccacaggcccacacctccaagccccccaacacaaggcccccgcaagggtcgaaaactaccacaggcctcacaaactagggcacaccctacacgcatcggcacgggacacggacaacacctcaccccactacgagcgtacaacaccagcc

SEQ ID NO: 641768 - DNA, 2037 bp, Homo sapiens
taggctaggtacgaggccgggtggcacgaggccaaggagtacagatagccttttcaaaaggcgcagcttaccgcggtgcgcgcggattctggacttgggcgccaactcgtagtccacgctccccggggtcagcagaggggcgctcacgctctcgccacccacctcgctttctcaccccgcgcttcccggcctgggtttttagtcttccttggagcgctctctggcctccgcctccgccagggagcggaaggcggagacagcgagactggccaggggggaggaaagaggacgcgtgtgggcaagggggacaacgggatgtccacgggctcggtgagtgatccggaggagatggagcttcgggggctgcagcgggagtacccggtccccgcctccaagaggccgcccctccgcggcgtagagcgcagctacgcctcgcccagtgacaactcgtcggcagaggaggaggaccccgacggcgaggaggagcgctgcgctctgggcacagccggcagcgcggaaggctgcaagaggaagcggccccgtgtggctgggggcggcggcgcaggtggtagcgcgggcggtggtggcaagaagcccctcccggccaagggctcagccgcagagtgcaagcagtcgcagcggaacgcggccaacgcccgtgagcgtgcccggatgcgcgtgctgagcaaagccttctccaggctcaagaccagcctgccctgggtgccccccgacactaagctctccaagctggacacgctccggctggcttccagttacatcgctcacctgcggcagctgttgcaggaggaccgctatgagaacggctacgtgcacccagtgaacctgacatggccattcgtggtctcgggaagaccggactctgacaccaaagaagtttccgcagccaacagactatgtggaaccaccgcttaaatcggactggaactcacttgatgggattattcgttaaatgcgagtgtttgggggccacggagagaagggagagctcgtgagatgggaagaagtttccgctggattctccttgacccttcccctttccctggaactgtgatcgtgacaggtggcgggtgtggctgtcactgcacagcgcccacggctacagctgcgccggatctgggcgaccacgttttgcctctccaaaaagagcttcctttcgtgacgagacgcggacgcaggtccaccctcgggccctagctctgtagactaactctcggctgctgccccagcccgcgccagacagcccacggatccgttctcagcggagccagattcatcgcacacgtgcgggacggttccacacagccccggcctttcgcggtgacacaatggttagggaacggttagaacgcgctctacatccgctttaaagacagaggtctagacgtgagatccgcgtcgggacagggttttaagtgacaaagaagggcgagtggcttctctgggccgggttcgtactccagcacagcgcccttctaacgggcgggaggaaggccgctgctcgcagggctaggtggagacacacttcccagatcaccgcaggcgggttttacccggagagctctgggccgttcggcctccctgccgggtggcttcttcaatcccgtctccttcccaagctcccggctttttctaatcaggcaggcgtctgtcaaccctctccacttctgggctgaagcctccccaagccccgctgcgccaacctgtgtggggtcttcttcgggcctccctctccgccccgctcctgctcctacctgcagcacccccagctccgactccagactctctgcatcaggtctccccactccacgctccgggcgccccaactccaacaccacgtcctgccgcgcaggttcttccccgcgcggaggagcgcgcagggtgggcggcttaccatagcaagtgatcctgcgatagggaacgcgcccttgccccgaggctgcactaccacaggaaataacatatgtaaataaatttatttttttatgaataataaaacgcgctgtaaaaaccgtg

SEQ ID NO: 641769 - DNA, 2077 bp, Homo sapiens
taggctaggtacgaggccgggtggcacgaggccaaggagtacagatagccttttcaaaaggcgcagcttaccgcggtgcgcgcggattctggacttgggcgccaactcgtagtccacgctccccggggtcagcagaggggcgctcacgctctcgccacccacctcgctttctcaccccgcgcttcccggcctgggtttttagtcttccttggagcgctctctggcctccgcctccgccagggagcggaaggcggagacagcgagactggccaggggggaggaaagaggacgcgtgtgggcaagggggacaacgggatgtccacgggctcggtgagtgatccggaggagatggagcttcgggggatgttgatcctgtgagtgagatgtgatgcttctgtgggtgctgcagcgggagtacccggtccccgcctccaagaggccgcccctccgcggcgtagagcgcagctacgcctcgcccagtgacaactcgtcggcagaggaggaggaccccgacggcgaggaggagcgctgcgctctgggcacagccggcagcgcggaaggctgcaagaggaagcggccccgtgtggctgggggcggcggcgcaggtggtagcgcgggcggtggtggcaagaagcccctcccggccaagggctcagccgcagagtgcaagcagtcgcagcggaacgcggccaacgcccgtgagcgtgcccggatgcgcgtgctgagcaaagccttctccaggctcaagaccagcctgccctgggtgccccccgacactaagctctccaagctggacacgctccggctggcttccagttacatcgctcacctgcggcagctgttgcaggaggaccgctatgagaacggctacgtgcacccagtgaacctgacatggccattcgtggtctcgggaagaccggactctgacaccaaagaagtttccgcagccaacagactatgtggaaccaccgcttaaatcggactggaactcacttgatgggattattcgttaaatgcgagtgtttgggggccacggagagaagggagagctcgtgagatgggaagaagtttccgctggattctccttgacccttcccctttccctggaactgtgatcgtgacaggtggcgggtgtggctgtcactgcacagcgcccacggctacagctgcgccggatctgggcgaccacgttttgcctctccaaaaagagcttcctttcgtgacgagacgcggacgcaggtccaccctcgggccctagctctgtagactaactctcggctgctgccccagcccgcgccagacagcccacggatccgttctcagcggagccagattcatcgcacacgtgcgggacggttccacacagccccggcctttcgcggtgacacaatggttagggaacggttagaacgcgctctacatccgctttaaagacagaggtctagacgtgagatccgcgtcgggacagggttttaagtgacaaagaagggcgagtggcttctctgggccgggttcgtactccagcacagcgcccttctaacgggcgggaggaaggccgctgctcgcagggctaggtggagacacacttcccagatcaccgcaggcgggttttacccggagagctctgggccgttcggcctccctgccgggtggcttcttcaatcccgtctccttcccaagctcccggctttttctaatcaggcaggcgtctgtcaaccctctccacttctgggctgaagcctccccaagccccgctgcgccaacctgtgtggggtcttcttcgggcctccctctccgccccgctcctgctcctacctgcagcacccccagctccgactccagactctctgcatcaggtctccccactccacgctccgggcgccccaactccaacaccacgtcctgccgcgcaggttcttccccgcgcggaggagcgcgcagggtgggcggcttaccatagcaagtgatcctgcgatagggaacgcgcccttgccccgaggctgcactaccacaggaaataacatatgtaaataaatttatttttttatgaataataaaacgcgctgtaaaaaccgtg

SEQ ID NO: 641770 - DNA, 155 bp, Homo sapiens
caggagacacctgtaatccgtgatagttctcatgctagagatcaaagagaggtttctctatcatttctgacttgtatatcagtgatgtctttcaatcccgagtgtaaatccagagtcttctgagaaggggtaaggcgtccagcgacgaggctttt

SEQ ID NO: 641771 - DNA, 1790 bp, Homo sapiens
ggaaagagagaaagactggccagtggggaggaacgagcgcgtttgtcaggggacacgggattcacgggctcggtgatcacgggctcggtgagtgatcgaggaatgagcttcgggggctgcagcgggagtacccggtccccgcctccaagaggccgcccctccgcggcgtagagcgcagctacgcctcgcccagtgacaactcgtcggcagaggaggaggaccccgacggcgaggaggagcgctgcgctctgggcacagccggcagcgcggaaggctgcaagaggaagcggccccgtgtggctgggggcggcggcgcaggtggtagcgcgggcggtggtggcaagaagcccctcccggccaagggctcagccgcagagtgcaagcagtcgcagcggaacgcggccaacgcccgtgagcgtgcccggatgcgcgtgctgagcaaagccttctccaggctcaagaccagcctgccctgggtgccccccgacactaagctctccaagctggacacgctccggctggcttccagttacatcgctcacctgcggcagctgttgcaggaggaccgctatgagaacggctacgtgcacccagtgaacctgacatggccattcgtggtctcgggaagaccggactctgacaccaaagaagtttccgcagccaacagactatgtggaaccaccgcttaaatcggactggaactcacttgatgggattattcgttaaatgcgagtgtttgggggccacggagagaagggagagctcgtgagatgggaagaagtttccgctggattctccttgacccttcccctttccctggaactgtgatcgtgacaggtggcgggtgtggctgtcactgcacagcgcccacggctacagctgcgccggatctgggcgaccacgttttgcctctccaaaaagagcttcctttcgtgacgagacgcggacgcaggtccaccctcgggccctagctctgtagactaactctcggctgctgccccagcccgcgccagacagcccacggatccgttctcagcggagccagattcatcgcacacgtgcgggacggttccacacagccccggcctttcgcggtgacacaatggttagggaacggttagaacgcgctctacatccgctttaaagacagaggtctagacgtgagatccgcgtcgggacagggttttaagtgacaaagaagggcgagtggcttctctgggccgggttcgtactccagcacagcgcccttctaacgggcgggaggaaggccgctgctcgcagggctaggtggagacacacttcccagatcaccgcaggcgggttttacccggagagctctgggccgttcggcctccctgccgggtggcttcttcaatcccgtctccttcccaagctcccggctttttctaatcaggcaggcgtctgtcaaccctctccacttctgggctgaagcctccccaagccccgctgcgccaacctgtgtggggtcttcttcgggcctccctctccgccccgctcctgctcctacctgcagcacccccagctccgactccagactctctgcatcaggtctccccactccacgctccgggcgccccaactccaacaccacgtcctgccgcgcaggttcttccccgcgcggaggagcgcgcagggtgggcggcttaccatagcaagtgatcctgcgatagggaacgcgcccttgccccgaggctgcactaccacaggaaataacatatgtaaataaatttatttttttatgaataataaaacgcgctgtaaaaaccgtg

SEQ ID NO: 641772 - DNA, 234 bp, Homo sapiens
aaacgttacaccgctttaggatgctgaggcaggagaatctcttgaacccgggaggcagaggttgcagtgagccgagatcacactactgcactccagcctggcaacagagcaagactctgtttcaaagaacaaaaaacaataaaaaaaaaagtttacccgggatttttggattgcttttgttttcccagttatttggaaggctaaggtgaagttgagggagaacgtatgaacctc

SEQ ID NO: 641773 - DNA, 2658 bp, Homo sapiens
taggctaggtacgaggccgggtggcacgaggccaaggagtacagatagccttttcaaaaggcgcagcttaccgcggtgcgcgcggattctggacttgggcgccaactcgtagtccacgctccccggggtcagcagaggggcgctcacgctctcgccacccacctcgctttctcaccccgcgcttcccggcctgggtttttagtcttccttggagcgctctctggcctccgcctccgccagggagcggaaggcggagacagcgagactggccaggggggaggaaagaggacgcgtgtgggcaagggggacaacgggatgtccacgggctcggtgagtgatccggaggagatggagcttcgggggctgcagcgggagtacccggtccccgcctccaagaggccgcccctccgcggcgtagagcgcagctacgcctcgcccagtgacaactcgtcggcagaggaggaggaccccgacggcgaggaggagcgctgcgctctgggcacagccggcagcgcggaaggctgcaagaggaagcggccccgtgtggctgggggcggcggcgcaggtggtagcgcgggcggtggtggcaagaagcccctcccggccaagggctcagccgcagagtgcaagcagtcgcagcggaacgcggccaacgcccgtgagcgtgcccggatgcgcgtgctgagcaaagccttctccaggctcaagaccagcctgccctgggtgccccccgacactaagctctccaagctggacacgctccggctggcttccagttacatcgctcacctgcggcagctgttgcaggaggaccgctatgagaacggctacgtgcacccagtgaacctgacatggccattcgtggtctcgggaagaccggactctgacaccaaagaagtttccgcagccaacagactatgtggaaccaccgcttaaatcggactggaactcacttgatgggattattcgttaaatgcgagtgtttgggggccacggagagaagggagagctcgtgagatgggaagaagtttccgctggattctccttgacccttcccctttccctggaactgtgatcgtgacaggtggcgggtgtggctgtcactgcacagcgcccacggctacagctgcgccggatctgggcgaccacgttttgcctctccaaaaagagcttcctttcgtgacgagacgcggacgcaggtccaccctcgggccctagctctgtagactaactctcggctgctgccccagcccgcgccagacagcccacggatccgttctcagcggagccagattcatcgcacacgtgcgggacggttccacacagccccggcctttcgcggtgacacaatggttagggaacggttagaacgcgctctacatccgctttaaagacagaggtctagacgtgagatccgcgtcgggacagggttttaagtgacaaagaagggcgagtggcttctctgggccgggttcgtactccagcacagcgcccttctaacgggcgggaggaaggccgctgctcgcagggctaggtggagacacacttcccagatcaccgcaggcgggttttacccggagagctctgggccgttcggcctccctgccgggtggcttcttcaatcccgtctccttcccaagctcccggctttttctaatcaggcaggcgtctgtcaaccctctccacttctgggctgaagcctccccaagccccgctgcgccaacctgtgtggggtcttcttcgggcctccctctccgccccgctcctgctcctacctgcagcacccccagctccgactccagactctctgcatcaggtctccccactccacgctccgggcgccccaactccaacaccacgtcctgccgcgcaggttcttccccgcgcggaggagcgcgcagggtgggcggcttaccatagcaagtgatcctgcgatagggaacgcgcccttgccccgaggctgcactaccacaggaaataacatatgtaaataaatttatttttttatgaataataaaacgcgctgtaaaaaccgtgtgccccttggaggtgtcaggatgtggtctttgttgccctttactaagagggtttggctgtagaagttaacttttaagggctgatctcctctggtcagggcggtgggtcattgcgggaggaatggtggcgatcacttttggatcactccatttccaaacgtcattctctattaatctctatgattctgctgcttctccgcgccgggcttcctggaaggccataactggaggcctaataaaagtcctgagtcttgaggcccctgctgtcctgacagacatacactcctcaggctaacataggtgcacgtctctcatacacacactcacacacacacacaacacacacagcagctactccagctaaaagcacactccaatccttaccattgcaagtagttcaaaaaaaaaccctaaggcccacccacaagtctccagtgtaactggcagaataaaaccctaatataagaagccaatttgtatttcaacggtgcttttcttttatcaaatgtttatatatctttttaaacgtacactcattttccgtgttattttcttccacttgtactgcaatttttgtagaaggtaacaacttggaaaccctataatacaatttttaaaacgg

SEQ ID NO: 641774 - DNA, 1244 bp, Homo sapiens
gagtttcaccaaattatcctgcgggcaaagtccaggaagaagcgtgaacggatatgacatggccattcgtggtctcgggaagaccggactctgacaccaaagaagtttccgcagccaacagactatgtggaaccaccgcttaaatcggactggaactcacttgatgggattattcgttaaatgcgagtgtttgggggccacggagagaagggagagctcgtgagatgggaagaagtttccgctggattctccttgacccttcccctttccctggaactgtgatcgtgacaggtggcgggtgtggctgtcactgcacagcgcccacggctacagctgcgccggatctgggcgaccacgttttgcctctccaaaaagagcttcctttcgtgacgagacgcggacgcaggtccaccctcgggccctagctctgtagactaactctcggctgctgccccagcccgcgccagacagcccacggatccgttctcagcggagccagattcatcgcacacgtgcgggacggttccacacagccccggcctttcgcggtgacacaatggttagggaacggttagaacgcgctctacatccgctttaaagacagaggtctagacgtgagatccgcgtcgggacagggttttaagtgacaaagaagggcgagtggcttctctgggccgggttcgtactccagcacagcgcccttctaacgggcgggaggaaggccgctgctcgcagggctaggtggagacacacttcccagatcaccgcaggcgggttttacccggagagctctgggccgttcggcctccctgccgggtggcttcttcaatcccgtctccttcccaagctcccggctttttctaatcaggcaggcgtctgtcaaccctctccacttctgggctgaagcctccccaagccccgctgcgccaacctgtgtggggtcttcttcgggcctccctctccgccccgctcctgctcctacctgcagcacccccagctccgactccagactctctgcatcaggtctccccactccacgctccgggcgccccaactccaacaccacgtcctgccgcgcaggttcttccccgcgcggaggagcgcgcagggtgggcggcttaccatagcaagtgatcctgcgatagggaacgcgcccttgccccgaggctgcactaccacaggaaataacatatgtaaataaatttatttttttatgaataataaaacgcgctgtaaaaaccgtg

SEQ ID NO: 641775 - DNA, 138 bp, Homo sapiens
aagacccagtgcaagccatgaagtgtctagatattcattcaacggctacttcttatatgttgtactatgtcttatcattaaacacaagctacttatcattatagaatgatgtacccacaaatgcttataaacttgggt

SEQ ID NO: 641776 - DNA, 1257 bp, Homo sapiens
cgtaggagagctgtttcggtttgagacaatcgtttctctctaatatctcacgttctttttgatttactgacatggccattcgtggtctcgggaagaccggactctgacaccaaagaagtttccgcagccaacagactatgtggaaccaccgcttaaatcggactggaactcacttgatgggattattcgttaaatgcgagtgtttgggggccacggagagaagggagagctcgtgagatgggaagaagtttccgctggattctccttgacccttcccctttccctggaactgtgatcgtgacaggtggcgggtgtggctgtcactgcacagcgcccacggctacagctgcgccggatctgggcgaccacgttttgcctctccaaaaagagcttcctttcgtgacgagacgcggacgcaggtccaccctcgggccctagctctgtagactaactctcggctgctgccccagcccgcgccagacagcccacggatccgttctcagcggagccagattcatcgcacacgtgcgggacggttccacacagccccggcctttcgcggtgacacaatggttagggaacggttagaacgcgctctacatccgctttaaagacagaggtctagacgtgagatccgcgtcgggacagggttttaagtgacaaagaagggcgagtggcttctctgggccgggttcgtactccagcacagcgcccttctaacgggcgggaggaaggccgctgctcgcagggctaggtggagacacacttcccagatcaccgcaggcgggttttacccggagagctctgggccgttcggcctccctgccgggtggcttcttcaatcccgtctccttcccaagctcccggctttttctaatcaggcaggcgtctgtcaaccctctccacttctgggctgaagcctccccaagccccgctgcgccaacctgtgtggggtcttcttcgggcctccctctccgccccgctcctgctcctacctgcagcacccccagctccgactccagactctctgcatcaggtctccccactccacgctccgggcgccccaactccaacaccacgtcctgccgcgcaggttcttccccgcgcggaggagcgcgcagggtgggcggcttaccatagcaagtgatcctgcgatagggaacgcgcccttgccccgaggctgcactaccacaggaaataacatatgtaaataaatttatttttttatgaataataaaacgcgctgtaaaaaccgtg

SEQ ID NO: 641777 - DNA, 1554 bp, Homo sapiens
taggctaggtacgaggccgggtggcacgaggccaaggagtacagatagccttttcaaaaggcgcagcttaccgcggtgcgcgcggattctggacttgggcgccaactcgtagtccacgctccccggggtcagcagaggggcgctcacgctctcgccacccacctcgctttctcaccccgcgcttcccggcctgggtttttagtcttccttggagcgctctctggcctccgcctccgccagggagcggaaggcggagacagcgagactggccaggggggaggaaagaggacgcgtgtgggcaagggggacaacgggatgtccacgggctcggtgagtgatccggaggagatggagcttcgggggctgcagcgggagtacccggtccccgcctccaagaggccgcccctccgcggcgtagagcgcagctacgcctcgcccagtgacaactcgtcggcagaggaggaggaccccgacggcgaggaggagcgctgcgctctgggcacagccggcagcgcggaaggctgcaagaggaagcggccccgtgtggctgggggcggcggcgcaggtggtagcgcgggcggtggtggcaagaagcccctcccggccaagggctcagccgcagagtgcaagcagtcgcagcggaacgcggccaacgcccgtgagcgtgcccggatgcgcgtgctgagctccgactccagactctctgcatcaggtctccccactccacgctccgggcgccccaactccaacaccacgtcctgccgcgcaggttcttccccgcgcggaggagcgcgcagggtgggcggcttaccatagcaagtgatcctgcgatagggaacgcgcccttgccccgaggctgcactaccacaggaaataacatatgtaaataaatttatttttttatgaataataaaacgcgctgtaaaaaccgtgtgccccttggaggtgtcaggatgtggtctttgttgccctttactaagagggtttggctgtagaagttaacttttaagggctgatctcctctggtcagggcggtgggtcattgcgggaggaatggtggcgatcacttttggatcactccatttccaaacgtcattctctattaatctctatgattctgctgcttctccgcgccgggcttcctggaaggccataactggaggcctaataaaagtcctgagtcttgaggcccctgctgtcctgacagacatacactcctcaggctaacataggtgcacgtctctcatacacacactcacacacacacacaacacacacagcagctactccagctaaaagcacactccaatccttaccattgcaagtagttcaaaaaaaaaccctaaggcccacccacaagtctccagtgtaactggcagaataaaaccctaatataagaagccaatttgtatttcaacggtgcttttcttttatcaaatgtttatatatctttttaaacgtacactcattttccgtgttattttcttccacttgtactgcaatttttgtagaaggtaacaacttggaaaccctataatacaatttttaaaacgg

SEQ ID NO: 641778 - DNA, 1576 bp, Homo sapiens
taggctaggtacgaggccgggtggcacgaggccaaggagtacagatagccttttcaaaaggcgcagcttaccgcggtgcgcgcggattctggacttgggcgccaactcgtagtccacgctccccggggtcagcagaggggcgctcacgctctcgccacccacctcgctttctcaccccgcgcttcccggcctgggtttttagtcttccttggagcgctctctggcctccgcctccgccagggagcggaaggcggagacagcgagactggccaggggggaggaaagaggacgcgtgtgggcaagggggacaacgggatgtccacgggctcggtgagtgatccggaggagatggagcttcggggggcgtgcgacgacgggcagatgatcacggggaaccggcgatccaccgaggagcggcgactccatcggggggaagaagcagcgcagctacgcctcgcccagtgacaactcgtcggcagaggaggaggaccccgacggcgaggaggagcgctgcgctctgggcacagccggcagcgcggaaggctgcaagaggaagcggccccgtgtggctgggggcggcggcgcaggtggtagcgcgggcggtggtggcaagaagcccctcccggccaagggctcagccgcagagtgcaagcagtcgcagcggaacgcggccaacgcccgtgagcgtgcccggatgcgcgtgctgagctccgactccagactctctgcatcaggtctccccactccacgctccgggcgccccaactccaacaccacgtcctgccgcgcaggttcttccccgcgcggaggagcgcgcagggtgggcggcttaccatagcaagtgatcctgcgatagggaacgcgcccttgccccgaggctgcactaccacaggaaataacatatgtaaataaatttatttttttatgaataataaaacgcgctgtaaaaaccgtgtgccccttggaggtgtcaggatgtggtctttgttgccctttactaagagggtttggctgtagaagttaacttttaagggctgatctcctctggtcagggcggtgggtcattgcgggaggaatggtggcgatcacttttggatcactccatttccaaacgtcattctctattaatctctatgattctgctgcttctccgcgccgggcttcctggaaggccataactggaggcctaataaaagtcctgagtcttgaggcccctgctgtcctgacagacatacactcctcaggctaacataggtgcacgtctctcatacacacactcacacacacacacaacacacacagcagctactccagctaaaagcacactccaatccttaccattgcaagtagttcaaaaaaaaaccctaaggcccacccacaagtctccagtgtaactggcagaataaaaccctaatataagaagccaatttgtatttcaacggtgcttttcttttatcaaatgtttatatatctttttaaacgtacactcattttccgtgttattttcttccacttgtactgcaatttttgtagaaggtaacaacttggaaaccctataatacaatttttaaaacgg

SEQ ID NO: 641779 - DNA, 884 bp, Homo sapiens
cgaaagacgggtgaaggccatgccgacttctgggaaagttccccgaaaggagaatctgtgggtacagcgtgagtgggggtcctgctcctttgtgtgctcaaccatggaaacagttcttggagcatgtctactcagcatctgcatcagcacctgcatggctctgggcgatggagtgcagggaagaggacagaggaggatgacccacgttgaggaaacgcaattctcctgactagtggccagggaatgtggctttggttctctggacagttctgtcgtgacctcatccgtccatgtctacttccactgctaccacaactagagctgcaaacagtgggggctgcaggccttgctagagccaggctgaccttggcccctgccttcctgcgactgtccagcaggcggaacgtcatccctgatatccctgcatcatttcctgtgtctgtggcgagcgactgtggagaattccttcgacaatcctgacggtggtttcatcggcgtgtggatagcacactagtctgtgctgtgaatagcgaagcagtcggcaaggacaacccggtggtgctgtgtggctggcaaaggctgtagctgcagcttcaaggaccggtagtaaagttcgagagcacctccgaaagcatatcccaggagaaagtggtagactgccctcgactgtggggggcaatgtgttggcaagcaagtacaaagttcttaagactcacaatccgcgacagatcctgatgtggagtcaaccaaagaaggtccaggggtctcaactggttccagcaatttggccccggagacgggcatgggggggccattggggaaccagtgagtcttttggcccttggtgctgatcggcgttgctcccctcgacacatgggttgaag

SEQ ID NO: 641780 - DNA, 1238 bp, Homo sapiens
  misc_feature (268)..(268): n is a, c, g, or t
  misc_feature (294)..(294): n is a, c, g, or t
  misc_feature (480)..(480): n is a, c, g, or t
  misc_feature (1021)..(1021): n is a, c, g, or t
agtatgcccctggttccaacccgttatgtactcttacccatctttggcggtgcacacttcaatcaagaggcagtctaatggcgcagtcgacatgtagttattgacatcgtcgcagtaagtgccgtaagtaaagtaacacgatgcatagccattagtgaattcacacgattactagacacgaaaataaaattaatacccttacaggtaccaactaagtagagcttgactatgcaatgatatttatacacttcaccagcaaatgacttcncacaggggtcacaattgaatctcatntcataataataaggcgtcatttccttcatacgatacgagattaatatcttcttaccggtgaataatattgggaaaggcaatttacatcctagagtgacttaacccaaaagtgcaaaacttagcatgcaatacaatatgacaataaagttctagtaacattagggatttattacgtcaatattcctnatgattcacgtgcatataagtccactctctcctgtattcaacttttcctggaggattccgcaaggagcggttgaaccgctaaggttcgactccccttctgcgatcatttcgagtactgtgtatactctactctatcatgtacaagaaggtatttaggaacaccctaatactactcattcattgtgattcagaaatctctacgcggccatggaaacggttaggtcctgtacttccctccatctccgactcaaatcgtttgtttccgactccagtaagacatggcactgtgggagggggggtctttcacaaccaaagagccgaagctaacgcaagaaaatcttggagcatgagttccctcgaattctcaccccatttgtggagggaagccactaggggggtctgacacgggagagcccctgaggagtaaacctggtcgtgagattaagctattttccaattaattctcgagagaacaaacgcgggagttagtgataggaaagtgtctgccgaagaggaaatgttgtctttccgaaaaagaganaggctgatagggtgcggaatagtgctccctactaagataggcagcgcggcagctctatggccgaagataataagagaccctcctatcgtggccttctgcttaactatgtattacagctgctagagaattcatatttctactgtgtgttggatgagcacacaatcgaaatgcagacgagccataagacagcggcaagcacaaccgagagaaccgcggg

SEQ ID NO: 641781 - DNA, 1050 bp, Homo sapiens
ggccatatggcaacgctccagattatcgaatgtctgacatagaaaacaagaagcagctaagacaccgcgctgtctaccaaaaagtatgtggagctgcaggagacagagatgatggacccagagctagagtacaccctcagtgagggtctgcatagcagatgataaacgaggttctgtccggaagcagattctatacataccatcgtcgtcaggtgcttgaagcagtaataaccaacagaggaattgatggatcccaaatgcgagacagatgatagaccaagcgccagatcacctcagaacaccagattaccgcttaaaccccatgttaagaaaagcctgtgatagctgacattcctaaattctgtcacggtatcctgactaaggccagggatgattcagacattagagaggacaagtcatctccttgctctgaagctcgtagatgatgcgtgatccagtcgaccatgtacttcagtactgtgaacgacctagatccgaatcattatccaggagtccgcccgtggactaccggctggatcctcagctccagctgcactgttcagacgagatctcctagtcatatgctgctagaaggacagtcgagtcagtcccgagagagcgagacaggtcaggtggaggagtgcctcaaggtcaacctgttccaagatccaaaacagaattgtgtaagcaggaagtgctaaagatgctgaagaggaaagcaaagccgacatctttgtggacccggtaactctaattactgttgatgccctggacattcatgctcactggagcaagcatcaccctgacggggcgtcaatgtccggctcatggaagcctgaggtaacggcgtaggtaaaccgcggcataagcggctaagaaccgatggaatgggcgtacgcccaagggggaccacaaaaagccccggatctgacgccaaagggagtccaccggagaggcccccggaacacggccagcgaatgtcccaagccaagggagaacccaagggcaaaaccagggacccgagcaaaaaaatcaccacagaccctaccc

SEQ ID NO: 641782 - DNA, 692 bp, Homo sapiens
acagaacaagactacgtctcaaaaactgggggagatatattaaaaggactggtccagggagagtttgctttgtaaccccgacaatcctggagggaatttggtgtttggttaaggaaaagagagaagttaaaagtcatgagttacatccagcagtgtaaaaacgaaatacccgccgggcgcggcgtctcacgcatgtaatcccagcactttgggaggccgaggcaggcggatcacaaggtcaggagttcctggccaacatggtgaaaccgcatctttactaaaaatacattagctgcggttgggggcgtgtgcttatagtaccagctacttgggaggctgaggcaggagaatcggttgaacccggtaggcggaggttgagtgagattgctccactgcactccaggcctggcgacagagggagtatgtctcataacaaacaaacagatgccatgtacaaggtgctgatgaagagatgcttcccaaattcccatgtcagctgcgaagctgacctccctgtgcgcctctatgccaagaactgtcacctgccttatctggactcttcccggatagctcttgaagtccacagccttttgaatcttggctagaggggggttttttctcttctgcacccagccaattgatttaggagaggttccagtttttgtgaggggacacaagacttgttgcttgtt

SEQ ID NO: 641783 - DNA, 125 bp, Homo sapiens
gcagcgctctcaggacatctccaccattggccttgggcttcttgcttgcttccttcacccttccttcaacttcaagggcgacaaaggggtctatggggccccagtcttgcccttgacttcaaacc

SEQ ID NO: 641784 - DNA, 633 bp, Homo sapiens
tgtcatgggtcactgaggctttgtattttggagcacaaaaccaccggggatctagccggtggccaccccggagatgacacgaggtctcacatgacttcttagacacttggtggggaaaggttgaggcgagaagaaacaagtgtatgtgggcgcctacatgtgtactacggactgtgctaacagcttagagtcttgctcaacgagggcttccagggagcttgggcattctgtagaagttcttaaggaagcggataggaacttccaggggcggaggggcggcataactatagcgagggtactctcctgtgtcacagtgtgttgtggtgtccgagggggccttcgaagtccgtgcctttgagcttgacacgaggggcaggggttctggtgtagccaactaggtgtgaccgaggggctttgcctgtgcccacgagctttactgggccaggggtctctgaagtaccggcgggcgaaacttagcctgtgttgcccagttcctttttcaattctgaggagctggtagtactgtggccaagcgctcagatcggccagggggcaccagtcttgatctgcccaggtgcacacgcccaaaaccaggtcagcgatgaaggtatctgcagtctcccccgaaggaga

SEQ ID NO: 641785 - DNA, 445 bp, Homo sapiens
ctaactcatgcccccatgtctaacaacatggctttctcagcaaaaaaaaaaaaaaaaaaaaaaaaaaaaatttgggggccgccggggcccccggaaaaagcttcttggaaaaccattcgcgtggtggggcgcgcggcgggcccacagagaggtcacagtggaaccggggcgccaaacgcggtgttccccgagaggagaaaccgcggggcacagagaacaagggcgtgggcgatttcccacaatataagaaaagccccgcggggggaaacacgaggagtgagttccgagaacacaaactcccaagagaggcgaggttcggagagggcacataagagggggaacccttactccaacgaggagagtcccaagaggaggagcccgaaaatattccaaattatccgcgcccccggtccgtggggagaaaagacgaagaaaagacagagag

SEQ ID NO: 641786 - DNA, 416 bp, Homo sapiens
  misc_feature (64)..(64): n is a, c, g, or t
gtccgcctacttgtgttctgtccagccctcctaagattccaatccgtctcactcttcctacacnatttccctgaacctaccctacctgcacctttcaactggtcaatttttggccgtcctggaatccgttcttggaacttgcttgccattgcaattgctcaagttgggccattaacaccaaggcctggtcttcttaattaagaccaggccttgttttcaagcttgttctatcccttaaagaatgcttccccagaacccagcttccagcctctggaaccaggcaccacccaggccaggcacatcagaatccttcctggtagcttccggtcagggccatgcttttgcatgggctgggctgccgctctcatttttgtgtaattatctgacttctcttttatcactcagctcagctaatc

SEQ ID NO: 641787 - DNA, 546 bp, Homo sapiens
  misc_feature (148)..(148): n is a, c, g, or t
  misc_feature (270)..(270): n is a, c, g, or t
  misc_feature (299)..(299): n is a, c, g, or t
  misc_feature (329)..(329): n is a, c, g, or t
  misc_feature (336)..(336): n is a, c, g, or t
cctaatgaagtcatctgtcagatgccatgatagtgtgtctcgttacatagtaagatcaacgtgccctccttattcttcaaaattctttggttattcttatccttaccctttatatgaattttaggattcgtctgtcaagttctatccnaaaagcttttggcagattcttttttattggaattacactgaattttatgaattaatatggggcaaactgccatattttaatactgagtcctttcatctgtaaagatgtacctctttttgttncttaggtaaatttttatatgttcaataangttgtgtatagccagcatgtggctacaccngtatccnagtgctttggggggggcccaggcaggaggatcacttgagcccaagagtctaaggtcagcctgggcaacagtgagacccagcctccacaaaaaatacatagccaggtgtggtggtgcacacttgcagtcccagctactcaggaggctgaggtgggccaagatgaccactgcactccagcctgggtgacagagcgagacccctgtgtcttta

SEQ ID NO: 641788 - DNA, 102 bp, Homo sapiens
tttcctactgcattggggacttctagataggttaacgaaaggccttttattctgttactggacatgaaaacttgtctaatttcttactctactgtacgttta

SEQ ID NO: 641789 - DNA, 854 bp, Homo sapiens
ggcagtagacggacagaggagtcgtagcggtcgaggttttgggctccggcgtgcccgaaagtatgttatgcataaaagtggataatttacatgataaatgaaaatggcaattcttgaagaggagaagtactaaaatttataaaaatctggtgtatctttggacgagatctatccaaaaggagcagactatttcaaaaagcgttgaagaacattttccttaaaaacaaagatgtgaagaatccagagaagatcaatgaacttatgtgcacagggcgaatttgtatgaaagagctagaagcttgtgtacttccttaggaaatacagagtatgaaaaaggctattattcagataccaacaaaataatgtgatcattactattgaatttagctatcaggtgccagtgtttatgtataccagatgttgtaaaataattctaacttaaaaatgggagatatacatgtggtgtaaaaaaatccctgaggtgccctatgaactaaataggttcaacgttctgtcataccggagaaagtatcagcaacttatgctccatgtgtgtaccaaacataagcaattaagtataataacgatcataaattaatgagcaccaattggatgacatatatacatttaatctctaattaataggattagcaattattttagttattctccattaattggagaatgcgttacggacattatagcaataattttaccattttccttatttggaggaccctttttccctggttgtaaggtcccgggctaaaaaaagcggtgttttggtgatcaaaatggggatcacacggggggcacaacaaaaagggggcacggttgaataaaaaaccaagggt

SEQ ID NO: 641790 - DNA, 127 bp, Homo sapiens
cgctcactcggcaaatcagccaagcacattcaccacactgtctgaacctgcggttagaccgtcgtgagacatgttagttttaccctactgatgatgtgttgttgccatggtaatcctgctcagtacg

SEQ ID NO: 641791 - DNA, 173 bp, Homo sapiens
  misc_feature (80)..(80): n is a, c, g, or t
gtctagacgatcgctttagtggttgtgagtagcatgctcgttgagattcatcaccaatccctaatctcaagtaatcaggnacacaaacactgcggaaggcgcaggtcctctgcctaggaaaaccagagacctttgttcacttgtttatcttgctgacctacccacaaccactg

SEQ ID NO: 641792 - DNA, 202 bp, Homo sapiens
tggtgcatattggccttggtctgcatatctgtgcctctacgttattgtgcatactttggttttaagaagaatgccattgaacacccagttcgaaccaatcagagttccacgtcagagttcctgaacagtcgttctacacgaaggcctttccttggtattatcatgggaggggttttgccctttggctgcatctttatacaaa

SEQ ID NO: 641793 - DNA, 346 bp, Homo sapiens
cgccgactcttgaggatacccgaactcatcagccagcagtgtataagcattcccttttctccacaaacttgccaacatctgtttttttgacttttttggggggtttttgttaacggagtctcgctctgttgcccaggttggagtgcaatggcgtgatcttggcttactgcaacttctgcctcccaggtccaagcgattctcctgcctcagcctcccaaatggctgggacttcaggtgcatgctgccatgcccgactaactttttgtatttttttttctagtagagacagggtttcatcatgttggccaggctggtcttgaactcctgagctcaggcaatccaccca

SEQ ID NO: 641794 - DNA, 527 bp, Homo sapiens
tggacctggaactcccgggggggcatgtgatggggagaaggtggtgcaaataggacatttacgaaccacagaaaaactctggtacatgtctagcgcctggcatcagaggtgtgcagctgcgcagaagtgggctggagccagcgctatttgtagaggatatcgtagtgtccaggccggtagacaaggtagaccttggcgctcggagcccgtccagggcaagatgtgcgagattggttggtgtcgcccgtcgccgcagttccattgtactccatctgtgatggactacgctgtatggcctgggccagcgcaatgatgtggatgtggtcgctctccttgcacatggtgtccatctcctgctggcagaactccttgacatgtccgtccagcctcgatgaattgctcgaagaacttgctctcgcgctgcaggtagcccgaggtgagcagccgcaggtagaccataaggtactcggaggtgctctggtcattgaaggaggccacaagtcggcgacagaggtctgcttctccat

SEQ ID NO: 641795 - DNA, 429 bp, Homo sapiens
catctcctcccactcctgggtcagtcttatgcctcagcctgccaagtagctgggattacaggcgtctgccacacacctggctacttttgtattcttagtagagatgggggttcaccatgttggccaggctggactcgaactcctgacctcaagtgatccacctgcctctgcctcccaaagtgctgggattacaggtgtgagccaccgtgcccagcccacttgttcttttctggccctcacatcccagtcccctctgagacagccatctctggcctcatagtgcaggtcacaactctcacttctaggcacatctccatcctctctctagacccacctagggaggggtgcatgtttagaaagttgctgactttggcttcagggtgggagtgggaaaagggttgtccagttctgaagcagaaggaggtggga

SEQ ID NO: 641796 - DNA, 234 bp, Homo sapiens
  misc_feature (129)..(129): n is a, c, g, or t
gctcaccttcaagggcattcttcgggggtgcatcagagggagggcagagcctgaaggatctaagcgaaggcttccccgggtgtaatttcctagggctgtttgtaaggaggagatcgaattcgcctcctnctatcaagcctctctgctcctgacttttagtttggatgccggcgctactgactgtggcctcccgcctttgttactaccccggagtattggctgaccatagcctct

SEQ ID NO: 641797 - DNA, 352 bp, Homo sapiens
  misc_feature (110)..(110): n is a, c, g, or t
  misc_feature (328)..(328): n is a, c, g, or t
aaattgtcacatgttgctgagcatcagggggaagtaagtgatctactagatttatgaacaaaatggaatggaatagcgattcgaacggaatgcaatgggaatggaatggnaatggactcgaatggaatagagtcgaatggaatgggagtcgaatgggaatgtaatcaaatgggaatgggaatcaaatggactgggaatttgaatttaaattgttaagggagcagaatgggattggggtgtttatccaaaagatatccgattgggattgggattgccagttggattggactttgattgggattggaccttgggattgggaattgggatnccgaattgggaattgggaattggg

SEQ ID NO: 641798 - DNA, 214 bp, Homo sapiens
tgctgagagacaggagggagctgcacagcaggggaggctgagcacagacccttgagatacagtaaataacaaagccctaaaatcactagtaacgagcatgactggccacctcccccagaggccggcagccgccaaaatgtagtgcttggagttacagggggtgaccctcactcttaactacccacaagggaggactaccaaagagtggtcagtt

SEQ ID NO: 641799 - DNA, 105 bp, Homo sapiens
cgcccgggtgtgtacatgcacctacggggcattgagtcagctcccccaagatgagctgcagccccccagagagagctctgcacgctcaccacagtaaccaggccc

SEQ ID NO: 641800 - DNA, 927 bp, Homo sapiens
  misc_feature (73)..(73): n is a, c, g, or t
  misc_feature (127)..(128): n is a, c, g, or t
  misc_feature (192)..(192): n is a, c, g, or t
  misc_feature (194)..(195): n is a, c, g, or t
  misc_feature (205)..(206): n is a, c, g, or t
  misc_feature (259)..(259): n is a, c, g, or t
  misc_feature (355)..(355): n is a, c, g, or t
  misc_feature (445)..(445): n is a, c, g, or t
  misc_feature (467)..(467): n is a, c, g, or t
  misc_feature (486)..(486): n is a, c, g, or t
  misc_feature (531)..(531): n is a, c, g, or t
  misc_feature (555)..(555): n is a, c, g, or t
  misc_feature (558)..(558): n is a, c, g, or t
  misc_feature (593)..(593): n is a, c, g, or t
  misc_feature (608)..(608): n is a, c, g, or t
  misc_feature (634)..(634): n is a, c, g, or t
  misc_feature (640)..(640): n is a, c, g, or t
  misc_feature (661)..(662): n is a, c, g, or t
tagtatgagctgtgttaaatctggccgaggcaagcggcggtgctatggctgccgagctcggcctggaggcggngagaacatggtgcgcaggttcttgtgtgaccctccggattcggcgcgcgtgcgnnccgccgcgagtgagggttttcgtggttcacatctcgtggttcacgggggagtgggcagcgccangnngcgcccgccnntgtggccctcgtgctgatgctactgaggagccagcgtctagggcagcagccgnttcctagaagaccaggtcatgatgatgggcagcgcccgagtggcggagctgctgctgctccacggcgcggagcccaactgcgccgacccctgccantctcacccgaccctgtgcactgactgctgcccgggagggcttcctggacacgctggtggtgctgcaccgggcctggggcgcggctggacngtgcgcgatgccttggggccgntctgcccgtggaccctggntgaggagctgggccatcgcgatgtcgcacggtacctgcgcgcggntgcggggggcaccagaggcagtanccnttgcccgcatagatgccgcggaaggtccctcaganatccccgattgaaanaaccagagaggctctgagaaacctcngggaancttagatcatcagtcaccgannggtcctacagggcccacaacgttgccccccgcgccaaagaatcccacccccgctttcgtaggtgtacactaggaggacgaactcgaaggcattcataagcaaccaatggttccgtggccattctcagagcgttacgactattagttgcctttgcccgcccagctagccggtcagcgtggtccgttgatagtcattttttctcactcatattccttcatacacaaggtgtacagccacggaccgacatcaaaaagcgagcacaagc

SEQ ID NO: 641801 - DNA, 322 bp, Homo sapiens
  misc_feature (77)..(77): n is a, c, g, or t
gttgggagtaacgctgttttgttttggcaggttaaaggggcccggccaggattcgggaaagggtggcctaaaaccancaataacttttggggtcattgtcccaggagggatttcacttggaacaaaagttggaggcacccgcttgcccaggaggtttgtcccttgaggcgtttcgccagtaaggtgggggctcagggcctcaatttttttttggagcacgggttggggtgggccggcagtttacgggggggccagtctttgcccacaacaatgtggagccctgtgaaagtgggatttgaataaagggccaggtgggccccca

SEQ ID NO: 641802 - DNA, 638 bp, Homo sapiens
atcccagctctcagggaggctaagaggcgggaggatagcttgagcccaggagttcgagacctgcctgggcaatatagcgagaccccgttctccagaaacaaggaaacaaaaaaaaccaaaaggacaaaaacaaacaaaaaaaaaacacaaaaaacaacaaatgtggggcgcgccgcgccgcggcgccctcgagaagagcctttcaaagacaccacccgcgggggaggcgcgcggggggccccaaaaagaagggaaaggagaaaagtgggcgcaaacgcgggggcccctagagaaagaacccgcggggcccagcgacacagcggagggaggagtctctccaccacaaaaataaaaaaaccgcccgcgggggagcgccccccgagaaccgcggttctagcgagaagacaactccccaagcgagggggagagtctaaagagaggcgcaaaatcagggggggtctctatatcaaaccgcagaggggagcgccacaagcggggacccccaaagaatatacaaaaatgaaaaagcccacagatagacggggggagaacaccgtcaaacacgcgaaacctaacagacgaagacgacatcaacacgagacaaacagcaacagaaatagccaccaccagcaacgagg

SEQ ID NO: 641803 - DNA, 233 bp, Homo sapiens
tatataatacaaaaatatagatagggcatagggggtgtatagcctgtaatcccagctacttgggaggccaaggcaagagaatacacttagaacccaggaggctaaaggcaggagaatacactacgaacccagaaggcctaggtatgcagtagagccagagatacactagcatagatcacgccaatagcatagatacaagagtagagacagggcaagacaggaaataacagcaa

SEQ ID NO: 641804 - DNA, 422 bp, Homo sapiens
  misc_feature (382)..(382): n is a, c, g, or t
gttttgaaaaagatgtgggttccttttggagtctagtgtaaggtgctgagaccttaacaatgggctaatacagtgaagagagtctacaataaaggtagtcagcactattttctgcatccagtgtggtggcgtttctcacctgaagagtaatcaagataacatcggtcatcttcctgggttaatggagtgaaagtgcctctcagctctaggggacagggcagagatgagagaaagaaagagggggtttcagaagtgtcagggtggagtgatcccaagggggatggtggtggcattagattaagctgaataattaatctcaattggggcagtgatcctgcttttggtaacgccggggccaatggtctccggtaaggacggtggnttcaggcatgtggtccttggtagggactaatggtgctgaa

SEQ ID NO: 641805 - DNA, 1028 bp, Homo sapiens
ttaacctcgtccctcgctgggtttctattgtgggtcgccatctgagggatctaacgccgttaatccgagcatttgtgtagacttcaaactttcgtaggttctggttttccgcccaaaagttttcagtcccatgtaacagaaattcagccaccaagaaagttgattgcttcctagaaaaggttggcatggaaattcacacaaggctcaatgacactatatccataacttcttgctaacgatcccagcagccctccttcacgtggcgcagatcagatccagacaagctttacccaggcaacggatagccaggggaggcctgctcaagccctgcgggaacgcgcccctagactaagagttactagtagtttctgaattctgctttcatgcagctagatccgtttgtagaggacttcaaatactctggtctcgctctccagcgacgactcgaccttctaaaccgtactgcaagaaatggcaattgcacgttgatgctcacgtccaacagacagactgtcatgtgcgctagactccggccatgatgtccaacggatgtggcagctgttgactgccagtgtcatctaacgtcatcctgtcctggaggattaaacacgatcgtatgtcccttgggaataagcaccgatacaggcttaagctcataagatagataggagtttatccttttaccatcgagctacttccccataataaccactgttgcatccaacactcttcacccacctcccataccgtcaaggggattagtggatagcttggtcccaaagtaactggtggtaggatatcttagaaacaagaccacttatactgtctgtctgaggcagcagataacagcagcatctcgagccagcctctgccttaaaggcaaatctttacttcaatcacgtatggttcacagataattctttttttaaataacccaacctcctagagaagcacaactgtcaagagtcttgtacacacaacttcagctctgcatcacgagtccttgaatttaacccaggggatcaaag

SEQ ID NO: 641806 - DNA, 361 bp, Homo sapiens
gtcttaaaaaattatttatttttttggatttgtaaatctgtggacaaaaaagggtttcctccccccttttactccctggggtcatgccagtgaaggaaaaggtccatttggttttccccctttttcttgctgtagtccaatgggctatgagcatcagcttactttgtcccttagagcaagcaaaacccagggcaagagtttcgttcagctttaaaaaggtttgcttttttttagttccagggccccttttgaaattgcccaaccagttttagggcccctttaaaccgggcgaactaggggtttaattttcccttttcatgttcaattaccagttcaaattaaaaaaaagggttattggaga

SEQ ID NO: 641807 - DNA, 231 bp, Homo sapiens
ggttgtggggtggggagaggggggagggatagcattgggagatatacccaatgctagatgatgagttagtgggtgcaacgcaccagcatggcacatgtatacatatgtaactaacctgcacaatgtgcacatgtaccctaaaacttaaagtataataataaaagaaaaaaaagaaaaaataaataaacttattgatcatctatgtgctaggcatattctctgtttgtatat

SEQ ID NO: 641808 - DNA, 194 bp, Homo sapiens
tagcccctggcttgctcaggtctgggtcgtgtgattgtaaactagtcaggtcaggatctgtgatagtaaactagtcggatcaggatagtgtgattgtaaactagtcaggtcaggatcgtgtgattagtaaactagcaaggtcaggatcgtgtgattgtacactattccggtcaggatcgtcgtggttgtaaact

SEQ ID NO: 641809 - DNA, 713 bp, Homo sapiens
  misc_feature (234)..(235): n is a, c, g, or t
  misc_feature (247)..(247): n is a, c, g, or t
  misc_feature (254)..(254): n is a, c, g, or t
  misc_feature (268)..(268): n is a, c, g, or t
tctcttaggtacgtttttttatctaacccactgtccagatgttgttgcacgcgacgcgcacaccaatgctttataatatagaagacaggaaattaagaatgatagaaaaggtgccgagggcatacagagaagcacctacactataatttcaaccatatattaaaaatccctattatttaatttacccagctccccatgtttcctgttacactcatgggtttgaggtggataggnncaacaataaatnctatagntatgaatgcacatnacagtgattcctgaaacacaaccttacccagcgaggccgccgatacgccaaccccccaccgcgccgcctcccctcatgcttcgtacgctcatattcctcgccgcttaaccttgagcccgcccccataatagaccccgagatgatgctgcggccccaccaccaagttgaaacgatttcttataagagacaaaaacaccccgccctcacatttatacaacacgagataatccacactgcacagaaactaccctaccataacctgacacacggacaccatgctcacagagaacaacttgatacacagggataaagctagaactctcccactgtaagagaaacaaaccaaaattatatgtcaacacgtctacccaccccgtccctcgtgtctcagtccatcccgcacccgccgcgcgccccctggccaacaaggactcatcgcccgcct

SEQ ID NO: 641810 - DNA, 345 bp, Homo sapiens
  misc_feature (31)..(31): n is a, c, g, or t
  misc_feature (94)..(94): n is a, c, g, or t
tacccccaaggagggtttgtttttttggttncgggggttcaaaaaattcccccccaaaaaattctttttttgggttttccggggggggcccaanagggggcccccccctttttttgtgtccaaaaaattgggggggggacccgggggttggaaaaaggggggccccttttttttggtgggggggccaaggggccctgcgggggggttttaaaaaaaaaacatttggcgggtggggggggaaacccccccattttatttttttttttttttgggggggggggggggggcccttttttttggggggcggggggtccccccccctgaataaattttggggtcccccca

SEQ ID NO: 641811 - DNA, 268 bp, Homo sapiens
tctacaaatgaggtggacagagaagacagacagatgaccatgggacccccctcagcccctccactgccacgattgcactctcccctggtaaggaggtcctgcttcacagtcctcacttctaaccttctggaatcccacccaccactgtcaagctcactattgaatccacgccgtccaatgtcgcaaagtgcaaggaggttcttctactcgcccacgacctgccccacaatcgtattggttacagctggtacatataggtcagagacgt

SEQ ID NO: 641812 - DNA, 300 bp, Homo sapiens
aaaaactttttaatttttccccccggccccagagaaaaaaattttttttttttattaccccccaaaaaaggccaaatttccaaattcccccccgggggcctttggggggggtttaaggccttttgggtcctgggaaagggcctgtcccccccgggggccccccaaacctttttaaattccaaattggttggggaaacaaactttttttttttttccaaaaccgccccctcccccccaaaaagttttttttttaaagaaaatgggttttttaaaaattaaaaaaaatttgcctttttttta

SEQ ID NO: 641813 - DNA, 435 bp, Homo sapiens
tttagaggcatgatccagctcgttacctgtctggagcagtgcgctgcggtgcaggcgagttctcgaacgcgcgcaggcgacctggaagttctggatcagtaccggaatgccggcaaggctgcgggtgatgaagcagttgttatcgggcagcagcgtcttgaggccggcgaacagccataccttgcggaagatcttgcgctgttcgcgggcgaagatgtccgtggacaggtagtagccggggtgcattcgcgatcgcattggcgggcttcctcaggaatccttgtggtaaatgacccgcgcagggttaccgaatacgctggcaccggccggcacgtccttgaccacgaccgaaccggcaccgaccactgcagcgtcgccgatatggatgccgggcaggatggtggcgtgtgggtgcacgatcgcatgcttaccgat

SEQ ID NO: 641814 - DNA, 620 bp, Homo sapiens
  misc_feature (19)..(19): n is a, c, g, or t
  misc_feature (31)..(34): n is a, c, g, or t
  misc_feature (173)..(173): n is a, c, g, or t
  misc_feature (176)..(176): n is a, c, g, or t
  misc_feature (179)..(179): n is a, c, g, or t
  misc_feature (486)..(486): n is a, c, g, or t
  misc_feature (513)..(513): n is a, c, g, or t
  misc_feature (561)..(561): n is a, c, g, or t
  misc_feature (569)..(569): n is a, c, g, or t
  misc_feature (589)..(589): n is a, c, g, or t
  misc_feature (618)..(618): n is a, c, g, or t
ggcggcacgagggcatggnagtataaaatcnnnnttttcattcatgaaactattaaaccttttaaaggggaaaaaatctctcttgagaatcttggaccaaagtctgcaccaaacatggatttggaattcaaatacattgttttccctgtctgtaaatccccaagttgagaaanttngtntcaaaatttctcctgaaagcaaaactgtctctcttcacagatgatatgattctatacctagaaaatctcaggtctacctgttataaccttcttctctcttttttgcagcaattatttttgttgaaagaattggttatttagacctttagcattttctacattctgtattttgctgattgcagagctgtgactttaatgtggttccctataaccctgtggatataatccatagctaatgattataacttctggtaattgtaccctccaatggaaaagagaacaactccagtatgagcaatctctctcnggccttttcagatttttccggtcaaanccttcaccttctggacagacctcaggacaactccaacttggtggctgnggcttccnggggtcatccacacaattgngggtcaataaacccttatagattttttcngg

SEQ ID NO: 641815 - DNA, 823 bp, Homo sapiens
agcgggctgcctctaggttctggcaagatggcgaaggtcccatgaccttgacgatgtcacttgtgcacgaaatgagagatatccatgagaacaccatggagacgaagaacaactcccgtaactagtgagcaacattgtggtagagttgtgcgaagaatgtacttatctgatatatgcttctatgctgggagatgatatttggactcatcatatgaacaggtgcatgattgcagcaacatatgacgtatggatcgtgcgtatgactcgtgccattggtttgtcttcaagagctgagaaagacaggttccctgggccagatcacagagtcgagtcgattaacagtgcatgcagtatttgaagccatcgaaagatctgtatgatgctgtacaatcctatatgtatgggattttacacagaacgatccaactaacactgctgctgaggaacagcgtatagcattgaccagttcgaagaatgcccagtgggatatctactgtgtgatggccatttcggcgagactgaaatgacgttatctgctaaccagattgggctcggagcaccaacagtaaagctctggcagttgaactgtgcaggagatcttcaccatcaatgaccagtgactatgcaaaagcagtctctatgtgtccacaggaactaatgatgactaatgtcctcagaaaccatcttatatctgtcatggcagtatgtctgaaagtgaagtgataccctaagtggacttgaaataatcctcgcaacctttcaaagaaaggtatttttgcaccaggcagttgaatacgtgaccaccacgacgataatatgacta

SEQ ID NO: 641816 - DNA, 169 bp, Homo sapiens
agtgctcagccatcttaagccgcgtttgcaccccgattgatttattcgctgcttcaagctgttcgctgtgtggtacacatccttgaaaggtcgcagcagaggattacctgtgtggagtacctgtgtgcgccatgggcgattcgtgctatttaatcttctacaactatgt

SEQ ID NO: 641817 - DNA, 168 bp, Homo sapiens
gaggaaccacaccgacaccccatccactttatctcagtagagaggtttagaagcagtgaagcacaagtgcagcaagagctgcgagaaggaggagcgggcagcaatggcgaggcacagcctccttgccgtgctcctcgtcgggctagtcgcggcctccggcttcagcca

SEQ ID NO: 641818 - DNA, 263 bp, Homo sapiens
ggcagataagtatggacgggatgagtagagagagttcctggaacaagaggtatagaactggctggcgtgtagctcacacctgtaatcccagcacttggggagtgcaaggtgggcagatcacttgagttcaggaggttcaagaccaggctggccaacatgatgacaaccccatctctactaaaacacaaaaattagctgggtgtggtggcgcacgcccgcaatcccagccactcgggaggctgaggcaggacaatcgcttgaac

SEQ ID NO: 641819 - DNA, 809 bp, Homo sapiens
cccgcctggccctgggactctgaccctcggctaccctttcctgccccactagcgtggccgcgagcctcggtgagcctggccgtattcccgctctcgcttagtggggcacagggcttgcagtgcatctgtgccctgtgccactccaatgccttctggtgctgctgggctgctgtcttggtgatactgtgtgccctggtgagtgctgccagcccatccgtcctgccctggttgccctctcaagggaacatgctgaacctgtgagagatgctgcctgagagagtttgggctcagtgccaacgagagctcatggctgcactgggtgtgcccccaatgccctgttagctgccccccctggaatggctctggggtgccaattgggcccatcactgtgggatggttgtgtgcccgtgaggtcggccttgcagggccatgggaggaacacacgcattgccccccctgttgggttgccctttgcgcaaggtaaccattttacagcaagagaggccccccaatatagaaataggctacggagctttgggaggtgctccaattaaaacaattccttggctatggcaggcaggtatgaccttccagggacccactggcttagcattgtgtggtgcacaacttggggaagaaatgagcataaaaagatggttaggtacagagatggccgcactatgaatcagatagcccctcgtgagaatgaaccctttcacacggggacatagacggggacacacaattgctgggagcacaaaaaccatggggcatgcctggggccaaaactgtttaaccaccagaagctg

SEQ ID NO: 641820 - DNA, 431 bp, Homo sapiens
  misc_feature (20)..(20): n is a, c, g, or t
caacccctttttaaaggacntggtttttggttttaataaaaaggtttgttttttccccaggggttggtccccaaggggccctcctgtccccccaagaggggcccctaggttagggccccccttaattcccccgggcccccccccccccctttgggcctgcccctggggggttttgggggcattgctgggaattagcccccctggggaaatgtcccaaattgggtaaatttaaacccggaattgtggggccatttatttaaaacgcccctaaaagcaggaaccttccccctaggggggggggggggaaaggttaaattttgttttccgggggtttttggggcccttttggggtttttaaaaaatgtttttggggggggttaggccccccccctgttttttttcggggcccaaaaaatttgggggggcttcca

SEQ ID NO: 641821 - DNA, 1141 bp, Homo sapiens
aaagccatttatttaaatgacagatatgtagatataacgggataaataaaaaaagtgtgaaatcgagattgtgaagcaggtggttaaaattataaactcattaggggccacttccctttggacaggtgtttcccccccagtcccagaacagatacaatgtggcttcagaaatttacacattagaaaagtgacagctccttcccttccaccctcgccaagagctcgtgaaccgaaaggccccacacaagaaacgtgaatttcagttgggaaccaagcacccccttcggccccgtgcctcctcttccacccttctccgtgcatttctaagcgatattatattttatacatttcactccgtgttccgtggaatccagcgcgcccgtaactttccggcggagaacgagcaccagaaggcgtggtgtgcaccagaaagctttcggggcagaggcccaagcacccactgtgtgtgtgtggcccaaattcgtgggggccctgtgccttggccctgtgccccttccctgtggtttcaccttccccacaaaaacaagaggggccgaacacccagtggacttccaacagatgtggaaagaaagacaagggtacgaggattaacgcgggcgcggcatccctttgagatacgtgttaaggtgccaaaatttcaccagggacaccccttgaaacccccaaggggcccccagggggtatacaaatcatcacctggtgccgtaccggagaaacacaaaccgtcgatagaagtcccaaaggacccccaagagaatcctgggtgtgcaattcccccctcctctaaagggcgaaaaggttgggaaacgggtccaagagatataagacaaaagtgggcaggcgaggcaacgaaaagaaaatgtgaggggaacacggagcatataacaagtaggaacacctcccggggaaatactaaaaaaaaaacaacagaaaggtgacggaattcacaacacagtggagggaatcaggaaaggggccctgtaaagcccaagagagcccgaaaatatgccacacggagaaaggggagattagagatgaacaatggtaaaacgcagcacacttgatgaccgcggagaagaccacacaaggagagaacagagaagaagaaagcaagtaccag

SEQ ID NO: 641822 - DNA, 100 bp, Homo sapiens
ttctccagcctgggaaacagacgcaagactctgtctcaataaaagaagaaaaaaaatggtaatgaccatgtatttattctgagtacaacctgccggctgg

SEQ ID NO: 641823 - DNA, 193 bp, Homo sapiens
cgccgagccagcgcctgggcctggaaacggggcgtagcccccccagtttcgcccaccacctccctaacatggacccccggaaagtgaaagaacttcgggcctttgtgaaaatgtgttaacaagatccgagcgttctggacaacgaagaaatgcgcctcctgagggagtgggtggagaacattggtggttaaat

SEQ ID NO: 641824 - DNA, 337 bp, Homo sapiens
tggttttggttttggttttggtttccaataagaattaaagaattctaagtggttgagaaaaactggcgacaaatttttatgggagacaaacgcctaaaaaaagaagaaatggtggtttggaatcataatcataaactcactcggatagtgaataaaagagagggaagagtttgtggggtgccaattaattttctctccttttcaccgtgggtgtgtgggcactttaaatctcagtgtggcacagagtgtttttctctcgtgttcacccaacaattttagcgcctttcaatataaagagtttataaagtgtggctcttaggtgcacattctcaaaaaa

SEQ ID NO: 641825 - DNA, 686 bp, Homo sapiens
ttacagcgaaagaggatgatcaggacatccgtcatcaaaaggaaggttaactctgtgagatgaatgcacacatcccaaagaagtttctcagatagcttctgtgtagattttatgtgaagatatttccctttctactgtaggccacaacgtgctccaaatatccacttgcagattctacaaatagagtgtttctaaactgctcaatcaaaggaaaggttcaaatctgtgagatgaacaaacacatcacaaacaagtttctcagaatgcttctgtctagtttttatgtgaagatatttcattttccaccatagactcaagacgctcgaaatgtccacttgcagattctacaaaaagagtattttaaagctggtccaacaaaagaaaggttcaactctgggagatgaatgcgcacatcacaaagaagtttctcagatagcttctgtctagattttatgtgaagatatttcgttttctaccacaggccacaaagcactcgaaatgtccacttgcagattctacaaaaagagtgtctccaaactgctcaatcaaaagaaagttcaaatctgtgagatgaacacatacatcacaaagaagtttctcagaattcttctgtctagttcttatgtgaagatattccttttccacattagacctctagcgcccaatgtcattgcagttctaaaaaa

SEQ ID NO: 641826 - DNA, 421 bp, Homo sapiens
tccccaatgatggtcctcagctccagcatcaatggtcaatgtgctcccttgggctggagctgcagcagccgtacctgttctttgctgtgggccgtgagctccccgtcagctacctgtgggatctgggggactggtgggcgtctcgagggtccggaggtcacccacgcttacaacagcacaggtaacttcaccgtatagggtggcctggctgcaatgaggtgacgccgcagcgacgccctggctcaatgtgactgtgacacgcggcgcgtgcgggggctcatcgtcaatgccagctgcccggtggtgccccttaatgggagcatgagcttcagtacctcgcctggaggccggccgtgatgtgcgctattcctgggtgctctgtgaccgttgcacgcccatctctgggggtcctgccatctct

SEQ ID NO: 641827 - DNA, 147 bp, Homo sapiens
atgatccacatatatccaggagaggggaagggaataggtgcagatacactgcacagttgcgtttatcacaagtgcctggaatacgagaagcagcagagaatattcactttcacagatgatccctgtgtgccaatgtggtcccccaca

SEQ ID NO: 641828 - DNA, 925 bp, Homo sapiens
tgtcttgatgtcctttgtagtctgaatgacgttttgccgtctatgttcatgttaagtccagcttttaccggatcctgttctgcacatgagttggcccttcttgtgggcctgaacatcccttacggttacaggttggtcattttatcctaccatcgccccctgggcttcccctatgatctacatccaccgattctggccgtatgtccttttcagggtttgcaggttcaaggtccatcaacgctggtgacacatgtacgattatttcacctgttgctacagccatcgaggagcagttctagtagatagctgtagtgagttctccgttggaagatttccgatggtgtctacagatctctcacacaggtcaacgttggtttcgaagagagtgttgagatcaaactggaagcaggcccactgttcgaccgaaaagaaggagatcaacaaacggaagcagctgatcctggaggggaaggaccctgaccttgaggccaagcgcaaggctgagctgtccaagatcaagcagaagaaccggcgcttcatacggacgaagcgtggatggagacgcatgaagcgacagaaggctggcagggctggccacaagggggcgtccacccaggacaccgtctgggtcccactcaggcccagtcccctcccagggccttggatcatgagccccacacggccatactgcccagtccgtagactcgtccatggagactgagggtcggaggaacgcttacctctggagggcagacagcccgttacctcgggggcctaccacagatgcctcacagcagaaccacgtgggcgctcagtgtatgtgacgggccatgctcctcagccccagaaaccactggctggccccattccctgagccctggcgcaagattacaggctgacaggggaagaaagaacatgaccggga

SEQ ID NO: 641829 - DNA, 1324 bp, Homo sapiens
  misc_feature (1228)..(1228): n is a, c, g, or t
actctgggatcacggcaatacatctgggagacgactgtagtaagactggatcctgagccagttcgccatgtggcatccaatcaaggcgtgctagaacgatgaattgtaagagttgtgcgtctccaggcagacgcactatctctcacgccatgcgggctctacgagtgcctcgtcgaggagctgtacatcattgcgacatagcatgaatgggtaacactgtagaagaattgttgctactagtcgacacgaagagacgtctgttatccaatgcgttagatgattagcatagcttgaatgacgattcgactctcgactgtatagagtcagccctatggaagtagatcgcatttatcaactcctattgaagtattacgctaatatggcaactgcaggccacgtctgaaattccatgtggctagtgctgcacctggacagcttgagcttgcttgtgcagtgatctatgttctctgatgaggaattagtaagctaccattttccaagagtcaagggaagaatcgaaggaatagtccatgggacgtggaaaatttgtgggtaaagggcaagctgttcgagaggacgaatggtaatttgatagacagagagggtgctcagggaaagtacaatagctatattgtgagctccgatccacaattggggccttcctctaggtagcggagaaccaattgtagatacctttaaatgtgcgctcggaaccatagaagaaacaacgtggatggcgatggattgaaggcgaaaaaagggtccagaatggcttgacttggctgtacataggacgcccaaaagggtcgaacgcgttcagtctttgaaaaggagttctttccatactttttcgcaaacgtttggtgtggctaacaattcgccgtaaacgcccaaaagggcacaaaacgttcataacttaaacagttgggttggcttggacccaaagtacgctcgagttctagcggacagtataaaccaaaagcggacaaggcgcgaattttagttggacattaaccccgccatagcgcatataaattactaaaagaccatttttggtatcaaaaaagttggcaccccgggtttgaacaactctggtttgccaaggtaccaccacattcaaccatgggaattttttcccatgccttccgaaggaatttacgtacattgatgccatttatctccaagatggtccttttctccttgcaaaaattccacgtccagttggttntccccatgcgccccttacaacattaggagagcggcctttttctttttgaatctggataatccccatggttgagcacaagatacaatttgcgctaga

SEQ ID NO: 641830 - DNA, 109 bp, Homo sapiens
cataatctacaggcgtatgtaaaagacaggaagaatactgggtcatagtttcatccagtgtgactctgtgacatccttcactagaaggagagtacttttttcacacagt

SEQ ID NO: 641831 - DNA, 139 bp, Homo sapiens
aagttgtctggatcaggaagaatgaggttcgagtcagtggggtgaacaagatcaatgaggagctttactgcagtgttagaacagctcgagaggagtgccctggcagagggtagttccacctgccagcttggtaggtctt

SEQ ID NO: 641832 - DNA, 165 bp, Homo sapiens
cgatgctctagaggatcctcacactgggtcgagtacacgactaggctgtgcaacttaagaccttgtttctacaattaatcaggcgtggtggcctgcacctgtggtcttggctactcaggaggctgaagtgggaggaacacttcagcccacacggtgtgaggttac

SEQ ID NO: 641833 - DNA, 221 bp, Homo sapiens
tgaccaacaaaatttcagggagtaataaaggctgtatacagagtttaaataggatgatgttttaaggaagtaattgattggtaccatggcttacaaccttaattcccacactttgggagggccacacacgtcagtgtgaactcagagagtgtcacgagacacacctcggcacacctagagtacaccccatcctctcatcacaaatataaaagtttttgtgt

SEQ ID NO: 641834 - DNA, 988 bp, Homo sapiens
cggcgagcatgctggtgcagcggctgcaggcctgggcggcggcggctccggcctgggacccgatgccgggtgacttcctgtgcccgctaccgggtggtatcgaacaagctgaagaagcggttcctgcggaatgccgaacgtggcggagtgccggcgagcagttcggacagctgggccgggagctgcgcgcccagggagtgtctgccctacgctggccttgtgccagctggctggtggcgcgctgccaggcaggcgctcttccactgggcccggggagtgcgctgtgcctcaccgaggccgcccgcctcttcctgcggcaggagcgcgacgcgcgccagaggcctggtctgcccctgccgcctaccgtgggacggcctgttgctagggccggccggccaggcgccacttggagaatcccggggagagagatctgacacccttcaaaaagccatggagaccaaaagaacaagagccaggaaaagaaccaaaccgaacaacatataagcacctataagatgcaatgtagacgaaacacgaaccaatggagagcaaaccctagggaccaaaagaaacagagaaacaggcacacacagaacggagaaacaaaatatacaagacaagaacaacacaaagcgacacaaaagagaaacaacacaaaagatgccggcaaaaaggacagaagaacgccacgcgataggagacagaaagacgcaagacaaaggggcaacacaaatgtagaacaaaaaggggaaaagaagcaaacacatatgacacaacgcacataaggacatagagacaaacgcgcaagaaacataaaacagacaggagaaaggcaccactagaagaaagaaacaaaaacaacgacaccgcacaaattatccacagagcaggaccatgtcggagagaagagaagaaaaacaacaaaggaacaaataccaaaaacacaacgaataaggaaagaaaaagtaagagacgagagaagagaaca

SEQ ID NO: 641835 - DNA, 104 bp, Homo sapiens
gggcgacctagaggatcccctcccaagatgaggaattgatctgggtgtggacatgtatgaattttagtgcatatagtaagatggggacatcttgggagcaattt

SEQ ID NO: 641836 - DNA, 162 bp, Homo sapiens
cctgccggtcgcatctcacagcatccccgcttctgcttctgccccgcttctgcttcctgcttctgccttctgctgcttcctgcttctgccttctctctgctgcttcctgcttctgcccaggtcttggtgcagggggtcacgcagctcgcacattcgtaatcc

SEQ ID NO: 641837 - DNA, 159 bp, Homo sapiens
  misc_feature (24)..(24): n is a, c, g, or t
  misc_feature (32)..(33): n is a, c, g, or t
  misc_feature (50)..(51): n is a, c, g, or t
  misc_feature (69)..(70): n is a, c, g, or t
tttagtggcagccaaaatcttcangtgtgatnngaatggtgcgctcaggnncagagacctgtttcttgnntcattcacagtgaggaccccatcagatacaggcataagtaatggtgagagggtctacatcagctgggatccggtatttcctgtggaact

SEQ ID NO: 641838 - DNA, 202 bp, Homo sapiens
  misc_feature (152)..(152): n is a, c, g, or t
  misc_feature (162)..(162): n is a, c, g, or t
  misc_feature (178)..(178): n is a, c, g, or t
caggtgtgagaacttgaagctcagaagcctcggtcagaaatgctgagcccttgcttggggatccagtaaaatgagctcagaggggagggggctgccgggctggggtcccggaggaatcaagtgtggggctcagtgtggtgctgcacctgctncataccaacnctccacgtgggctcangaggggtcgtgggccgctttttct

SEQ ID NO: 641839 - DNA, 116 bp, Homo sapiens
atggaatataagggtgtagacatgtaagcttgatacagtgtgcgagtatagtagtaggtgtctgtggtgctggagtttaagtatgagtagtcaggaatgacggtagatagttagtg

SEQ ID NO: 641840 - DNA, 95 bp, Homo sapiens
  misc_feature (66)..(66): n is a, c, g, or t
aaaagaaacgtaaaaggaataaatttgttatttgttaattaaaaaaaacaccttgagagtcaaccnctgttatggcgttaatctgtttcaagcgg

SEQ ID NO: 641841 - DNA, 93 bp, Homo sapiens
agggctctggtttttgtttttttgttttaatcattgggcattcacatggggcggttaaaatgggctggtttttaattaaaccaagaagtttta

SEQ ID NO: 641842 - DNA, 638 bp, Homo sapiens
  misc_feature (19)..(19): n is a, c, g, or t
  misc_feature (61)..(61): n is a, c, g, or t
  misc_feature (79)..(80): n is a, c, g, or t
  misc_feature (85)..(85): n is a, c, g, or t
  misc_feature (110)..(110): n is a, c, g, or t
  misc_feature (118)..(118): n is a, c, g, or t
  misc_feature (177)..(177): n is a, c, g, or t
  misc_feature (186)..(186): n is a, c, g, or t
  misc_feature (310)..(310): n is a, c, g, or t
  misc_feature (344)..(344): n is a, c, g, or t
  misc_feature (612)..(612): n is a, c, g, or t
ttttactcatccaaatgtnttttgttttgtttagttgttttttgttcaggttttgttcaangtccaatacagtcatggnnaatcnggggctagggggcctttataaaggngggtgggnttgggggcccttggggactgggcggtcttattttgggctagcatgttttagtcaaaggngtggggttnatcaaatatcaattaggggttgctggggtgcgcactcatgccaaatggcaactaacatgctatttcctactatgatggctctttggtttggggcagatggctttggaggatattgctagctatnccatgggttttgctcttctgcttctgctctctanagcggaatcttattttttcacataagcggctcatggaatcgaatgttaattaaagaaaagatagggtaagtacaactaggggaaagacagtacctctaattacataggaaatccatgaaagaattaatcatcataagagaagaatcatttttccagtagccccactaccatgaatgatattttcatgagcctcggccaccttctccaatggatattgagaacctatcacaggtttcaaccagccaatttccattccagcttgaagggntgctgcatattgctgaaattcctcct

SEQ ID NO: 641843 - DNA, 196 bp, Homo sapiens
cgtggatcgcttctatagggtgatagattggtccacttgggtgtgaggagttcagttcatatgtttgggatttaaataggtagtgggtgttagagctatgaacgctttcttacaattggtggctgctatttagagcctactcatgggtgttaaatttatttactactcatctacaacggtttatatcctagatgtc

SEQ ID NO: 641844 - DNA, 126 bp, Homo sapiens
aaatttatcacccctctttctaggataaacacatggtgaatgctgctgcgggggcagatgtacaaactcttgcttggtggccatttgggctatcagaccatttgaatgcctgagagcatgtttaat

SEQ ID NO: 641845 - DNA, 113 bp, Homo sapiens
tattatgtgcgtgtgctacaattagttgggatatctgagtttccctcgtgaagaaatggaaaaagtgttgggtgtcccatcgccgcctccccctccccgatacgggctaccga

SEQ ID NO: 641846 - DNA, 548 bp, Homo sapiens
  misc_feature (494)..(494): n is a, c, g, or t
gacaaggagggtattaatgaccacgattggttgaatgacgatggacgacactgtacacttgccacatgagggagctaatccgtcccgaagccaatactgccgctaaaggtatgatggcacatatacgaacagctaattcttaaagccggcgaatgattgatccaaaaggaagggacgcgtttatttataaggataagacttttgccaggatagaaaatataacctgttcactttcaaaaaagtgagaatgctcacatgtcgactatgacaccaaaagggaatacgctgagtacatactaattggctaaacatcaatgtgctggaacaagtctgtcgaacgattactctatgcttgagaaaatgaggagctttgtgactatgccataaactatgagagtaatatctgatggacccacatctactaacgtggtcgaaaggagtgaatacgctagctattacccttccgagcatgtccgaaacaagacagaggtatngcaactgctggtgccaagattctcgaatcggtgggatccacttagcttagagtg

SEQ ID NO: 641847 - DNA, 577 bp, Homo sapiens
aagtgtacacgatccccatctctaaaaaagaaaaagaaagaaagaaaaaaagggattgggggcagggcagaaagaagacttaacctcagagcctgtctggcttccatcctggtggggttcatgccttccctgccggctgtctgggtcctcccctcctgcccgagctgagaaaggccagctgggtctcctcttctgtgtgactgtttctggcctaggttctttctaacttcaacttcctgtctgtcctctggcctcttcgttctagctgtctaactctccgtggtacactctgctttttgttgttgttgtttgatttcctgttagctgctgcctcccagctgtttccagatgaggttcaacagctctctggggaggaactaagtgcaggggaagttgtggttattttttaccgagtcctgagaagtggcctagggattctgactgtgatccattcctgaactggcagggcttcacctcctgaagggtctttgcccggggctgactttgggtgtggaccagggtgtatgaggacttggatatgagtgtgcccagggcctgctgggtagggaaccgtgca

SEQ ID NO: 641848 - DNA, 102 bp, Homo sapiens
  misc_feature (6)..(6): n is a, c, g, or t
  misc_feature (13)..(13): n is a, c, g, or t
  misc_feature (19)..(19): n is a, c, g, or t
  misc_feature (24)..(24): n is a, c, g, or t
  misc_feature (27)..(27): n is a, c, g, or t
  misc_feature (44)..(44): n is a, c, g, or t
  misc_feature (62)..(62): n is a, c, g, or t
  misc_feature (66)..(66): n is a, c, g, or t
  misc_feature (71)..(72): n is a, c, g, or t
  misc_feature (91)..(91): n is a, c, g, or t
  misc_feature (93)..(93): n is a, c, g, or t
  misc_feature (98)..(98): n is a, c, g, or t
atcccnggccggngtcccnactcngcnttgggatagtgtgagcntcattttgtacacgtgtnactncgtcnngttacaaaccgggtaaacncngtagngtgg

SEQ ID NO: 641849 - DNA, 165 bp, Homo sapiens
gcgcaagtaggtctacaagacgctacttcccctatcatagaagagcttatcacctttcatgatcacgccctcataatcatttcccttatctgccttcctagtcctgtatgcccttttccaaacattaaaaaacaaaacttacctattactaccacttaagacgtt

SEQ ID NO: 641850 - DNA, 881 bp, Homo sapiens
atcccagcatctttggtaggctgaggtggtcgggcagatcacctgatgtatgggagtgtcgagaccagcctgatcaacatggagaaaccccgtctctactacagaatacatagcattagccaggtgtggtggtgcgtggctgtaatccctggtagtctggaggctaattccctttatgtatgtggttccagctaggagtagtggtgctttcacctgccgttaggccaatgtgatggtctcccatctcctgtgcctcgtgatccacccgcctcggtctcagatagtgttgggaacacgggacatcagcgatcggattggtccgaagctgcccagatcgtaactaggccatgccagtagctggagaatccatctggctgacattcaagattcccaaacagtcgtccatgaagtcagacttcaatacgatctgtcccaagtcttcatgcactgagtatgtagtacagatgtggtgcatcggcactcctacttctcaaagggatcctctacatgcaaacacaaacaaaccaacaaccaacacaccatcattcgcgtcccgcccaacctccccaacagcgtactcaccacctacccatcagcgcccggcccacaaggacagacgggcacaccggccctcaagctcgcacaagccgccaccgggcacacaccccgagcagagcaactccaaaagacacatccccgcccggcccacagcccgcaaaccagcaagaagcagaaccccacgcgcatccacagcgaaccaagacatacaaacccgcaagcgctccacccagaaaccaccgacgcacgcaaacagagccacccaccgccaccctccaacacccgacgcaaccatagaaccgaccacacacgacgcaccacca

SEQ ID NO: 641851 - DNA, 650 bp, Homo sapiens
  misc_feature (592)..(592): n is a, c, g, or t
ccaatgccccctcgtgcagtgccagtgggactaaggttttcattcatcaccagcttcctgagattttagtcctaagaaaagcacagggtagttcattccttgaagccagcttcctctatgagttctatacaaagcctcagtagagtgggtcccattagcaaccaagttgaacaacttttatttgctgtctgaatatagatacacctgaattgttgactgcttttgtaactaaacactcctctcctgtcttccaacgagtggtcatttttgtccgcaacttgaccacagcaatccctggggccctagctctactctcaataaagagttatggctgtgtgttttgaatgacaccttaggacccatcctgcctccacctccttctccataaaatagaaacctaactggcacctccaagctctgaaatgctgaaacttaccaactcccttttctccccgctatttcttccttccatggcagggactttcaggttttctttcttttactaacaaggcactaagcatgattttctcatacaaaatcgagagccataaagtggcttaccacagtcctatttcaataaagatgaatactngacatctggcaagtagtgtgtgcctgacagtgtccccaccgtgcttatctcaatccgg

SEQ ID NO: 641852 - DNA, 105 bp, Homo sapiens
aaaaatccttcactgatgtcttcaactttgatcttcatcaacagttacactcaggatttgatgtctcatacatgtcatgagtctcgaaagctactgttcatatct

SEQ ID NO: 641853 - DNA, 324 bp, Homo sapiens
gatccccttagacggtacccaacaccaattctgctaatttattttttgggctcaatcttggctcatcacaacctccgcctcccaggttcaacggattctcccacctcggcttctgaatagccgggattacaggcacctgccaccacgcctggctaatttttgtattttaagtagagaccgggtttcgtcatgttggccaggctggtctaaaactcctgacctcaggtgatctgcccgccttggcctcccaaactactgggattacaggcgtgagccacctcgccccagcctggatgaaggtgttttcaaagccctacctccccc

SEQ ID NO: 641854 - DNA, 257 bp, Homo sapiens
cttgttctgaagccactcgtgccctgtcttggctgtgtgcttagggtcgttgtccttttggaaggtgacccgtctcccccagtccgaggtcctgagcactttctctgttcatctttcccctcgatcctcacagaatgatgctgccaccacgcatccccgtagggatggtattggccaggtaaaaaacagtgcctggtttctcccagaagtgacacttggcattccggccaaatagttaaagcttggcttcaccagag

SEQ ID NO: 641855 - DNA, 347 bp, Homo sapiens
  misc_feature (12)..(13): n is a, c, g, or t
  misc_feature (33)..(34): n is a, c, g, or t
  misc_feature (38)..(38): n is a, c, g, or t
  misc_feature (55)..(55): n is a, c, g, or t
  misc_feature (58)..(58): n is a, c, g, or t
  misc_feature (60)..(60): n is a, c, g, or t
  misc_feature (95)..(95): n is a, c, g, or t
  misc_feature (113)..(113): n is a, c, g, or t
  misc_feature (143)..(143): n is a, c, g, or t
  misc_feature (146)..(147): n is a, c, g, or t
  misc_feature (149)..(149): n is a, c, g, or t
  misc_feature (161)..(161): n is a, c, g, or t
  misc_feature (167)..(167): n is a, c, g, or t
  misc_feature (175)..(175): n is a, c, g, or t
  misc_feature (198)..(198): n is a, c, g, or t
  misc_feature (208)..(208): n is a, c, g, or t
  misc_feature (211)..(211): n is a, c, g, or t
  misc_feature (231)..(231): n is a, c, g, or t
tttttttgaganngggttcactctgtcgcccanngtgntggagtgcagtggcgtnatntnggctcactgcagccccgacctccctcatcctcccntctcagcctcaagtagcnggaccacaggcgggtgcaccatgcccagcnaanntntgtattttttgnagaaanggggtttngccatgttgcccaggctggcctngaactcctgngcncaagtgatccactcgcctcnatttcccaaagtgctagggttacaggcgtgcgaccatgcccagcccagacttccttctcatccaggaaattccaaatgtctttacatacatattcttatattgtgtaataaaagat

SEQ ID NO: 641856 - DNA, 380 bp, Homo sapiens
atgcataaaagggacttcacttaactctattaacatgggtctcacatgggtcatcaccattcagctcttgtataaagtaggccagtatattgcctctcaacttctactagcaaattatcgagagtgctctcattcgctcttcttcatcttgaatgtgacccaaagatccatatcttcatttcatgcatttgaaagactcatcaatgacatccttggcatgagactccttgccatagtcctttcctatgacacatgtgcaaccatccactttacgaggtttcacctcagtgtctacttttcaaaggcctacccagtctcctagtttcgtgctgtcatcaaccttaattaggttgatttggtggtcagcacagagcctggtc

SEQ ID NO: 641857 - DNA, 725 bp, Homo sapiens
taaactgaagggggggtacttggtggcagcgggttctgtcatggctcagcctagtgggcgtccagctgggccatttcctgcactaatagatgcctatatctctcgctgtcaaaaagcacgaagttacaccggtttggagtggaagaggacattgtgtagacacgaagttaacgtggagagtggcctctcagaaactcagcgtgagcgtgcgtgatcgtgcttggagaaaaccgattccgtgccggctgccgagtggagtggaaatgtgcaagtggattttcagctttcttatccatcggccaggggccaagcaggttttatccacctggtgtcttttcccaagaagtgtttcttcaccatcttggttctggcccgcccaaatctgggactctattcacaggtgggatccccaaattcttgggcatggcagggccatgggcctggcggctgacaggcagcctccaaggttacttctccaagggggcccggtgtctttttcgccagaaatatatttattacatagcatttataccatctcctcactctcttagggaatacgtagtattatcggcgtcacaacgcttcattatcctctcgccttacttagtgcctagaagggaattaatacgtaatcgcgtggtccattatagctacgtctcataacccttcaaagacccatttcccttctttagccaatattgggggcctatggccatactaggtcg

SEQ ID NO: 641858 - DNA, 128 bp, Homo sapiens
aacaccacagccattgctgagggccttgggttcgcctgggagccacaaagttttgaccctgatgtattgcaagcgtgcctttgttcactggtacgttggttgaggggattgaggcaggcgaggtttca

SEQ ID NO: 641859 - DNA, 658 bp, Homo sapiens
agggcttatattgtgtggctatccgtgacttcaaacaggcagcagagctctttctcgacactgtttctacgtttacatcgtatgagctcatggattacaagacatttgtgacttacactgtttacgtcagtatgatcgccttagaaaggccggacctcagggaaaaggtcattaaaggggcagagatccttgaagtgttgcacagtcttccagcagttcggcagtatctgttttctctctatgaatgccgttattcagtttttttccaatcattagcaatcgtggaacaggaaatgaaaaaggattggctttttgcgcctcattaccgatactatgtaagagaaatgagaatccatgcgtacagccagctgctggaatcatataggtcattaaccctcggctatatggcagaagcttttggtgtgggtgtggacttcattgaccagtaagtttaagaaatttatgtatctaaactgccttttaatatgtgctttctacattttctgagtttacactgcttccctcagttttaaggaagagaatttctgaactattattttaacagtagcatgtgtccatgtctgccttcctcaggatacagtttccagtgagatgagcaaagcattgcttgagtaattacacaagtttatgtggctac

SEQ ID NO: 641860 - DNA, 282 bp, Homo sapiens
  misc_feature (75)..(76): n is a, c, g, or t
ccaaccgttttcctggggggggggggacccaacttttttccataacccccctgtgaatccccctcccccggggtnngaagatgaataaaaagaatttgggcccccccccgggcccccggggccccccccctggtttgggccgtttctttgcccctgggcccaaaaaaggatttggggccctaagcccccccttttttcttggttccaatgaggggggggaaacgggtctcccccccccttgcttggggcggggggggggtttaataaataccttttccttta

SEQ ID NO: 641861 - DNA, 493 bp, Homo sapiens
ggcggtcgtcggtcccgcgggtctgtctcttgcttcaccagtgtgggacggaacagatccggggactctcttccagacctccgattcgacctccgataggccatctccgtatggcaacctccgggagcatcttctcggccactctcctgctatctgggacctgccgagcagcgaattagtggttagcatccttcttggcaaaacaaagcagtgagctcccagattcgtcagagattattttcacgcggacgatggagggggagaacgatcaatattagtcctgggtcatatataggtgggcgtgcaggaccttccgtaccagggtgagcgctcatctactggcggcttgtcttataaaaagacccgaggattggatgatgggcgtgctggtaagcgaagatgaagcacttatgtgtcttacacgcagaatatcgggtccgaaggcaggagaggggcgaggggcataagagggggttaatcctggaaagaatga

SEQ ID NO: 641862 - DNA, 291 bp, Homo sapiens
  misc_feature (187)..(187): n is a, c, g, or t
tggataaagaggaaattggtttcccaggctggtgatttggggttggtaaacattccaggaggaattaaggagtgtaactatagttaatacttctataaggtggtcttacatttacattttaaagtgcctattggtttaaaacgtgatttattgtttctcttctaaagaggatagtgtgtacgtgggntttcataatctctttgggtttggcttttataaaaaaggcaagagcctatacttggtatttacctaataaaccacgaggtgacatcaacgagtcttttcaaaatt

SEQ ID NO: 641863 - DNA, 1443 bp, Homo sapiens
gcccttttatttttttattgggcaaaaattaagatctcgctattctttcttcgggcgtggcctcaccatgtggaagggatctcccaattttgtgaaaagaaaaacgcatgtggtgacagaccaccaagaaccagggcagacgacagatggtgagtggccgcggaagtgtgcgccccaatggtccaccccgcaccgcgtggcgtgtgcaccgcacgataggagctatcgcgcccaagaataaactcaccgcgacgagcagacaacgaacaaatgcaggagaaacagtctgcacacacaaaacaacgacacgaaaacatgcaacccacacaagaaaaatacaccacacacagtgggaacacaccaacaaagagaaagcacagaagtcctagacatcccagcagcgcgctgatcacacaagagacagagagtacccgcacgccagtactagaacaataccagcggaaccaccacagcacgcagccacaacgccgccgtgcgccgacgacacgccgacgccggcacaacaacggcgaagagcaacaagaggaagaaaaagacagcgtggcatcacacgaaaataagaggcgaagcagaccacgcagagacacacaggagtagtcgaggaagccgaaagaaaacaaacacctacaaagaggaggtggcgcagcagaaggaacaacagaaacaccgacagacggaagacaccgaacgaggcagacaacgacagtcagaaaacaacacaacaacaaagtcgaagaagacaggagacagagacggcgtcagccacaccacaaggaggcacaaagagacaccccacatcacaccatacacccaaccaaacacaccagacgtaacacagaccagaaggagacaatcacgagagacggaccagaagcgaccacaaccagagggacaaacaactagaagacagcacaagcagaacacacgcacacaagatcgacgtgctaacgatacatcgacaaccagaagaggacgtggagaacacgcccgagcaaggggaagcacacacgaccgcagaacacgacagagaagaagaccatccgcgccagacgtaagtagcgaaaccacacaggtcacagagaaaatgggaataaaacagagacgcaaaggccgacaaacagagacacgagccagaagaggaaaaaacgaaaccagggagaacgaaatcgcgctatcacgccgaggctagacaaaagagagacaaagaagcaaggagacgcacaaaagagaggcgaagtaacacaaaagccaagggagaagagaacagagcaggacccagccataagaacacctacaggaaaaacaagagaccgaaagaaaagaatcatacaccagccggagcagaagaccaaacaaaaagcacaccacgactaactagaacacaagatacaaaacaaaaaccaagacaaaaccacgacagag

SEQ ID NO: 641864 - DNA, 944 bp, Homo sapiens
  misc_feature (911)..(911): n is a, c, g, or t
ttttacccatttgtgtaccgggtctgatttctgccttatattatgtttctagtggctttgttttgttttccctttagtcctcgttgttaagccattcgttctgcgcgcgatttctagtgtggtactactagaggagagtttgaccttggaattcacctttttctacctggtgtcacttttccttgcgctcagttatcagactgtcgggtcttttggtactatcatctttggattgcaccgttcaggagtaccacgtccacatgtctctgacaccttaactgtctacttctcattgagtgtaatgtcttctggttctctgatccttaggcagctcctagttctagggcctgtcttccgtgatctgtctgtccagttgactaataccagtgaagatctcggcacatccttaggagatatggccaagtctagttccatttctagggactatgaattttactgggagtatcctccttctgttctgtcattgtgtgccctgattgtggccatctgtacgttaattgcctttttcggaggtctaacaaaagtaaggcggcttcgggtactgggactataatgcacagttctcatatcagctaaatgaagcaatgttggaagagcgagagaggctatgttcttgcggatctgcaagaaatttcataaattacgtggccctgtatatggcagcaggagctcagatacacccatggagtcgttaactgaagttcatctaatattcctgctatacctcctaatctgggaatcttatcaataatgttgtcgctacaaaatgttctcatgcgtggcagcataccatgcaacgagagactgaaacacaaagttcatttctgactgacattcctttctgcaactgacaggtggcacacacaaatatccggtctttgtgcttgctntaagctgggggggtggcttttgttataaaggcc

SEQ ID NO: 641865 - DNA, 635 bp, Homo sapiens
cggagtacgcacagcatattcggagtgaaatacactagcgctccatctcaggcatggcgcgctcgacccacctcccagtgttgtcaaagtacactgggccagagaccccgaaaaacatcccgaagagacaagaggctggagctttggacgtgtaaagcacccagaggacgccggacccgagtacaggataagggtacatcatacaggggagtggcataacactacgatcagtaataatcttgaggtaacgaataacgctccaaggaaggtaaaagtgcacttaaccgctcacacgtcagagcctacttgacaggctaccacgtgacggcccgtagtaaggtggaaaaaagcgctgaagcgcaatctcccggcgattttggacgcagacgaatgcccttcttaagatccgttcgtgctaggaaagcctgtagctacgacgctcgggttacggagccactaagccatcccaaagagcggcgagtacccctatgccgcatcagacgagcgcatgcgcatccgctccaggcatatgacgccaagagctttacgtgaatacgtctcaatcgtcgtaacataccccggtactaatttgaaagtccggaccggaccgcggcacagttcctagcgcccctcgg

SEQ ID NO: 641866 - DNA, 160 bp, Homo sapiens
  misc_feature (85)..(85): n is a, c, g, or t
gtcgactaactaaagagagcctttttgttaaagtaaaattaatcggttactttaagaagttggtccccattgataaatttttttncgcccgcaggttttttagtcgagctaaaaaccatttgtgataataaaatccaacttttaggactatttcaatgat

SEQ ID NO: 641867 - DNA, 654 bp, Homo sapiens
gccgccgcaccactggctggctccctgcgctcggcccgcgctttttcttgggcgccatgggttggtgcctggaccaccaggactggtcctgcacacccatgaagcgactgacccagctggtctgaagcaccccacgaggagccccactgcacccgcgcatctgccactggagggtctcggttgctcttggcctttaaatccctggtgagatggagaaaccgaggcaaggtacctcagaacccaggccagatccacacaaggctctcggtcagtcccagatggaagctccagtcccaggccgtgacatgcatcagctcccacacccaggattgtcccagagaaagcgctctgccctccccgtccacagcaccacgagggccataactgcactgccacacctctccagttccagagacatccctgagaggcagccatcaggggtgcccagctgaggacacgcctccttggggaccctcattcctgagtccatgcctccagattcacgatctcagagacaaccacatccgcaactggcacgtgtccccaccgaaggggctcaagtaagtgactggagtgaccaggtggatgggcctggagtacctgggtctatagcccacgcccggagcaggaaatgggggagacctggggtacctg

SEQ ID NO: 641868 - DNA, 571 bp, Homo sapiens
taatcagctcggtacctaaattaagaaacagctaggagcctgcgtgttcccagacacgcggctggggcatgggcctttacacacgggcctcgtctgggcagtcagtagagttggaaaaggcagaatgagttcatggtgatcctcagtctgatgctgatggccgcccctgccatcactctccgtccctgtactcgaatcctacaagcattggctgctggggtgactgcatgctaaaagtacccatgtgcctcagtttcctcaccagtaaaacaggtcaaatagtacagctgccttacagaatgatggtcagattaagacagtgaactcagggagcaaagaggtaagcattgtacaagtgctggccaggaccctctgaatcattatcatgcttagtaagcatcagaggggtgcaggcctccagcacttattcagcagaaagatcagcacccagccttcacttcctccctgcgcccagcatcatcctatggggcaggcctgggtgggggagctgcgggtccctgaggcaccaggtcacctgactgggccccctctgaggccttctctctccact

SEQ ID NO: 641869 - DNA, 389 bp, Homo sapiens
  misc_feature (44)..(44): n is a, c, g, or t
  misc_feature (75)..(75): n is a, c, g, or t
  misc_feature (187)..(187): n is a, c, g, or t
  misc_feature (196)..(196): n is a, c, g, or t
  misc_feature (199)..(199): n is a, c, g, or t
  misc_feature (213)..(213): n is a, c, g, or t
  misc_feature (256)..(256): n is a, c, g, or t
  misc_feature (274)..(274): n is a, c, g, or t
  misc_feature (297)..(297): n is a, c, g, or t
atagaaaatttcattataatttaatcagagttgactaactgganaaaggtttttccacattcactgcattcatangggcttctcccctgtgtgaatgctctggtgtgctatgagggttgacattctggactgaaggcttattgcacattcagacagcaatatcataagagattctctcacgcgtgtnagtactttnaantacaactaagtatncattctggataaacacttttccacattcagtacatttgtagantatctccccagtaatganttctctaactttttctaaaggcntgcctttcgcggagggctttccctcgttgattagggtcaaaaaatctctctgcaggttgagctttatgaagattataatggaagcatacttt

SEQ ID NO: 641870 - DNA, 390 bp, Homo sapiens
  misc_feature (37)..(37): n is a, c, g, or t
  misc_feature (44)..(44): n is a, c, g, or t
ggggataattcccagtgctttctactggaaaactcanaaccaantctgaaataatgccacatactgtgtgatttgcccttgctgtcccaaccctgttcttgctgccatttaaaaacaatcaggccaggtgtggtggctcatttctgtaatcccagcactttgggaggccaaggtgggtggatcatttgagctctggagttcgagaccagccagggccacatggcaagacctcgtctctgctaaaaattaaaaaaaaaaaaaattagctgggcatggcggtggttcatgcctgtagtcctagcactttgggtgccgaggcgggaggatcgtttgggctcagcagttcaagaccagcctgggcatcatagtgagaccctgtctctatttata

SEQ ID NO: 641871 - DNA, 2284 bp, Homo sapiens
tgttctgttgaattgctatgttcagcgactattcctagggggctggggcgcagcggactcttttcgtaactaagcacttgctctcacttcttgtgctgctgctggagctactaacaggctacaccccttacttgtaaaaaaacataactaactaacctaacaactgacacagaacacaacgtcacgcaccagccactctactctaacacgtgctaacctctgctcctagctacaacttgatcacgtagcaacctacaacaccaggaacaacagacaacaagaacaacacaacaacacaacaaacacagaagacacaaacaacaaagacacaaacaacaccagacaacaacgagagagggggggcggcggcgcgcggccaacaaagatatctatcctcaccctagggagagggcgcgccccattcctctcgcttacacccctgttccaccccgcgcgcacctcttctctgagtgcacacgcacagagagggggtgtacccctatacatcatggagagagcgagcgccagcccgactgatctcgccacgacagacccgaggacgcgccggggccgccgcagagggaagcagtggctcgaccgctccccaccactacacgccgagcttctcatcaagggatcaaacccgccgcggggcacaccaacacagccgaggggcgcggcggaccccgcccgaagaccgcgaccccacaactcctccaccgtgtccgccagcaatccccgagagacggtcccacgaaacagacagcacagcaccatcctcatgatccgcgccggcgagcaccgccagagctcccgacccctacaatccagaggtgcgagagccctcaacacacacacaccactccctccccccccccaccagccacgggcccgtatcaccctcaacgcccaacagccccgacgctacccaccaccaccggcgcgccgcgggcccgagacccataggcatcctacaccgcaccacgcgccgcctgcacaggaccgccccacccggccaccatacgacgcgaccgacacccagaagagacgacgcaggacggaggagaaaacagaaccaacgaaccgcgcacgccaccaccgccccagcacaacccagtcacacaccgccgagtgcatgatcggacagaccgatcgccactgcctcgcgacgtgccggcccacagcctcgaaacgtgacggacgacaagcgctcacccccccccctccgccctgcgccggacgcccacatgcgcacgtgcgaccagtcacctagccaagaggagggacaacgacatagaccagcacatgactgccacaaccgacaagctcacaccaccaccacacccacggtgagaggcggaagcgcactaccgcagaccaggcgccccgcgcacacacacaccacagccgccttgatcaaggcagtcgcgcaggaccgcaggcgggagggcacggtgcgggagagagcgaggcggggcctaggccgggccgacgctcgggcacgtcgcacgacgggagggggagggcgcgcgagaggggccggggcgctcgtcgtccggcggagggcgagtcgggcagtagtgggggcgagacagggcgggggggggcgagcgaggtcggcgaggcggggaggcgccgggaggctggagagacggacggcgggcgggcgagtgggcagtctgctccgaccgaggatccagtgcacgaccaactgtacgctcggagcgacccacagcaggctagtggcgcctccgacgcgcacctgcgcggcgcgaacacgagcaccttcggcgcgacgccgcgagagaggcgagcgcgattgacgagaaacgggtcgcgctgtaagagagcggccggctgataaatatgagggagcaggcagaggagggacgacagctggatgcgccgtgagtggacgctgaacatcacgaagctaagtgagcacgagcatcatcagcagagcgtgacagagtaggatgactcaggtagacaggcacaagtacaacacgacgtcgcacagagcctcgcacgagccactagcaccgagaaccgcggacccagagcgcacactccgcagcagcctagcttaggacccacgtagagccacgccacagaccgcgactccgggcggcgagcacagcagaacgcgtgcagcgccaacaccaactgacgcccgcacgccacacatcacagacgacgaacacacacgccgcccgaagcacgtgaacgctgcacgtgcagctcgagcgcactcacacgtcccagaccgctcctgaatgcatgt

SEQ ID NO: 641872 - DNA, 1183 bp, Homo sapiens
gccgcccttttttgtttttttttcagttacacttttcctgtgtcttaaatattggtggtctttttctgctttggaaatgtgagcctcttcaatttacaaaattaccaaactacactcaaaagaggggtgtaaaaaaagccagccattgtggcacagcatgtggaaaagcccacaagttaaggacagattagcagcagcgaggtgtggcaaaaggtgtgggagggtgacgtgaagcaggtggtttacaaatgtgttcacaggaagcttaaaattatccaacaggtttggtgcccataatgtgttagcacaggtttaaacatagttatacataccttggcatagggtggccctcgaggggtgtttcagaatttcttagcgcagaaattacaattttctttccagttataagaagtttcttgggacttgtgcaccgattcacagccagtgggtgtgaagggttacgtggaaccgaatcttgggtagagattttctcaaaaagggcgtgtcgttagaaccgtggatagaagtgtattggagaagaattctcgagggagcttctaacatttcaggtggacaggcggtgttaagtgggggggttcaccggagcgtggaatacgataagttgcggccaagaactccaaagtgccatttaggtagagctctcagggaattgggtaacagcattgtccgtggccttccaaatttcctctggggcaaatagtataaaacattgggtggctcttggccaacttggctgggaacaccggtgtcaggcatttacactgaccattcctttaatctgagacctgaagtcccaattctcattgcggaaatatacccttcctgttcgccaacggaaaacaccgggcggcccaatttgcgacccttctcacacaaaaggcgctttagggggaccacacgcgcccctacatagcaacaagcacgcgcgagtggggggtctacaaagcacccaggggggagaatcacaagggagcacactcaatgaagggggcgccggaaaataatacgagagagggaaaaaaactccggtgggaaccaagaaagcagcagtggtcaagcaaatagtgggaaccacacaaatgttaaccgacggcgagaacacagtgcgaccacaccagggacagaccacaacaaacgcggggaaagtagaagacaacaccag

SEQ ID NO: 641873 - DNA, 854 bp, Homo sapiens
taattttgggaatgaagtctcactcttgtcccccaggctggagtgtgatggtgcaatctcggttcactgcaacatccgcctccgtgggttcaagtaattctcctgcctcggccgcctgagtagatgggattataagcaccagccaccatgcccaactaattttttttattttttaatttttagtagagacagggtttcactttgttggccaggctgctctagaagtcctgacctcaggtgatccacccatttcaccctcccaaagtgctgggattacaggcaatgatctaccacgccaagccctgatgattgtattactgtagggccagtgctgatatctgcttatatcattttaatggtgtctattcattcttctctctttcttttattaatctagctagtggtctatctcatttatttaattttttttaaacagctcctggatatatcgatttttcgaagggtttaggtgtctctatctcctatggttccatctgatccgggtaataggctccagcgaggctaggggtaagaaaggaccctgggtcacactatgcctttaagttgtgatgtccgcgaagccacttgaaatcttccagcctgtgggaagggggatatcaagcgctatatttcccccttaagacatacttaagtgatttccaagaattcgcataatgctccgggtccctgggctcaagaacttttattgtgactatattattacccgaactatcggactttataaattccgcgcggtgtgcgtaggacggacaccgcgccatcatgagcgggcgcgaaagtgatgtcgtcaatcataagcgtccaattatcatagtacggtcaagtagtgtgct

SEQ ID NO: 641874 - DNA, 464 bp, Homo sapiens
  misc_feature (8)..(8): n is a, c, g, or t
gaaatcgngccaagttattcagtagggggtactatacaattaagaagtgagaaagtacagactactcagaggatcacctgtctaagattgctcaaagagctgtcattgggagagaggtctctctcgcaactccaagtgctcggaggcagaagagttgggaaacgtggcagccacatcagaaaaatggcagctcctggaagcatcagcccaaacccctagagagggaggtaaaaaggctgggaggaagctcagagcaagggcagttatcacttgagggctgagggaaccgactggtagaggacaaagcctgcttctcaggagagaggcttttctccggcaacactcccaaggaaggagtgatctatagatttgggtgggctcagttttacctcaccaaggtaactcactccatagttcagagaggatagggataaagaaatggactcctgacaggacaggtctga

SEQ ID NO: 641875 - DNA, 247 bp, Homo sapiens
  misc_feature (84)..(84): n is a, c, g, or t
  misc_feature (90)..(91): n is a, c, g, or t
  misc_feature (99)..(100): n is a, c, g, or t
  misc_feature (103)..(103): n is a, c, g, or t
  misc_feature (112)..(112): n is a, c, g, or t
  misc_feature (121)..(124): n is a, c, g, or t
  misc_feature (151)..(151): n is a, c, g, or t
  misc_feature (160)..(160): n is a, c, g, or t
  misc_feature (175)..(175): n is a, c, g, or t
  misc_feature (177)..(181): n is a, c, g, or t
  misc_feature (184)..(187): n is a, c, g, or t
  misc_feature (192)..(192): n is a, c, g, or t
  misc_feature (197)..(197): n is a, c, g, or t
  misc_feature (200)..(201): n is a, c, g, or t
  misc_feature (203)..(205): n is a, c, g, or t
  misc_feature (207)..(207): n is a, c, g, or t
  misc_feature (228)..(228): n is a, c, g, or t
  misc_feature (231)..(231): n is a, c, g, or t
  misc_feature (236)..(236): n is a, c, g, or t
  misc_feature (243)..(243): n is a, c, g, or t
  misc_feature (246)..(246): n is a, c, g, or t
ggcggcggcagcgagcggcggcgggcgtccggcggctcctcctcctcctttggtggcggcggcggcccgggaccgagacccggncccggnncccctctnngcnaccccgcgngcgcccaannnnggggcgctgcggggaacatgtggctcnggtttccgnaggccggcgagtgantnnnnnccnnnnatcgncttanaanntnnnancgctggcccggccgcaaatantanctagntaatacnaanc

SEQ ID NO: 641876 - DNA, 240 bp, Homo sapiens
aatgctccaacaagatttcctagtgtccaagagctgttctctttggactaacagttaaattacaatgggattagagggtctgtgggcaattaaagttgactatgatctatcttggacaccagctatcacaggctcggtaggtttgtcgctctacctataattcttcccactaattttgctaattagaaggggtgttgctctttaggctgttcttaggtagctcgtcttgttggggagccg

SEQ ID NO: 641877 - DNA, 713 bp, Homo sapiens
ctcctagtgtttctttgtggtctgtgtcaccgtatctcaggaagtcagccacttgactggcacacacccctccggacatccagcgtgacggagcccacactgccaccttgtggccgcctgagaccctcgggcccccgtgtcgcggcacctctggcccttgatggaatgacatcattcatcctcttcaggtgtatcaaaaggacggagctgcgggcgacagagactcagatgaggacagagtggtttccaatgtgttcaatagattatagtgagcacgaacatgcaaggggctgcatgacctaccaggacagaactttaccctcagttacagcgctgaatcacacgtccgcattggtgactcacttcaatgtgtaatttccggcctgcctgtgtgtgaaccagctaggacccaagtaaccggggggggtcgagcatgacgaagaagacacgtgcagatcagcgattcaccactaaccctttcgatacaatacttatccttggacaaaccctacccagccaaagcggtcagcgcacacaaagattgcgcttgtacatagcaccacagagggaaaggcacacggccggtcaggattagatttgaagccccaagacgttatcataaccacgacctgagcgcccaactaccagcgatccaccggctctttcgcaaccctatcagtactacatagaactatacattaacttctcatatc

SEQ ID NO: 641878 - DNA, 1301 bp, Homo sapiens
tggtgtttatttttggttaggttggttgggtttttcctcttcatctgtgctatagagttccctctacttagtgtaaattatgtgtgcaaatagccaggccttcattgaactgtggggggctgtgttcccatttgtgcaggggttcctcacgttcacttcagtatagggggcaaattgcggcgtgtagccacctgcggtataaactctcgccacagggccaactctccaatagcataggggcagggcgcaagggcatgtggataggggctcggctgtgtgtgttacaccctgtgccataaccggtcacgtggtaagcggttgtgcaggggtttgcagacagcgggtggtgtgcggttgtgcagatacgcgggcgtggtgcattactcgtgataggcgtgcattattccaccaatagaaggctcagcaccggtaaaactccgtccgtggttaaaccaacaccgtggattaggcggggggatttgcgcttgttggagaggttcaccgcttcgggactgtgcaccattattacgtggtccgcgccttctgtgccccttcaagtgtgggcctccctctgtggaaacgcgggttgcccggtgggtggctttgcaagtaggggtcacaggcggaacgccaaggaactaacaggggagactgggattaacggggacctgtaccgtcggttggatacccccttcttcctgaataggcgcgcacttggctcgcactccatgggcctaggggacaccattttgcctcggaaaaggcgtggcgatggcatgcataataaactcccgggaccaatattacaggttccaaccttacgtggcgccataatttccaacgacatttggcttattggggtggaaccaaatcgttctaatgggcgcataaccggttgctgggtcggctttattacacccccgcaatttacaggggccctctttaccaggggggccccgggggtaaatatcattccccgatgggcccgtgtgttgtggaatatggcagcagtatatttcttgtggcacgagtttctgaaagccccgagaattcccattagagaggacccgtgttatgttacaagcagagaatatcatccacacgtccagtgacgggtttggcgactcacccaacaacatatgttcggggcgaggatgagtgtcctgcaagcgggcaggaacacttattaatacagtacccgaccgagaggaagatatctactcgtacatatacacaatgcgaggctggtgagagaggaaggcagctcgtgtaccctatccgagaactaaataggttcggga

SEQ ID NO: 641879 - DNA, 221 bp, Homo sapiens
ccggctgcacaaggatgcctggaaactcaagtgcggactgatcgaccttgttgttggcccgtctgccccccaaaggagtatgacgatgagctgaccctacttctgaagttccaaaaggggaaaccaaattcaccgttaggaaacagtgagctccggcccccacctcgtgaacacaaagcctcggatcagccttgagagaggccacactacacacaccagat

SEQ ID NO: 641880 - DNA, 213 bp, Homo sapiens
tctttttttattaatacctaccttaattctactgtgatcagagaacacattctgttgggtggatcacttgaggtcaggagttcgagactcagcctagccaacatggtgaaactccgcctctactaaaaatacaaaaattagctgggcatagtggtgggtgcctgtaatcccaactacttgggaggctgaggcagaggaatcgtttgaacctgg

SEQ ID NO: 641881 - DNA, 140 bp, Homo sapiens
acggggtatggacggaaggcagatcatcaaacccagggaggaaccccaactggcggaggagaaggtgcttgaaagctctacaagaagcatgacactggcttaacgaccatgtgaccggatccctctaatgagtctcaagg

SEQ ID NO: 641882 - DNA, 107 bp, Homo sapiens
ctggttggacagtgggtgcagccacagagggtgagccaaagcagggcgtggcgtcgcttaacccggaagcccaagggtcaagggatttcctttcctggcaaaggaag

SEQ ID NO: 641883 - DNA, 301 bp, Homo sapiens
cctttcggcgcgagccgcccggctacttgctgtattttagtagacaaggggtttcaccatgttggccaggctggtctcgaactcctgacctccggtgacctgcccgtctcagcctcccaaagtgctgggatgacaggcgtgagccaccgcgcctggcaggacttccttcttgtgagcaggtagcgggtgtttgaaggtgtgttccgcaccttctcatctgttactgagcgctgtgaggcttgacttaggccttgttatagaaaagcctcccgtaagctttgggtgccaataccttcaccgt

SEQ ID NO: 641884 - DNA, 341 bp, Homo sapiens
  misc_feature (59)..(59): n is a, c, g, or t
  misc_feature (61)..(61): n is a, c, g, or t
  misc_feature (145)..(145): n is a, c, g, or t
  misc_feature (181)..(181): n is a, c, g, or t
  misc_feature (187)..(187): n is a, c, g, or t
  misc_feature (194)..(194): n is a, c, g, or t
  misc_feature (204)..(204): n is a, c, g, or t
  misc_feature (302)..(302): n is a, c, g, or t
  misc_feature (308)..(308): n is a, c, g, or t
  misc_feature (336)..(336): n is a, c, g, or t
gagcgaccacgagatcgatcggctggagctgcagaacgggcgctgctgcggagagcaantnacagcatgctggcgacctggaggcggcgcacggcagcgaggccacgctggagctgctgggacgcgtgctccggacatggacctnctgggctgcctggaggacatcgaggaggcgctttgngccccnccactanccgcccgcgnccagtcttctcagatgaggctgcgccctgcggcagcttcttaaggaccgtcctgcgagatcgccttccaaccccacttttttcttgggaaaggagggntccttncaggggcaagcaggagttagcagccgcntattt

SEQ ID NO: 641885 - DNA, 882 bp, Homo sapiens
  misc_feature (25)..(25): n is a, c, g, or t
  misc_feature (120)..(120): n is a, c, g, or t
  misc_feature (132)..(132): n is a, c, g, or t
  misc_feature (136)..(136): n is a, c, g, or t
  misc_feature (180)..(180): n is a, c, g, or t
  misc_feature (183)..(185): n is a, c, g, or t
  misc_feature (199)..(199): n is a, c, g, or t
  misc_feature (232)..(232): n is a, c, g, or t
  misc_feature (303)..(303): n is a, c, g, or t
  misc_feature (312)..(312): n is a, c, g, or t
  misc_feature (324)..(324): n is a, c, g, or t
  misc_feature (338)..(338): n is a, c, g, or t
  misc_feature (340)..(340): n is a, c, g, or t
  misc_feature (420)..(420): n is a, c, g, or t
  misc_feature (474)..(474): n is a, c, g, or t
  misc_feature (539)..(539): n is a, c, g, or t
  misc_feature (542)..(542): n is a, c, g, or t
  misc_feature (552)..(553): n is a, c, g, or t
  misc_feature (647)..(647): n is a, c, g, or t
  misc_feature (650)..(650): n is a, c, g, or t
  misc_feature (652)..(652): n is a, c, g, or t
  misc_feature (654)..(654): n is a, c, g, or t
  misc_feature (659)..(659): n is a, c, g, or t
  misc_feature (669)..(669): n is a, c, g, or t
  misc_feature (672)..(673): n is a, c, g, or t
  misc_feature (683)..(683): n is a, c, g, or t
  misc_feature (691)..(692): n is a, c, g, or t
  misc_feature (697)..(697): n is a, c, g, or t
  misc_feature (718)..(718): n is a, c, g, or t
  misc_feature (721)..(721): n is a, c, g, or t
  misc_feature (733)..(733): n is a, c, g, or t
  misc_feature (750)..(750): n is a, c, g, or t
  misc_feature (752)..(752): n is a, c, g, or t
  misc_feature (759)..(759): n is a, c, g, or t
  misc_feature (762)..(762): n is a, c, g, or t
  misc_feature (876)..(876): n is a, c, g, or t
attggcattacacttgtaaaaggcnaaatggacacaagcccttctgagggtctattgtgaagtgcttgggggcaagtggcctcaaagaaacttgggagtgagaggtttgcactgagcttnggaagggatccntggnaaaacaccacacttttgaaatcagaaaaaaaaaaaagcaagtgntgnnntttacagcccaggncgacttcctgctggtttaggtcagaaaaaaacntgagagagattcctaaaacaatgagggctgtaaggggactggtggaaaaaatccagtggaaatattttctnaggaaaggnaggagcaaagtnatggtaagttaaantntggtaccctaatgtagtagtaaatttaaggcctgtcgaggaaattttaacacttccaacaggtgactaatattcaagganggaaaaaccaagtgcttcctgcttcaccttctgctgcttttgggacttttctanagctagtatgctaaggacaagaccctgaacccattttttcactgggagaggaaaaccaccaggcntcncagctatggnntggcaactctggagttcctatggcttccatcagggctccaggccctgataagtggcctcaggcaggaggagatcgggagcggatgggagagcgnagnangnaaggnggaaaagggncanncccaaacacngttggcgnntaatnatttaaggaactggatcgtanttntgcattgctgcngttggtggctctcggangnctccagncgncttttcaggtcttgcaccggctctggtaacggcggtccgcatcatcacggctccgcgcagctggctcaattccgttttggttctctcagctgggctcaaggtcaagaatttttnttggct

SEQ ID NO: 641886 - DNA, 381 bp, Homo sapiens
cctggttcccccctgccccctgccagggttcctttttccttaatatgggaaaagggtaaatcccctccccgccccccgctgtttttaaaaagcaggtttcctggtttcttataaagaggccaagccaaaagggggttccttttttccctccttaaggaattaatcccaaagctttcccaaggctgggttctccccccccgggaatgtttggggaatttctttgtggaaaagggactttttgttttgctttaacccctcccgtttttttagggtttctcgtttctttttggggcagggctttgtggcaaaaggctggtctggatttcccccctttgccgcccctttttttttgcctgtttaataaaacccttttccctgtta

SEQ ID NO: 641887 - DNA, 279 bp, Homo sapiens
aaggtaggggaagacccaaccatcctgttctgacttctagcaattactactgccctcagtcatgaagggctccctatcctcccatcctatggtcccattgtgcatgcaatgagagatgggaaggaccgagagaaatggacgacaatttggttgccaggtagaaagcaatctctgctctgcatagctaatttggccctggccatgactacaagcaaaaagttggttgcagattgctgggccaagtgtgctgtggtatgaagtggatactcagtaggcatt

SEQ ID NO: 641888 - DNA, 108 bp, Homo sapiens
tcagatgccccttttcattatgaaactctttttaaaccttaaattaaagttcaggggtatgtgtgcagattggtaacataggtaaactggtgccatggggccagcggg

SEQ ID NO: 641889 - DNA, 766 bp, Homo sapiens
  misc_feature (339)..(339): n is a, c, g, or t
gctacacttattgcaggtgtcttaggagagaaaaaaatggtagaaaaatggagaaagcatgaataagaagagggccaggaccctagttgtgtgccacgagccatagtcacagtggccaaagcgccctataccacccagtgcctggacaaatggtagtggctctgtggtggagtgaatcctagtgtgcctggtgtgcctctagactcaatgtcgtgctgggccttgcaaatgtgtgctgtgtgtgatgtgtgtgcacgtgtgtgctccttgctccattaatggtagagatgtgtcttgtgatggactttgctgtgtgtgatgtgtgaaatgtgcacatangtggatgagacagatgtgtgtgcactgttctttgtgccgccttgtgtcctcgtgatgctgtgcctcccaatgtgtgcacatgctcccatgctcccacactgccctcaatatgtgagaaatgcttatgcgtgggacatgtgcaccctggaattctagaaagaagaacacctgacatgatgatgtgggtctggcgcatggggtgctcgctcgagttgtgtccactgccttccactctccctttctccagcctcctcagtcccaagaatttgtgaggagaagctgtcccaggaacctgttggccacatgccatcccgtcatgttgtgactcccaggcatgtcaccctgttatctgtggcagatgagattgcccacacgctcaaactctggagtccagacatgcagtaagtcgccgagcaggaatataggg

SEQ ID NO: 641890 - DNA, 195 bp, Homo sapiens
gggaaaagtttaaaaaaagtaaaaaaataaaatcagctgagcatggtgacatgcacctgtggtaccagctactttggaggctaagttgagaggcagtgatgggaggatcatttgacggcccagaggttgaggctgcagtgagctgtgtttgtgtcattgcactccagcctgggtaacagagtaaaaccgtctgtc

SEQ ID NO: 641891 - DNA, 795 bp, Homo sapiens
catgtgccagggaacatccatttataaaaccatcagacctcatgagacttattcactaccatgagaacagcatgggggaaactgcctccatgattcagttatctccacctggccccacccttgacacatgggaattgttacaattcaagatgagatttgggtggggacagagccaaaccatataattcttccccggcccctcccaaatctcgatgtcctcgatatttacagaagcaatcgtgccttccccttaagtcccccaaactcttatttcagcattaactcagaattccatagtccatagtctcatctgagacaaggcaagtcccttccacctgtgagcctgtaagaccaaaagcaagttagttattttctagatacacagggatacaggcattgggtaaatacactcgtttcaaatgggagaaattggccaaagtcgaagagagctacaggccccatgcaagtccaaaatcgccagcaggcaaatcttagagctccaaaatgacctcctttgactccatgtgtcactatctaggtgatgccagaagttgggttcccagggtcttgggcagtcccgaccctgtggctttgcagggtacggtccccccttactggactgcattgagtgtctgcagctttccaggcacacagtgcaagctgtcagtggatctaccatctggggtctggaggatgctggccctttgtgacagtctgcttggcaataccaccatgggactcttgtgtgtgggtcaacacatatttcctttgcacctgtcctagctcgcggtctcg

SEQ ID NO: 641892 - DNA, 390 bp, Homo sapiens
tgggggttctacagagacgttggctgtcagggagtgtttatttcgcgtccgattctgtttctccgggcccctgtgctgccccgacttacatactccgccagaaccggccttagtctctccgcgcagaagtttcccggagccatgcgcgagtactcctacgggaagtctaccaagcttgtgctcaagggaaccaagacgaagagtaagaagaaaaagagcaaggataagaaaagagagacgaagatgacgaaacccagcttgatattgctggaatctgcgggacgagaacaaactctggtgaaatttcaggaaccatagccattgaaacggagaagggaacctatctacatgcactcgagaacggcctttttaccctgggaagctccaccg

SEQ ID NO: 641893 - DNA, 296 bp, Homo sapiens
ggcctgaatgtttgtgtcccccaaaaattggtatattgaactttcatccctaaggtcaacagtttagggaagcgattaggtcctggggattctgccctcttgcatagaattagtggttttattaaaagaggcccgagggggtttttttgcccctcctgccatgtggggacacagttagaagttcccatttgtgaaccgggaagcccccctccccagacattgaatttgttggagccccctttttggacttcccagcctccagagttgtgagaaataaatgcctgttgtttaagtta

SEQ ID NO: 641894 - DNA, 205 bp, Homo sapiens
  misc_feature (1)..(3): n is a, c, g, or t
  misc_feature (10)..(12): n is a, c, g, or t
  misc_feature (14)..(14): n is a, c, g, or t
  misc_feature (58)..(58): n is a, c, g, or t
  misc_feature (86)..(86): n is a, c, g, or t
  misc_feature (93)..(93): n is a, c, g, or t
  misc_feature (101)..(102): n is a, c, g, or t
  misc_feature (113)..(113): n is a, c, g, or t
  misc_feature (120)..(120): n is a, c, g, or t
  misc_feature (124)..(124): n is a, c, g, or t
  misc_feature (126)..(126): n is a, c, g, or t
  misc_feature (135)..(135): n is a, c, g, or t
  misc_feature (152)..(152): n is a, c, g, or t
  misc_feature (189)..(189): n is a, c, g, or t
  misc_feature (193)..(193): n is a, c, g, or t
nnnttaaccnnntnaacaacaacctatttagctgttccccaaccttttcctccgaccnctaacaaccccctcctaatactaactanctgactnctaccccnnacaatcatggnaagccancggnanttatccagnggaaccactatcacagnaaaaaactctacctctctatactaatcttcctaccanatcntccttatttata

SEQ ID NO: 641895 - DNA, 232 bp, Homo sapiens
ggctagtacaggatccggtgagcattcgggaagaggggccgaacacctgatcatcttcgccttttttatccagtcctggtcaaagagcaattttttcagaaagatgttgtgacaaataaaaagacaacatgttcggccgcagaattacttacgtgggtatctggacgattgcagttcagacccgcgtcctcggtggtgtccggacactttattcgatgatccgaagaacaat

SEQ ID NO: 641896 - DNA, 91 bp, Homo sapiens
ctactactactaaattcccggcacgtcgacggcagatgttggtgctggcaaaaagtgagctggagattggatcacagccgaagagctaaag

SEQ ID NO: 641897 - DNA, 313 bp, Homo sapiens
ggcgctgattgccgtctcttcggaaacagaagaagagcgcacctttacctttcgtcagctgcatgacgaagtgaacgcggtggcctcaatgttgcgttcattgggtgtgcagcgcggcgatcgggtgctggtgtatatgccgatgattgccgaagcgcatattactctgctggcctgcagcgcattggcgctattcactcggtggtgtttggtggatttgcctgcacagcgtggcggcgcgaattgatgacgctaaaccggtgctgattgtactcgctgatgccggagcgcgcggtggcaaaatcattcccta

SEQ ID NO: 641898 - DNA, 268 bp, Homo sapiens
tgcctgaccacactcactgcagatctgttcctaggcattaagctccttcttcctttgccattcggtcttacttcagtggtcccatggcatgctttctatctcctccatggtctggaagcggccatggccaaaacttggagcgtggtgtcaatagaactctaaggtcaatcttactccagatgcctgccgcttcgtactgcaccagccaaggacttgcgggagggtgagcaccccgtttcttggttcccaccaaacagacctttcagca

SEQ ID NO: 641899 - DNA, 158 bp, Homo sapiens
acagtcaactaagctccagccagtatactgaagccaacaggcaggggcctggcaggttataggcagaacggaggacaccgccaagagaccacggccagaaagccgaactaatttccccattaaccaccccgcccttaaggcttaacgacatcctctat

SEQ ID NO: 641900 - DNA, 140 bp, Homo sapiens
catccaccttcagcagggaggcagcccaacaacctggggagaagagctgggggcagtgaatggtagtctgggactggcatctctcggttacttctgaggatccagctccaggagggggaggtgacactttcagatagtaa

SEQ ID NO: 641901 - DNA, 126 bp, Homo sapiens
ggctcggtaccctcacaagacctgcttctaacctccctgttcttaaattcgaacagcatacccccgattccgctgcaaaccagtaactgcacaacccgctgcaaaccagtatctgcgaaaccagta

SEQ ID NO: 641902 - DNA, 342 bp, Homo sapiens
ccaatctaatttaaaaagacatgcaataacaaatgttggtgaagatgtggagatctgcagtcttatacgctgctgctagtaatataaaatggtacagctgtgttggaaatcattttggcagttcatcaaaaagttaaacattccagcctgggcaacatcatgggaccctgtctctaaaaaaaataaaataattagctgggaatgatggcacacacttgtagtcccagctacttggtaggctgaggtgggaggaccacttgagcctgggaggttgaggctgcagagagccatgattgtaccactgtactcccttggtgacagagtaagaccctgtcctaaaaa

SEQ ID NO: 641903 - DNA, 116 bp, Homo sapiens
cgtggcccttcgtccggcgagagctaggccgaggaccgcgccgcgctccccggcacctcaccgcgtccttcattttacttcccgcgcgcggccgggcggggaagggcgggcggggg

SEQ ID NO: 641904 - DNA, 261 bp, Homo sapiens
taaaacgccgtccacaggaagccttaactatggccacagctgttgcctggctgaaaaacgacctcactatgacgcccaagctgtgatgcagtgggccatcatagcaaactgcagccttgacctcttcggttcaaccgaacctcctgcctcagcctcctcagtagctgggactaaaggcacacatcaccacatctggctaatttgtgtattaatttgtagagacagggtttttccatgttgcccaggctgggctctaactcc

SEQ ID NO: 641905 - DNA, 140 bp, Homo sapiens
gtgtgggctggacccgcctttgtgctccaggggctggccggttttcgggggggccggcttccaccacttgccgccccacccctgcactccgtgacctttgagaacccagctggcccctcgttagccccagggtttgccgt

SEQ ID NO: 641906 - DNA, 608 bp, Homo sapiens
  misc_feature (608)..(608): n is a, c, g, or t
ggcagtggttcatgcctgtaatcccagcactttgggaggctgaggtgggcgtatcacctgaggtcaggagtttgagaccagcctgaccaacatggtgaaacgctgtctctactaaaaatacaaaaaaattttgtggtggtagatgtctgtaatcccagctacttgggaggctgaggtaagaaaatcgcttgaacccaagaggcggaggttgcagtgagccgagatcgcgccattgcactccagcctggttgacaaaagagagacttcgtctcaaaaaaaaaaaaaaaaaaaaaaaaaatttgtggggggcttgggccctgaaaaagtttttaaaccccttcggtgggggcgccgcggggcgcccagtagcggtcagtgtgcaaccttgggtcacacacgctggtccccaaaagggaagatcccgtggcgccagtgagctctaatgtggtggggttttttcccccattttaaaaacacggcccggggggggaagcccgagacgtttctctggacacaatttccgaataggagatcccgagagggcccataaccggggttctctttcccccgggggttccccaagggaatccggttttcaatttcgccgn

SEQ ID NO: 641907 - DNA, 126 bp, Homo sapiens
ccgctggccaatggcatgatgagcatgctccatctctcttagcaggtgtgttgtctttctctaggatcaggaacttgcagtccttgtgccagaaggtcatcgctctgcaccacttgtagttgcagg

SEQ ID NO: 641908 - DNA, 300 bp, Homo sapiens
accgcccccttcccccccctttcagcgcccggcggcgggggcggtttgggcagcttagaccaagaccacggctcgagatcttcgcgggacgaagaaggaggagctgctgaaacagctggacgacctgaaggcggagctgccccagctgcgcgtcgccaaagcgacaggcggcgcggcctccaagctctctaagatccgaggcggccggaaatccattgcccgtgttctcacaggtattaaccagactcagaaagaaaacctcaggaaactctacaagggcaagaagcacaagcccctgga

SEQ ID NO: 641909 - DNA, 897 bp, Homo sapiens
ttctctgctctcagcacatgacgtccgtcgcgtgttcctgactggcgaagccgccagttcgaaccgggcatcgtgggaatggtgaagatgcttaccctagggaaggttgagctcggccaatagcggtaccacactcgcagtccttcctgggataccaagggagtgttatgactcactagttgattaggggagaatgtctgaaaagagccgggattccgataggcttagtcgaaagaatggaatgttggtgtgattgggatggtgagacgaattggtaagaggtagcatgcaagcacacaataggtggtttagtgggctactatgaggtgcgtacaggtggaaatccgatcgatgggtctcctgaaatattcgtaggaatgattttagtgtgatcacatgaaatgagttgacttgcaacgcacgcgaccgtgtctatgaggatattggacgattaaaagtcctatacgtactgtacaggggccattttaccgagatgtatctagctaagcagaatagcgtctaggggcattgagggatgggcgaatgagcttgcaggctggagaaaggccttcggccgaatcctgacagacagtaactgcacctacataccgtggttcgttgctccacacccaggatgatgcctgcctatcatcatgcggcatagaaaaagaagggtcaggctgcattggagatctacggtgaactagagagtgatgtggttcgactacgctaggatatggcctgccatcaggtttgagacaggcggtgcctgagacccatgtgtttggtgctcgcttgaatgatgaggccatcggggtgacccagggcaagggtaacggggtcccaaccgtggggcccagaagttcccgtaaaccacgggctcggcaagggccgatg

SEQ ID NO: 641910 - DNA, 732 bp, Homo sapiens
ggtaaaaggtgtgcaattctgtccatgtgtgactctcaagatcttgtaactttagacagcatatgctcaggtataaaagtgccgggtcagaacgcgtttggctcgccaacccaggacccccgctgccagcctaccttccaccagggaccttttggccatggtcagcggccggtgcgagctgaatttgagcatcagcgatctgcccgggtcgccggtccggggctgggcagcagccgcgcctcctgcaagccgggacccatgcggtgtgcagcagcgtagccagcaagacgcgctgcgggtcagattcggcggcaggccgtctaagcgcatcagcatcacacttctcggtgctgcgggacactagcagcgggcaggacggccgcagacggatggttgtgcacgcgtggcagatagtgcggactgcgcgccgtcgcctcgagctgtagcgggcataggcgaagccgcggttcaggccgctgaaggtcatcatcaggcggaactcgtagaggcggcccacgcgctggaacagggggataagctggtgctcgtacacgtcctgaggtgagcgcccgatgaacacctctgacccagctggcgggggctgccacccagcctgtgggaagagggtatgcaaggacaccgtcaggcgacgctttcgaattctgagccacggacccaccgcgcgggggtgggaggcgagtgaagcaaaggtctgtgaaaggggttaacacg

SEQ ID NO: 641911 - DNA, 1071 bp, Homo sapiens
ggctcggctccatgcgccgccccttccgaggctaaatcggctgcgttcctctcggaacgcgccggaaaaggggtccatggtgacagagtcccgtgttctctcctttgaatccacgtcgccaggaccgccggcctcttgccggccggaaccctgtcacacccggcccactctcactgtgccagggaacttggctacataccgagcacccaatggcccgtaccagatcatcccaggcacgtggaacccctgtgtagcaagcacagacacaggcagctggtactggaccatcctgctcaaccggcaattctgtgggacaccctgtggcaaagggtgccaatccctgaggcctggccagcatgtgctacttcccaactgtgggtggaacgccaatttgggcccaaaagcgctggagatatgcagcgtggtccacactctggagcccaccccggaagcacacacaccccgggcggggcacggacaccccggtgctgaccattcacacataacacgggatccagtgaatgtggcgtggacgatggaaacaccacggtgtgttgaacactgcaaacgcggactgtgttgcaaaaaccccccacatgtggacccactttgggcgcgcgcaggattggcatcaacaatccgcccattcattatgtcagcacagctggacatgaacaccgaacgtatctattacgcaccagcgaaacatggggcgcgtgagatcactgacattatgggtggccagattccccacattttatccgccgaccacacagtagagagggttactacgtttccaacatgcatgtgtttcccacaaactggggagcggccccagtcagcatgggtatccttcggcatgtggaggcgagcatattctacacaacaatgcggggtactacaagagaccactaacaaccagagaggcggcgctacaggttgaggaggactcacccccatcccattaatgtttggcagcgccactggtggaggaaacactcaacatcacttttgatgtcgcactaggcaaagaccatataaccctacaatgctcccaaaacaagggtcggg

SEQ ID NO: 641912 - DNA, 170 bp, Homo sapiens
cccctcagctgcatcatgtgtcttcctccaggtctctgaaaaaggcaggacctctcttagactgtaactaaggagtgagtaggtgatggttacagagttcacttcagaatcctctgttggaccaagtagcgtgcgccatttcttggtctgtagccgagcccccgctgcgg

SEQ ID NO: 641913 - DNA, 671 bp, Homo sapiens
tgggaaagggattctcattttgttgcccaggttgggtatgcaggggtgaaattttgaaatctccgcctcccaggtgtcaagccatttctccgtgcctcagccccgcgggaagcagttgagaatatacaggcacgtgccaccacaccccgtctattttatggtgtattttaagtaaagacgggtgtgtatcacaccagtgttgtggccaggtgtggtctcaaactctgtgacctcaagttgactccaccgtgattgtggcctcccaagagagcgtgggtatatacagggtgtgtgtgagccacccattgcccggcccttctttatccaatttttacctttctgtgagtaagtgttgtgctcagaactttctcccaataagggtcttctggtaaaacacctgtttgtgggaaataatcagctggtggggggatttaaacttcatttggaaaaacagaagtgccacactgtgttatttcctcctggttaaaagccaccacaattagttaccactcagaggtcctcgtaagaaagtgtgctcatattctgggtcccaacccccaattttaattccatttaacactctggtgattccggtgatttctactcgtgttttggggaaactacaacatcaacaacacaagaacacgacacatcccatgatttttttttct

SEQ ID NO: 641914 - DNA, 172 bp, Homo sapiens
  misc_feature (14)..(14): n is a, c, g, or t
  misc_feature (26)..(26): n is a, c, g, or t
  misc_feature (59)..(59): n is a, c, g, or t
  misc_feature (115)..(115): n is a, c, g, or t
gggagcttcggccnccgggggcctcncagcccgccccgtggggccgcccgggtgtggcncagccatgtcccccccccagggccttcattcacccctcccctccccacaggggaantgttgaagtgtggcgagtctgggcccgggacaataaagcttgtgacagggccaggaa

SEQ ID NO: 641915 - DNA, 138 bp, Homo sapiens
  misc_feature (60)..(60): n is a, c, g, or t
agtaagactcctgtctcacaaaaaaaaaaaaaaaaagtgtactggatttttctatcccanaaaacctggcatttcaggggccaaattatttagttgggtttggccggtcagttggccattccactttgttccctgttc

SEQ ID NO: 641916 - DNA, 308 bp, Homo sapiens
tgcaaggagccacacagcaggaggtgagcggtgtcgagtgagggagtgagggaagcttcgtctgtatttacagccactcccctttgctcacattcccgcctgagctccaccttctcagatgagcagcagcattagatgctcataggagaacgcaccctgttgtgaaccgtgcatgtgagggatcgaggttgcgctgtccttatgagaatctaatacctattgatctgtcactttctcccatcacgctcaggtgggaccatccggttgcaggaaaacaagcttaacaacgcccactgattctacattat

SEQ ID NO: 641917 - DNA, 615 bp, Homo sapiens
cgaatatggtgaaacccagtgtctactaaaaatacaaaaattagccaggcgttgtaatctgagctactcaggaggctgaggcaggacaattgcttgaaccccggaagcggaggttgcagtgagccgagatcttgccactgcactccagcctgggcgacagagtgagactctgtctaaaaaacaaacaaacccgttttgtctgttggagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccaccctcggcccctaagtgctgggattacaggcctgagctgtgtaatttcatgccgcgtgacacaatccaataggaacaaaccccgcgggtccagcgtttactcacacaagtggactgatggctgataaatcccagcatgagcccaaagagcagccacagaaccatctactaaacaggtggactgatggttgattcccgggg

SEQ ID NO: 641918 - DNA, 118 bp, Homo sapiens
tacaggatgcttagcctccacttggttgccaggtgggtcttaaagtccggggctcaagccatcctcccacctcagcctcccaggtagctgggactacgggcatgagccacaggccttg

SEQ ID NO: 641919 - DNA, 619 bp, Homo sapiens
  misc_feature (261)..(261): n is a, c, g, or t
  misc_feature (588)..(588): n is a, c, g, or t
  misc_feature (619)..(619): n is a, c, g, or t
agatacatatagaatcgagccggtacccatagttttagaagtttcaatagcatggcaaaaagattagaattggctgctttaaatatgtgctgtatggttagaaagtgaaacatattgggcgagattacccatagaaatctaagattgacagttgcagtaaccaaagacaggcaatatcttagcacaatgttgtaaacaatctggtctttaactatcaattcaacctctttgttcagtttcttcagtggttacctccatatngctaaataatgtgcttacccttgtgtgtactaatttatcagctataggcattatctaccagtatttctgaattcagagtttagacattatacactctttgtgatgacagatgaatagctcacttatcgttatcccttccctttccctatttgtctggaaatttgggtagtaatgtgtttatcttcggttcttctattgagtattttttgtcactttaaataatatttaaatctcttatttttttattcccacaatcccaacagtttctcttgtataatctgtttataaggacactactatttctatgatttccttctacctcccaanttatattaaaccttgactttagcatttgtan

SEQ ID NO: 641920 - DNA, 117 bp, Homo sapiens
agacctgacgagaagcgtagaattgctcctatttaaaacgaaaaaatgcaattagggaagagaaccctagatttcactagggaaggtaccataatttccagaatcaaaaattccatc

SEQ ID NO: 641921 - DNA, 529 bp, Homo sapiens
tgttttggggggatagtgatactgacggtcctcccaggagcttccggtgctgggcaccgtgtgcgctgggggaggtgtgtactaagatttgggctcctgggctccgtggccacgggggaggtgtgtcacaagatttgggctctgtgcaccgtgggcttgtgttacgttgtgtcagcaagtgtagttatgagctcaactctcttgtccaccttgtgtgttgctgggcttgtgattcacgttgcatgtttaggtctgggtgtccaagctgctggagtggtcacggtcaccatgctgcttatgtatgtagagtcctgaggactgtacgacagctcgtgaaggtgtgcacgcctctggttagggtgcctgagttccacgactccgtcaccggttctggtaagttctccttgatcaggcagaccagggccgctgtgcccccatatgtgctcttggaggagggtgccttggggaagaccgatgggcccttggtggaggctgaggagacgatgaccagagttccctggccccagtt

SEQ ID NO: 641922 - DNA, 111 bp, Homo sapiens
aaaccttgcaattgcgctggcactccggcagccgctgcgcggtctgctgctgttttatccggtggtaacgcttttacctgatgactatgggacttcgtggcaggagtttgg

SEQ ID NO: 641923 - DNA, 876 bp, Homo sapiens
  misc_feature (506)..(506): n is a, c, g, or t
tttttttttcccaggggggtttgcctttattcctgtttagggcaggtggtcctaaacagcatttcccattaaaagctgaacaaaaaattatcttggtactctcttcttggtgtacatggtctgtttcctgcactgtgccccatcccgcctggaacaaaaagcgggcttccagggtgctggcacccgggagggaggctacgtgtggaacaaccaggcagcacgttgcttgttggcccccaagcagttgtaacttgcccgtggctttggaccacgcacagggtttgcgcccttggtgtgtggccataatttgtggtttgatgtgtccagggtcttcactccggtggctccccgaacctgtgcgccccttgcgggttgcaggaaggcacgccacccgagggtccccgtacagcactgactttgagaaaataagccggggggcgtggggctacacgttgtttctggtgtgctttgcccaggggaatctttgcgcctcctccaaaactcgntctttcacctgggggcaggtgccaaagccccaagccccgacggccacaagcaagccgtaatttcctccgataccttgtgacccagagccaccttgtttatacggggaaaagactgctttctcaaagctccgtgtgtccccagaaccgagtcttccggtcctcccccggggggtgacccagggggctgtctttggcctggggaacagggaaaccccgggcacagtttttccgacggtgttccggccccgggcctcgcaggattgaaggccctatatcgtgtttcccaggagtgggtggaggttcccggttggcgaccatccgggtctgcgggaacccacttatgtgtgtcacccggttcaacccgtaactg

SEQ ID NO: 641924 - DNA, 303 bp, Homo sapiens
gctcgactccaaagacatcttcggagaggtccacatatccgcttgcagattccacaaaaagagagtttcaacactgctctatccataggagggttcaactcggtgagttgaatgcaatcatcacagagaagtttctgagaaggcttctgtctagattttatgcgaagatgtacccgtttcgaacgaaggccacagagtgtccaaatatccacttggagactttacaaacagagtgtttccaaactgctgaatgaaaagaaaagttaaactctgagagttgaacacacacatcacaggtcgacg

SEQ ID NO: 641925 - DNA, 412 bp, Homo sapiens
taataaattcacatataagaccatctgggcctacaccagacatacaggtcagatatcatctggatgacacagctctcaagaacagacaagatagaaacagctgtgactatcaaccccatctgcttctgggcagtacagcaagcctttctcattttctccatcagggaactggctttaattttgagaataatcacaccaacaccgtcttctaacttcactgctgcacaaggggcaacaacctcaactaaagagtccaaccacgaccggacgcattctcatctggtgggggcagcaaaccttcttatgaggccatatacgtgaaagctcaactccctcaggcctcacctccgcatcaaagaccagcccaggagaacctgccgcatctagcaacagaactgtggcaccttctgga

SEQ ID NO: 641926 - DNA, 272 bp, Homo sapiens
atcccctgtgtgccccagaaccttgcagctcccattctactttctgactctatgaatttgaatgctcagatattgaagctccccctgtgctgacaaaaccaccctgctcccctgcctaccgcaagcttgtccttcttctccacctacgaggctgctctctaattgcggaagattgaaggaggagccggcatgtcacttgtttgagaacgagggagaacagggagacggggggttcttgggtggcacaaagggttcttgggggcacacaaggt

SEQ ID NO: 641927 - DNA, 148 bp, Homo sapiens
actctagagcataaacggctctgccaaagaatacactctttagagaaatgcacttagaaaagtaccatcataagcattctatcaatatttgagaattccctgctggtccagtggttgggatttggcactttcacttccggggcatagg

SEQ ID NO: 641928 - DNA, 1882 bp, Homo sapiens
ataaagaacattaaaaaagaacaagaaagaataaaaaagaacacaaaaaaataaaagggagcggacccactcacaggaattattccaacggaagacaacgccataagatactacacgcgcgaagccaccacgataaacgcgaggcaagcaaaggcgggcacccgcgcacagctcgcgcggcgcgcgttatctacttaaccgcactacgactgagtgcagcgagcacgcgattttcaagtacacgcgccgcaagaagccctgtggggtgacagacagaccgcgtgagagagactttagtgagggcgcacctcttctagtgagggcgagcaagtagctcactccctatctcaagtactgtagtgcatcgtgaggccgagtgtgcagccacatcattatattctgtaggaaacaaaaccaaaccctaacccgctcacaccctaccgacaccaaccattctaataccacgcggcctcatctaatcaacgccgtctactaacctattctcaagaccacgaataagctctgataccccacgagtcgtgtcgtaccatcatctacgctcgcgcgcggtgagcacacacatgatatctgagccgtgacgacgtacccatagttggcgacgaaaggcgacgagccgacgagatggagaaagaaaagaagtcgtctacgcacgcgccgtcctcatcaccgcgagcgcaagagccatataattagtcatactaatattagtcctagtcaacaccactacgcagtctcgtactgatctcgaccgcgcgccgagcagagcaaccgactaaagaggcggccggacgagaatcaacacgaagaggagagaagagacgcccagacgacgcgccgcacgcagccagcgccgcaggaaagaacacacccccacaggcccaacgaccacacgcacaggaaggacgcataccgcgaaacgcaccacgcacacccatacagaccctacaacaagacgtacccaccactccccagccggagcgagcagcacagcgagaccatcctgaaatagcagcacatcagaagccagcaactcagactatccgtacgacccgaccaccgaacggcgtgcacacagagcagcacagcagcgcacgaaccacaagcccgcccacggccgcacacgagcgcgtccatagcagcgcctacgagagagcggagcacgacgcggcccgcacaaccagaggccccacccacggatagcgacggcgcagggctcgagatcgaagcaggacgaacagagcgagcccgtaccggcgcgagccagcaagcggcgcgcgcgaccgcaacagcaggagcgcgaggcgaggcgagggcaggcgtcagccgagagtcctgcagccacgccgccccggccctaccgcggctcctcccgagcacgccacagctcccgccacgccgcacacagccacacgagagaagacacacagacagcacgtagagatcacggaaagcagacgagtcgaagcacgccgttcgcggcgtcgagcctgtcagcgacatagccgtggccaaaacgatggcacatcacgacggcggcagcaggaatggcagagcgtcgatgcgccagcgaatcggaggggcgcagacatatcgagagaagagatacgcgtaatgccagacccctgtcactcgccagcggacatcgcggagagagcctcgaccgagagcagagcgataggtcgacgggacgcaggtgccatcaagagacgagcatgctgagaggacgaggagcacagagcgacagcgcaactcatatgagcagcaggcagacgaagttcgacatagccgagagatcagcgagcgagcgcagtcccatcagcatatcgcagacgcgcacaccgtcagaatcagcacgccgctc

SEQ ID NO: 641929 - DNA, 654 bp, Homo sapiens
catccaatcctggctctggggaggcacgcctggcggcggggctggggccactgaggaaatccatccgcgccgccgcgccgcgccgccgccgcgccgcctccgccgcggagaagcacagcgccgcccgtgcacgcacagcgacaacccgacgcacagatccaccgacacaggcctcgggaccagcggacctaggagctgcctccccagaagcggagggtatgagtccggcaggaatgtggtacaggaaacgacgcggacaaacacaggatacaaacgagaaaatcataacgagggaaaagaagagaggagagccgagacgacagaagctccgtaacgaaaagatgtttacaaaaggaagttcatcatatacagaaaccaccgagtcaatacgaagaggaccccggagacacagggcagaggagcgtaagcaaaacgaccccgaagggagaactatggaagcaaccaaaagaaagccgagaaagccatacagacgacaccccgcaagagaaagcatgacaaggcgcaacgaggaagcaaagcaaacccagggagaaagaccacagaaaataccgagtgacatggaagacatcagacagacagatagaccagcaaaagaggagcaccggcaagagaaatacacgtgcagaatatctg

SEQ ID NO: 641930 - DNA, 207 bp, Homo sapiens
ggtccgcgatactcagatcaggaagctcagagaacactaagcagataatataaaaaacaaaaacagaaaacgcaaccaggcatataattttcaaactacagaaaatcaaagataaagaaaaaaatcccgaaagaaactagagaggggccaggtgcagtagctcacacctgtaatcttagcactttgggaggccaaggcgggtggatc

SEQ ID NO: 641931 - DNA, 370 bp, Homo sapiens
ctggacgtactaggacagaggaatgatagagtcaacatacagttgagtccccccggcactttctcatacacatagtggaacaaaatctcaagtccttaccatggccgtcaggacgtgaggtgatctaggctcctgcttgcacgctctgggctatgttacaaccttccttctcccgcatctgctctcctgcagagacgcaggctcctctgctgtgccctgaatgggctcagcccactatcccgcctctgtgcctcgacatgtgctgcgccttcaggccgacggggctctcccctaaggtacctgtataccccctatctaacttcctgtggtcccaagcagccctcctaggacaacccgtgaatggagccca

SEQ ID NO: 641932 - DNA, 858 bp, Homo sapiens
ggtccttcctctagttgaagaacttccagagaggtagtatcgagaacgagtggtgacgcaagctctgcaaggaagctcctcgtctcagtcagtccaaatgtctgcctccacagcaggaggcctccttcaggctagttttcacgcacgcaagccatgtgcgtatgcacggcagtgactgtagatgaaacgttggcgaagcagtgtctgcccaaagcagtgtcctccatgcaagagtcctctcgtagaaatggagttccagcaagcttcatgggaataatctagatatgacacaagcgtggaaagcatcaatctagtaggaagtgcttacaggcagggctctacacgagggagactgccgcctgaaagctatgaagctcttccatctcgatatcagcatcgatgaccggcggtagttctaagcagtagcctgtgcgttcacgggtgaggcctacacccagaagtaacatggtcctgtggtgctaccgcagacaatccacagtcaagaacaggggaggttcctcgatctgaaaacacagatgacctgacgcatcctgatcatcactggacgtacagacaacaaagatggggagcttcatacccctgagtctcagcggacatgacttgtgggtctgacctctggccacgtgaagtatacatattcgatccgatgtacgaggccctgtgccctgactaactctacactccattccttaactgttcggggacgcttcccaggactaaccttgcgactgtaccgccttacgcacccacagccgctgggtagcactacaggacgcgttccactccttcacacttgcaacgtgctcgaatcaacaggcgggaggccaggatacggaa

SEQ ID NO: 641933 - DNA, 413 bp, Homo sapiens
aattttggcagctgtttagccttttcgtacttggcgtgatgtcaacgtgacttctaatctgcaggagcagaagctgttggctagtttactgcgcgtgtgtttacggagatggagtagctcgcagagagtcacagaaagtcttgcgccgtgaggcagggttttcagaccgtgggtcccagcccatttagtaaaatgggaaatcaattagcaggtggtcggccagcgattacacagcaatgaagcggaataaagtaggccagaatgcatcgtggggtaaaggcgggtactgttttgtgagacttttcacccgtacatctaaatgtgagaactggttgcaatggaagacatttcttggtgggaagttgtgagcaaaataagttgaaaacaggaataaagatctgtctgtctgagca

SEQ ID NO: 641934 - DNA, 146 bp, Homo sapiens
  misc_feature (57)..(57): n is a, c, g, or t
  misc_feature (59)..(59): n is a, c, g, or t
  misc_feature (81)..(81): n is a, c, g, or t
gttctcttcagcggtgtccattctggtccagtcccttcccgttcttttttgtctggnangttttttcctccctgtcttcanctatctcctagcttttaaacacaagggttttctagccaggacatatctcactccacacctccttg

SEQ ID NO: 641935 - DNA, 1172 bp, Homo sapiens
ggcagaggttgcagtgaactgagatcacaccactgtactccagttgaggcgacagagtgagacccagtctcaaaaaaaaaaaaaagtgtgtgtgtgtgtatatatatgttatatatatacacacacacacacttcccacataccagcccggaattacccgcccttgggtctttctctggctcttggatcatcagcccccatatcatttctggataacagagcaccagcaacagaatctctggaaagcagaccttgatgaaatcgtgcctgtgtcttaattcacaacggcgtaacgtgaatgccgctagaaaggtgctcacatacacttaccccagaaacatgagcagcctgtctcatgcaggcagtcgggagccagcgcatgctcagcggaacctggcactatgtcttcatgactgctgcatggctgctcaaccaagtggggactgacccctcctgacacgagctcggagtaacacacgcaacagcgtcacggcagcccacgcgactcatcgaaccacctcacaactactgcacccattgcagccactgccccgaccacacacgcccgcccttgcaacacgacgcactcgtacaacaccctcacaaccacaccaatcaagccccccgcgcaaccaccgcacctaccacaaacgacactcacacaaactaaccacgctgctcaacaccctgccccccacaacactgacaaaacccgccattctcgccgcatcaatgcaacacccccacaacccgccccacaccccatcgcacaccaacatgcatcccccacacccaaaatcacaaccacaatacaacaccaccacacacaacaccaccaccaataaaaaaccacaaacacaacctatcaacacacaagacgaacagtctccccacaactcacgcctaagcctcaccccaaacaaagaacacacttcctatcgacataccaaccataagactaacaaaacccacacacaccacaacacaacccaacaacgccgcacgcccacaccaacccacacagccccccacaaccccaaaacagagacacaacccccacaaccaacacacacccacggcccacccaacactaccacgaaccacaccccacacgagaacacaaacaaaaacaactcacacgcacccaacacaaacaccacaaaagaccaacc

SEQ ID NO: 641936 - DNA, 423 bp, Homo sapiens
attcgcagatggcagaagcgcaggggtgccaccaggggtcacggcagcctcaccctcccaggcccaagggaaatcttttcacctcagcctcctgagtagccgggaccacggggttgcaccaccacaccgggccaattttggtatattgtgtaaagacaagatttcaatatgtgggccggtcggaaactcttgagctcaatctgcctgcctcagtctcccaaagtgcgggaataaggagccacagcacctgggccagattggtctctttaaccacccgctcgggcatccctcttctctcaagcgatatccgtctctctcactcagcgcttctcggtctcacgtgatggtatcccttttcctacatttcccagcatctcttcctgaaaccgcttgggcaaaattctaccgaggaggctgaggggt

SEQ ID NO: 641937 - DNA, 103 bp, Homo sapiens
tttctcctccaacgtcccctctgaaatcaggtcttccctgtcaccctgtgtatcatacctcccactttctttagggcagtagctccaccccaggggtgattat

SEQ ID NO: 641938 - DNA, 627 bp, Homo sapiens
  misc_feature (590)..(590): n is a, c, g, or t
  misc_feature (627)..(627): n is a, c, g, or t
ccagctactatatatcgatggaaagttgtaccccaaggaatgttaaatagtcaaacttttgttggaaaggttattcagcttgtcagggatcagtttcctgattgctatattattcattatgttgatgacattttatgtgctgctgcaagcagggacagacggattgagtgttttgctaggctacaagaagtggtgggacttacaggtctcgctatagcaccagataaaatccatactacaccctatcattacctgggaatgagggtacaggagaaaacagtaaagcctcaaaaggaggaaattcgtaaagagtccttaaaaaccttaaatgatttccaaaaattattaggggacgttaattggataagacctactttaggaattcccacctaagcaatgtctaaactgtttgctttgctgagatgggatccaaattcatgtagcaaaagaactctgatgcctgctgcagctgaagagttacaaatgattgaggaattcaaagtgctcaagtccgtagaagagatcctagtgttccattacaggtgttagtgttccctactctccattctcctataggagtgattgttcanaatgttgacttagttcatagctattcttatggcctcn

SEQ ID NO: 641939 - DNA, 266 bp, Homo sapiens
cactcgtcgtagaagccatagcatgcggttgatgctggcacactcgtggttccactggagcaggaagaagttctcgcgggtacttaatcttatagtgccagcgagcaggcagcactgtctccaaggactgcttgcccctgtccacattgtcccccagaaagaggtcgttgctctcgggagggaaaccgccatactcaaataatcgcataacgtcgtaatagcggccgtgtatgtcaccgcagatcttgtccagaattgccccgagt

SEQ ID NO: 641940 - DNA, 633 bp, Homo sapiens
ggctgcaggaatccggaccaggaatgataggaatgctcagccaagtcccagctacttctaagcctgggctcaagtgtcctggctctacctgccttgaactggattatcctaagctgatattcggaactttttagtccagaaactatagaccagggctctgcaacactgataccataaatacttcctggattttatctgccagtagccacagataccactgctagctgctacatataggatgagtgattaaacctgcttctcaaggtcaaatgctacacatcttttgagatgctgaagaaggaagaagcactttcatggcctgaaactttagcaatcgatcattcctatattgcctacaaagcagcatatgacgaagagatacagaagttacttaaatggagttcagatttaagcgtgagtaaacctcatgccttcagcagtcgatacataggtgcagagacctaggcctttgcaatatacgtaacagtacgtgtggatcccaagcttgatcgggtccttctgatgattaacgtgattaactagggctgcagactgccatccagttagagttcagacctcaggtacaggcggacagttggtacgtggtgccttacccaagctatgtcgtctgtt

SEQ ID NO: 641941 - DNA, 788 bp, Homo sapiens
cgggttagacatccgttccagattcgtattccggaccccttcttgaatcccttccagatggacactggacagtggatcggaacctttccactcccagactcgggtaatcgctcgccaggacgctacctatgcccccagactccccccgaggacctggagcctctcctgcctctccagtcagccccttctcgccgtgttcttccactgagagccccaacccctggacgctgaagtgccttcctcccccgacggcccgcgtcctgcagacagcgcccttgttcattccacatccgaccccctcatgccgcccgagggatgaggcctcttcagagccgcctcccccaacccgcttcctcaggaaaagtccgttccccaaagccgagatgatagcagagtcccaggcctcagacatgctcatcattcggatatgctgaagaccccatggccagcccagccgcttcccagactgggggagtgaagttgctgcccccgggacacccaggaccaggcaccccagaatgtgtacgtactctgcccagccggtggccagtaatagtgaccagtgaccctggactatggagataatggttttggagctggaaggggaccagttagtgaaagccactgaagagcgctgcccccgaattgagaccacttgaagaaaccaaagacgatcccgagatagattatcgacaatttccctagagtcattccataaatttacagccatactgtgattttattagaaaaagagaagaactctctgaccaggttgaaggacagaagga

SEQ ID NO: 641942 - DNA, 589 bp, Homo sapiens
  misc_feature (81)..(81): n is a, c, g, or t
acggccgggcccgggggggtgtctcccctttcgacacggtgcgcgcgccaataataatgcagtccgggcgcaaaggagctnacatcatgtacacgggccccgtcgcctgttggaggaagatcttcaaagatgaggggggcaagcccttcttcaagggtgcgtggtccaacgtcctgcggggcatggggggccccttcgtgctggtcctgtacgacgagctcaaaaaggtgatttaagggccgcggcctcctccacacacacacacacaccaggggaaccaagagaaccacgtagaatcctcacccgtggggaccatcacccttcgagaaattccagttgtttttttcccacccgcatcctgcctgtaaatggccggggaaggctctaaaaaaagggcgcatttcgatccaacccaccgccacccaattccgttttttgatcacggggtgggagggaaccgtggggtccctgggtggggcccatgggtgagacactccagtattgagccctagagtccaaatgcttgtaggagccaagtcgtgttttaagtatttatttaaaacaaaaaaatcacgttttcccatttgta

SEQ ID NO: 641943 - DNA, 912 bp, Homo sapiens
ctacacttgggcttttgattctgtaagtacttcaagggtgtggccgagtgcaaacagctcccatgtttgagcagaccaattattaggcaattttcctaactctgcttccgcaagagtctccctatcaattactgcattacccattgtgtttatttttttccctcagtcaccccgggaggaaccaatctatcatcctgccttgaaggtagtttctgctgggatctgggtcagacctttggtatgggtaatggaggatttaaatccccttgttaggaaatctgctaggttaaggtaattaagctggaaggttaatgtaaaatcacctttactagcagaatagacccataatttaagatttatggacgttagttaagctccctttctaggcgttccaagacttaggatacgtcctcgaccgggctgaggcggtgctcacaatgagggtccctctaaaggttcactacccacctgataagccaactgatagacaaagccagtcgctgaatacagtacttggacctgcatcgggccatccaagggttccggggctcaggatctagcaaagaacaggcactggaagcaagggggataacagagactacccgcgcacacgcccttggttgcccctgacacaccaaacggtatcggacagaatcattgggcaacgcgagcacctcgactcagtacgatttgataaaaaagaccgcggatggaacgaacagggagcaccagcacaccaataatcagcgaccaagcacgagacaccatggcatagagaggatggaacccaagaagatccatgcacatgccaacaaacggtcccatacacacgaaccccactcggaacacacatgacgggataagaccgagcgcgatgccacaacaacccaggcaaccagacaaccgacctac

SEQ ID NO: 641944 - DNA, 298 bp, Homo sapiens
gattctcgaaagtgtgcagtgagcagtagtgaagcagaatttactttcccatgtactcctgtagttctgtccctgtccccgcgaaccccaggagggtacaaatgtagatcgaaaactgtaaggcctcaaaccagttaggacaagtccctttctcgtaatactttatttcattcccaatgacagaaggcaggtgcagttccagggctgtgcgcctatcgtctgggtcaagagaagaacacagctttctttagaaaaacatttagtttaaaaccaagcaccttgattgggtattataggg

SEQ ID NO: 641945 - DNA, 240 bp, Homo sapiens
ccagcgattgaagtgcaggcgtgatgggagttgctaataaataagtataaagttttagttatgcatgatgagtaagttctagagatccactgtacaacattgtgtttatagttaatactgtagactgggcgcggtggctcacgcctgtaatcccaacactttgggacaccgaggcaggcagatcacgaggtcaggaggtcgagaccagcctggccaacgtgatgagaccccgtctccaca

SEQ ID NO: 641946 - DNA, 351 bp, Homo sapiens
  misc_feature (349)..(349): n is a, c, g, or t
tcttgctctgttgcccaggctagagtgcagaccatagctcactgcagtcttgaccttccgggctcaagtgatacttctgtctcggcctcctgagtaactggaaacacaggtgtatgccaccatgccctgctaatttttttaatttttatttttgtagagacaagttctccccatgttgcctaggctagtctcgaactcctggggctcaagggatcttcctgtcttcaacctccgtaagtgttggggattacaggtgtggggctaccatgcctaaaccttgtttatttatggaagatgggggtcttggctatgtttgcacagggctgggccttcaaactcctggggcttnta

SEQ ID NO: 641947 - DNA, 206 bp, Homo sapiens
ccagacagtatcattgtagcagctgcacacccatatctagattaactctttggtctctgtatattggaacaaaacctgacgctatcgcttgccgccggcaggagtgcaaccaaaaacacagtttggggtcagacgacattaaaaatcacaataaaaaaggtgccttgattccagttgcgtgacttagaaccattcatcctgggtca

SEQ ID NO: 641948 - DNA, 293 bp, Homo sapiens
aaagaaacccctattggcttgttattttatataaataagcattttgattaaaagaactatttgaactgaatattttctcccacagaatgggaattagatttctttaacttagcctggcttagggtctctctgtcttcctttttttgaagatctgaaactctggcaaaacaatgtcatattttctgctaatttgtggttattgtccttttgcaggatttgaatcttatatgaagtttattttgtcaccaggactatataccagaatttgagtctcagctggtatcggtggggga

SEQ ID NO: 641949 - DNA, 1244 bp, Homo sapiens
acatcagctagtgattatcgctgtcttccgtttttatggctggcgtcttttgtttcctctttatactgtttatttgtcttgctctctccttgttgtttttttttctcttctctttctctattgttgtgttgctcgcaacttttcccaacgttgcgctggcgcccaactattcctggtctttcgatgtgttccgagtgtttcccccgttggcctccgcgcccttgttggtcttagttttttccgcccccaaggcgcattattccgtttgattccggggcatcacatctctgggctctactgtcccaccgtgccccccgatgtggattttcaaccaggggtgctgcgaattcggggctcctacatctgtcccccgcaatggttttcttatcggtacttctgcagaatgtcgtagcactttctgcaatgggtttaattgaggaattagaaattgtgcccctcggccaatgcgaccacaccctcactgctagcctcccgtaactgggattaagccttcgtaaagaaattgttccctggaagcttgttatctgatatccgccctggattgtagaacttgttgctgattttgaccctgtattgaagattaactgttccccctggtaatttgtttaaataccccggtacacaaatctcttgagttcacacccttatgtaacgctgtggctctggtcacacttcgctggctataaggtaaagaaacgctgctctgttggaaagacccaagttctcgttgtgctctggtgtagagttctcgtgtggcccacccacgcctctctgaattctcgtggccacgggtatattaaacgtggtccacgggctcgaagtgttttctcgggaatttttcttctatagagaggctcggccaagagaacccgcttgttttgtcttgcgggtttcgtcacgggttgtgaaagttcccaagcccgctaggagccccgctttcctcttcttatgctgaatgttctttgtgccacgaaacacccgctgggctcgttaacttggctttgaggttggagaagcggtttgcacatttacgccccgtaaaatgtgaattcacttcttaaatttaatgtaaaggttttttttgtaacgccatttctcgagattctttgaaagaagatgagcaccaccacaaattttggttttctaactgttaatgtgaggaacccttaggcccagccacacgtccttgtgtaaggaaaaatataaagtgctgccgtaaccca

SEQ ID NO: 641950 - DNA, 289 bp, Homo sapiens
aaaattttaaaaattagccgggcatggtgatgtgtgtctgtatccagcacttcaggaggcaagtgggaggactgcttgagcttagaagttcaagaccagcctgagcaacatagggagggcctgtctgtacaaaaaactaaaaaattagctgggtgtggtgatacatgcctgtggtcccagctacttgagaggctgaggcggaaggatcacttgagcccgggaggtcgaggctgcagtgaaccatgatcatgccactgcactccagcctgggcagcagagcaagaccctc

SEQ ID NO: 641951 - DNA, 130 bp, Homo sapiens
gggtgcagccacatgagctcacagcaccccctgaacacccagactgcagctcacctcacagcaaccagctcaaacagcagccaccaccgcgtcataatgatagcacaacacatcagtggcgcacagcatt

SEQ ID NO: 641952 - DNA, 117 bp, Homo sapiens
tactgtttctcatatttcaccttccttaatttggagttttctgtcttctttgtcacggcattcaaagtaggaataaactttgcttgatattgtgtgcgatatttgaatgcgggtacc

SEQ ID NO: 641953 - DNA, 222 bp, Homo sapiens
tgtactggtgtgatctctagagtctgaccaggctccagcttaactgatattttggagtgtcagcactggtgctcacgtgtcgacggaacttgtacatgtggaggcatgcacctgcagtggtgaatacacgtacgaccatggctccagtctttaacgatattttggacggtcagacacgtgttgctcacagtatctgactggaagcatttgtcctaatgggat

SEQ ID NO: 641954 - DNA, 423 bp, Homo sapiens
ggccactactctgcccctgacaggaggcatcagtgggctctgtttgtttcccattgggtttgccatggaaacattggagattggacagtggcaggaggataaagtgggggtacgtgtccttggcccccttctcacggggtcctagctcctgccctggcctttgggtcccccttcacagctctggaaactgcatcctcctctgggcagccatggagatggcttttgcttttcagcctgaggaccacactctccctctcagcactcctgagcccagccccgcaccttcctcgccattcctcattaaactgccactcattcgattgccacatgagcatgagtgaggcgagcaaggtgcccaaggtgcaaaaaaattttttttacatggaatctccagcctgggcaataagagtgaaactctgtcaa

SEQ ID NO: 641955 - DNA, 472 bp, Homo sapiens
ggccactactctgcccctgacaggaggcatcagtgggctctgtttgtttcccattgggtttgccatggaaacattggagattggacagtggcaggaggataaagtgggggtacgtgtccttggcccccttctcacggggtcctagctcctgccctggcctttgggtcccccttcacagctctggaaactgcatcctcctctgggcagccatggagatggcttttgcttttcagcctgaggaccacactctccctctcagcactcctgagcccagccccgcaccttcctcgccattcctcattaaactgccactcattcgattgccacatgagcatgagtgaggcgagcaaggtgcccaaggtgcaaaaaaattttttttacatggaatcacttgaacccgggaggtggaggctgcagtgaacagagacagtgccactgcacatcagcctgagtgacagagagactttgtctc

SEQ ID NO: 641956 - DNA, 181 bp, Homo sapiens
ctttgcctttacccaaaacctttttggaggtcccaccccgtttttttttgtgttcacccccaaaatgtgtacccggttgtaataggaacttaaatccatttttaggtgttccaggaacttgcatatttaaaaaaaaaaaattagtccctggcccatttttttttttttttgccccaggcca

SEQ ID NO: 641957 - DNA, 197 bp, Homo sapiens
cacagcaagtgggtggtgaacttcataagactatttctttcgtcacctaggggccccaagaagaaaaaggacattgaaattctccctgtctagggttgattcccacgccccagcgagccgtgttcttacttttgggaaaaaatcccccggcgtggggcccccctttttttttaaaaaaaaggcccccccaaaaaaaa

SEQ ID NO: 641958 - DNA, 224 bp, Homo sapiens
gactctagagaaatcttatcggcgcccttttttgtctctctactatcagcactggtgaggcggatacctttcctcggggaagagaaatccatggttagtggccttgccagtggggaaatgttggccaagtcgagtgggaaaagtgttgccattggccatctttcacgtgaaaccacgttcaaaagatccaggctgcctactctctgtagggtgatcacaccaaa

SEQ ID NO: 641959 - DNA, 435 bp, Homo sapiens
ggaaagcagatacagcatgtactctcttataagtgggagttaaaggataagaacttgtgaacataagaaggaaacaacagacactggggtctacttgagcggggagggttatatgaggtagaggagcagaaaagataactattgggtactgagcttaatacctgggtgatgtaataatatgttcaacgaacccccatgacatgtgtttatctatgtaacaaaccttcacatgtaccagcaaacccaaaataaaaataaatttaacaagttaaatgatgctgggataactggctagccatatgcagaagattggagctggaccccttacaccatatataaaaatgaactcaaggtgaattaaagacttaaatgtaaaaccgaaaactatgaaccctgcgaacctatgaggcggatccctctagaagtacgagctgc

SEQ ID NO: 641960 - DNA, 111 bp, Homo sapiens
  misc_feature (20)..(20): n is a, c, g, or t
ctctagaggatccggactgnagatgttggacactgggccaccaacgcaatgacgacgaaaccttctgatgaagcctccagtggagaactgggcttggcagacatctccagt

SEQ ID NO: 641961 - DNA, 753 bp, Homo sapiens
gatccctcaggcggctgcaggcttcagcctgcgctggttggtgaaacagagatgtcagaaaaggagaacaacgttccctgccactgcccaagttcatccctgtgaaggccctgcttctaccagaacttctccgacgagatccccagtggacgcaccagggctccatggtgcaaggaggatctacgcgggtgtggagtgtttaacgtgcgccacccgtcggcgtcggagctcattgcctgcctggcctggtggatcgtgcggattgctcggtggaccaatgttcggccttggccttcgtgtggctgcttcctgttcacgccttgcggctacgttgtgctggttctcggcttgtctacagaggccttccgagccgactagctcctttaggttccatggcgtcctctctgcatcttcggagcccaggtttgtccatgaccggtcagtccaggctgattggcttctccggctggggcgcgtgcgagctggctgtcggccattggattcttccagctacagcccgggcgctgccggggtcatgctgcttccagccactcatgttctcccgtgtctggctgcatgatggccatcgcgatcatgactggtgcccggatctaccgagggcgctggctggaagcttccggacagcccatactggttggcacacgggccttggcgggaccccccgcgacgggggccccgtcaacatctttcggcgaagcttgcccagtacccccttgtgcccgtaaccggcgg

SEQ ID NO: 641962 - DNA, 141 bp, Homo sapiens
ggtgtgccgatcttgctccacgcacctctgcctcccgggttcaggtgattctcctggctcagcctcccgagcagctgggactacaggcatgcaccaccacgcccggcttaatttttatttttaggggcagagtcttgctcc

SEQ ID NO: 641963 - DNA, 102 bp, Homo sapiens
cgccgccttggttgcctaactcccgtctaataggcctactccctttctaggaatacaggtaacagatcaaagaactacacgtgcatcactcacaatgaccat

SEQ ID NO: 641964 - DNA, 198 bp, Homo sapiens
gatccccactcatgcatccaacccagcagcaacacgtgcaaactacctcagcaccaggcatccaagcacatttcccagcacatcatcaagccttcaacacacaatggcctccgctgtgggtggcagcaattgggtcacctgagctcgcaattctgtcaatccatggtccatcagctgtttccatgtagtgcaacatgg

SEQ ID NO: 641965 - DNA, 276 bp, Homo sapiens
gtatgaatgaaggagctcaggcaagaacatcagtgtggcttccttgcaatagcagccaggttgtgctaggctagtagagaggtcctctactatctgcagatcatcctcaggagctccgtagatcagccacacagagattgaacatgaagtggcttgattggacctcaccctattaggagacagctatggactgtcccctctttgtgccattgtgctctgtatgtacatatcggctcggatgctgtacttgacctcttatgaactactgctcaagga

SEQ ID NO: 641966 - DNA, 492 bp, Homo sapiens
tacttttccacaggctcgtccctgttctcgtttctttcccccttttccatccgagtagtttctgtgctttagccttgtctatcattctctttgctccagtttgtcaggtgaatcatgatgctcatgagcggaaggtgcagtgctgagtaacagtgtgggaggtttccctgccatcttcccacccgtcattccttttctttttttaatttgtatttattttattttatttgttctaccctagtgaatacaacctttgtcctggagaccccagctagtctaagaaaacttcctaggctgagctctcttgggaatctaagataaagaactgagatcctgggaagaagggaactgcctcctcttctttctgcaagcccaaagccctcgggactgggcaggcaatgataccacccactttgctacagtgataacagaccctgtgacaagataatgggaagtgtcactgacattagctgggcatttaggcattctttc

SEQ ID NO: 641967 - DNA, 253 bp, Homo sapiens
atctagaggatcccggtgttccctttgtcttcctgcagcttctctcacacagtctacctctgcccttgttcttccatgaaagccgtgggcctgggaaaactctgtactgggcacctttccttactgtaattctagacttcagtgccgtcctaagaagacaaaccagccctgtgttcattcctctaagaatccgaattgtctttgaaaagtcaaaaggggtcgggtatagtggctcacgtctgtaatcccagca

SEQ ID NO: 641968 - DNA, 300 bp, Homo sapiens
tctggatcccaggagcctgaggcaggagaatcacatgaacccgtgaggcggaggttgcagtgagccgagatcgcgtcactgcgctccagcctgggcgacagagcgagatgccatctcaaaaaaaaattaaatgtgatagtagatattgagcatcttgtagactttttgctaaacatagcttttaaatacacacatttatttttactcctgctgaaaccctgccaaaatgacaataaagaaatacaaaaaggcatgcatgcccaagcccaagtaaaatgggaaaagtagaaaacagtgaaa

SEQ ID NO: 641969 - DNA, 616 bp, Homo sapiens
  misc_feature (181)..(181): n is a, c, g, or t
  misc_feature (615)..(615): n is a, c, g, or t
tggtctcgaaaaacatgaaccgccggggggccgatcaaaattgctggtttaacctgttggaccgaaagcctccggtgatatttaaaatcagcccccaattagctggccagggcaatctgaccaaggacaagtgcggtggcttgccgtttggcccagcccctgctgcagaccgtgggtgtanggccccggcacccacccgagcggaaggggtcgctgtttaaccaccaccaccgccattggccaatctccccattttatccccattccagtttattccataagccttacgattgtggttaactgaaatgttccttttaccggctgtttttaaaataaaaatgtatgtataggttttgaattttttaaaagggaggaaagactgttaagaagagctatttggtgactaacaactgaatattttagcctcaatccgtttatccagtcctcgaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattcccctttttna

SEQ ID NO: 641970 - DNA, 137 bp, Homo sapiens
caccgacgtgcggtgacatgctccctgtacaagttccgtcgacacgtgaggcaccgtgcttgacctccacaatatcgtataagcatggagccttgcgtcgacgtctagtaggatcactcaagctacccagaggcact

SEQ ID NO: 641971 - DNA, 126 bp, Homo sapiens
aactcagggtgcgagctgcggcagcttctccacaaggacaagagcaagcgaagtgctgtagccagcagcgtggtcaagcagaagctagcggaggtattctgaaaaaacagcagtcgcccctgagtt

SEQ ID NO: 641972 - DNA, 354 bp, Homo sapiens
tgtcctttgtttgtttgtttgttttaactgatggtttcgttttgtttttttttaagatggagtctcactctgtcgccaggctggagtgcagtggcgcaatctcggctcactgcaacctccgactccctggttcaagcgattctcctgcctcagctacttgggagctaaggcaggagaatcacttgaacccaggaagtggaggatcgcttgagctcaggagttaaaagaccagcccgggcaacacagagaaaccccccacctctacaaaaaactttaagattacctgggcacagtggctcacacctgtaatcccaacactttgggaggctgaggcgggaggatcatttgagccca

SEQ ID NO: 641973 - DNA, 1095 bp, Homo sapiens
tggcatttaaccactaaatctttatggaatttttattggtaacagcaatgcaatattaggcaaattagacagaagaaattttagagtgtgaagaagtaattacagcaataaagtttaaagagggaggggttaggggcaagtggggtttcaggtggctaggaaggaaggggctacgtgcacgaggggttacacgccagaggggtttgaatttatatcacactcttttatataacatctttccctatggaaacatattttacccatccctatcctattggcaacaatgttccctattctctaaaggccgagtaatatttatatcccaagagtgtccgatctcctatcctctctctatatgtaaatacttattttagatatctctaatattcccctctttttggaaatcttgttctccccccaatggggggggtggtttctatatcccctatgtgtcccccatatttccggctctctaaaatatacaatgtggggaggctctccccccttgaacatgttcaccctctcgcgcgaaggtttaattatctcgtgagacacatctcttctaacagcgcgtataaccgcccatatttatactcgcgcgggggtaaacacggggtgggttcaccacatgtccaaatgtacacgcgctatttgtcccccaatattatatcgacgcgcgcatatatcctaatattccacatatcgaatattatgtatattcttctacacaacatattcttcttcatatattaaaaccgcgcaaacccccaaaattttttaacaatactttcatcttttaaataaaggtccgccctttcttctttgttttccccccccaagaagaagggttccctttaggcgccccccaaagggggctcgttgaacttggtgttttttcaccctgtgtggtcaactctcttggaaccactcttcgtgttgtgccggggcgccacaacgcgcttccccttcgtttttgtttaaacccccccccaagatattttgtgggcgcctccttggagcttgcgaaaatgtggcgccctctcttattgggcccccctgggggggggcgtatcacttcatccctttggaaattgg

SEQ ID NO: 641974 - DNA, 212 bp, Homo sapiens
gctggagatcatacgatactaagcctggctcttctcactttgccgtcatttccttgtagctgcaggaagaaagtttccttctactagctgcatagaacaccatgataaggatacatcagtttcagctcttctattgctgcgtcgaacaccggaataaggatacaccagatttcagactcttctatttctgcgatagaaacaccgatgataag

SEQ ID NO: 641975 - DNA, 176 bp, Homo sapiens
  misc_feature (81)..(81): n is a, c, g, or t
  misc_feature (83)..(83): n is a, c, g, or t
  misc_feature (106)..(106): n is a, c, g, or t
  misc_feature (150)..(150): n is a, c, g, or t
  misc_feature (168)..(168): n is a, c, g, or t
tgatcctgaagtacagaaagacattaaaaatgttcccttttaaaattgtccgtgcctccaatggtgatgcctgggttgagncncatgggaaattgtatctccgagncagattggagcatttgtgttgatgaagatgaagagactgcaganaattactggggcacacancaaaaaat

SEQ ID NO: 641976 - DNA, 961 bp, Homo sapiens
gagacccatcaaagtggagatgccctcccttggaaagagtggcgcctcctccgagccccgatactttcagaatgagtgaatcatctcactcctgaggagtgattcgtcgccaagtctcccaccccgaagacccaatgaagtcctacagtgggcttaggtccccaacccggtgtgtctcgtgaaatgcttgtgattcaacgacagtggcagatgcgagggagagtgagcccggtctcggcaggaaacatgcatctactgcctcccgtgtgtggatgagccggatgctgctcttctcagaggggcccatgtacttccctgctgtggcctgcaaagctcccagttcccagcagactccgtctgacccttgcctcccagctcagctactcccaggaagtgggaggaccttttaagacacccattaaggaaagcgctgcccatctcctccagcccgagcaaatctgtcctccccagaacccctgaatcctggaggctcacgcccccagccaaagtcagggggactggatttcagcccagtacaaacctcacagggtgcctctgaccccttgcctgagcccctggggctgctggatctcagaccagtccctttggcaagtggtcccacccccttgaactcaccgcacaggtcctcagatcagaaccttagacctcatctacgtaccctttgggcaactattactaccctcagatttagaagtacccaagaccaggacccccagagacaaaaggaactgggacacagaacccaatacatcctcgcacaaacgggccctcgcccgggaacacacaggagaaggcaacacaccgacagagacccgcatggacaaacacaataacgggcctagaaacggcacacatgaagcccggacaacacacggggacccagagagccagcgggacgaagaagacccgaccaaaacaataggccctagtggataacatg

SEQ ID NO: 641977 - DNA, 461 bp, Homo sapiens
  misc_feature (56)..(56): n is a, c, g, or t
  misc_feature (73)..(73): n is a, c, g, or t
  misc_feature (134)..(134): n is a, c, g, or t
  misc_feature (164)..(164): n is a, c, g, or t
  misc_feature (224)..(224): n is a, c, g, or t
  misc_feature (233)..(233): n is a, c, g, or t
  misc_feature (235)..(235): n is a, c, g, or t
  misc_feature (257)..(257): n is a, c, g, or t
  misc_feature (283)..(283): n is a, c, g, or t
  misc_feature (383)..(383): n is a, c, g, or t
  misc_feature (406)..(406): n is a, c, g, or t
  misc_feature (443)..(443): n is a, c, g, or t
  misc_feature (450)..(450): n is a, c, g, or t
gttttgacaacatcgaacatcaagtcggaccggggatttagggcattgcctactgncaacgtgccccacggcntctgtggaggagacggccgaactcgacgctgtgccacatcctgaacctgtaccgggcgggnccacctggctgcaccagggcgctgcggganggcacacgagtccagcagcgtcgagcagatccgcgaggtggcgtccggcggctgccaggntccgcgggnanaccttgggcatcatcggacttngtcgcgtggggcaggcagtggcgctncgggccaaggccttcggctttcaacgtgctcttctacgacccttacttgtcggatggcgtggagcgggcgctggggctgcagcgtgtcagcaccctgcangaccttctcttccacagcgactncatgaccctgcaattcggcctcaacgagcacaaccanccacctnatcaacgactt

SEQ ID NO: 641978 - DNA, 165 bp, Homo sapiens
agcaatgaggcagctctccgtgaaatgcttctcccaaaaaagcacctggtactaaggggtactgctgctgctgctgctgctgcgtgctgctgcttgttaaacgttccagcaaaaatcgatcaccggccggcgagttaaaaagggctccagacccagaatggttcc

SEQ ID NO: 641979 - DNA, 863 bp, Homo sapiens
aacaggttgttttcctccttccctccccgaaaataatgggtaacctcctgtataaaatattgccccccgccggccaattggttttgggaaaattacacatgtgcgcgttccttcccccccccgatacttaggactcacacagtgtgtggccacgcgataaccacgcgctcttcctaatttcccccacacacttgtgcacccccatcgccatcatccttgtctgcaaaacatatgtgttagaaagtatctgtttctcccacacccatcctctcatgaggcataacatgtcagggtctacagaatactctctttctttatccacacaccacgcacacaaggtttttgcggggctggagtaaaactttatctgagtaaggtaagtaaccccccgtcccctcactcattcttctgcgtgcgtactcactgtcgagtgcacctctcttatgttggaaaagaaatgtctggtcactcactcccactcacacacatgctggcgggtggcaggcccttgggggacaccacacagatgaacgcctctcttcttcgcgtaataagcaggccgcaagcgcaaaatttgttgtacagcactcctcgcttccgtgggaaacttatattatgtttgtacgtcacgcccgtgtgtgcgtatcacgcacagggtagggggcaaccccctcttatgaggacgtgtatgtggtgggtgtgctgtgcgccacggcggagcacccaggcgcatattttgtttggttggggttctcacacagcggcaggtatatgttttgttataagacaacataaaaaaataattgctgagaccagctactcatgataaatttaaaagaaaaaaaaaaacgaaaaacataaca

SEQ ID NO: 641980 - DNA, 1325 bp, Homo sapiens
gggcactgcggcgctcgggtgtatgtggatggccctgcgagtggaagggcccggatgtcgaggcccaaggtgctgccttgatagcgaggagtagggatcgggactcaccgggcctggagagagcgtactcagggccaagagactgaggaatgaggacttcattatccccatgcccaactatggaagcgtagcgcatgatggaggcgacttgcctgattcaggttcatcgctgttgacttcattggaaatctaggcaccaccgatgcgacgaagggttggacaatcatttttgtcactatgttgagttggcgcgaaagaggtgtatggacgtgttgagcgagaagattaggacgcgtagaaaaagtatagtgtcatatagagcatcatttcggcgcattgaacgattatagacagttcaaaaaagatgtaggaatcgcaagaagcgaatgaaaattgatgcatagaagagagggaggaaatttatatggacgatatagaggaaacggaaggggtacgagtatgtgtatgcgtaatcgtatcgaatgacgggtcgctagagtgagcatgtagaaaattaggcgaaagaggaaaaaatgacatgtcgaagggatgctgaataggattctccatttgaagactgatttgagacagaaaggacgagcagggcaaatggcttggtaagtacccaaggtggggacattgggacacaccacagcattataaaggttgagaagccaacagaaagatgaaacacaaagcgcaacggaagtcacaaacaagggccgtgagaaggaacacagtgccaagttatacagaacggaaagcggggagcgaccaacaccagtcttaggaacatgaaattgagaccagcgaacggaacagcccaagaacatatagcaagatatacatacacgtttatatgaataacaaattcagaatagacaccaggaaggcgaagaggcgggccgtatgtgtatagggaccgacaccaaaccaaaaatctaatatctcgcgcactattccattagtagtttaaagcaccacattatcgtcgcggttaccatagaattgttacgtagtggcacagcaggaaaacaatgagcataaagacccacaggcgctagtacaagcccacagcagggcagtactcgcggagacaagaaaaaacacaagaacgacaaatccgcgaaaatatgagtagaccacctcactagtagggcatacccacgagtcggtatactatcacccaagctcgtagtgaagacaacacgtattatgttgacacatatacatagagtgagaagcaagccactacggtggatcaa

SEQ ID NO: 641981 - DNA, 346 bp, Homo sapiens
ctgagagatagtgtgatctatccacgaggattatatagatacataatgagaagccacaagtacaaccttgattagacatactgacaatacttgcaggtccgattacaaaggatggtgaaacttagtatcgaaactgttgacatactgtcgaaaggctttaatggttcttaaccgagtgaccgtactgtagcacatactatcgcaattcaagctgttcatgactctgataatcatgaagactttatgatggcccacttgagtgactgtttatttgttggctgacattggttaccccccccccccttattgtgttggggggggggatattatcttggggggggggggg

SEQ ID NO: 641982 - DNA, 672 bp, Homo sapiens
  misc_feature (332)..(332): n is a, c, g, or t
  misc_feature (377)..(377): n is a, c, g, or t
  misc_feature (389)..(389): n is a, c, g, or t
  misc_feature (400)..(400): n is a, c, g, or t
aactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccnagccccagactccagtgcaccaagaagcacggcacaaggaagccntggggcgcgctngctgtgaaacngtcctgacctgtgatcacacatgacagtgaggaaaccaagtgcaactccttgggtttttttagattctgcctgacacggaacaccaggtctgctcgtcttttttgtgtttatattgctattaggtcattctttgggtttctagagacgcccctaagtcacctgcttcattagacggtttccaggttttctcccaggtgacgctgttagcgcctcagctggcggtgacagccggcccgagccgtggcgccaccagacaccgcagagctgtcca

SEQ ID NO: 641983 - DNA, 472 bp, Homo sapiens
  misc_feature (46)..(46): n is a, c, g, or t
  misc_feature (67)..(67): n is a, c, g, or t
  misc_feature (73)..(73): n is a, c, g, or t
  misc_feature (105)..(105): n is a, c, g, or t
ccttaatggcgactggatttggcctgatcacaccacagtgtggccnatttgggtccttgtagagatngtctcnggtttctactatccccccagcaactgcttccntacctgatccagagggacctggagaccccttagttggaggtcactgggtcattctgaagtggggggtgagggcccaagggcttgtcactgctgtgggcagtctttgtctcttgtagatccagccttaatgtctgacatcccaggaagcgcagaccctgcacaaagtggatatcagagcgatactgtgaggagtaagtaaggagcataggtttaccaaagagaatgagctagcacatcatgtctgcctgttacactgatctgagtgcacccttagaaaactgaatgtaccacagacccaggacagttttggaacttgtatgctctctagcaactttgtgtgaatttttatacaagcactgttttatta

SEQ ID NO: 641984 - DNA, 610 bp, Homo sapiens
  misc_feature (332)..(332): n is a, c, g, or t
  misc_feature (377)..(377): n is a, c, g, or t
  misc_feature (389)..(389): n is a, c, g, or t
  misc_feature (400)..(400): n is a, c, g, or t
aactcggtggagaagcctgtgtcctcgattctgtccagaaccccgtctgtggcaaagagccccgaagctaagagcccccttcagtcgcagcctcactctaggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccnagccccagactccagtgcaccaagaagcacggcacaaggaagccntggggcgcgctngctgtgaaacngtcctgacctgtgatcacacatgacagtgaggaaaccaagtgcaactccttgggtttttttagattctgcctgacacggaacaccaggtctgctcgtcttttttgtgtttatattgctattaggtcattctttgggtctgggcgcctagtacctgtcattgcggctccggttctcacgtccgtgatgccatcctgcgtacccgccccgtg

SEQ ID NO: 641985 - DNA, 118 bp, Homo sapiens
gtcgatctaaggatcccgctggcactcgtcatcacagctataatcgtggtccaccaaataagtgcaacagagtttatctatttttaaatcattgccattaagctgacgagtgcccagt

SEQ ID NO: 641986 - DNA, 701 bp, Homo sapiens
  misc_feature (361)..(361): n is a, c, g, or t
  misc_feature (406)..(406): n is a, c, g, or t
  misc_feature (418)..(418): n is a, c, g, or t
  misc_feature (429)..(429): n is a, c, g, or t
aagtagcggatcctttttgcttgcgggtggggtggtgcagcatctgtctgggagctggcattttcgttgaccggacgaggaggagtctgtactgggagatcatggggacagctcccaagctgaaggaagggatgaagcctgctgggagcgtgaatgacatggccctggatgccttcgacttggaccggatgaagcaggagatcctagaggaggtggtgagagagctccacaaggtgaaggaggagatcatcgacgccatcaggcaggagctgagtgggatcagcaccacgtaaggggccggcctcgctgcgctgattcgtcgagcccatccggcgacagaggacagccagaagcccagccnagccccagactccagtgcaccaagaagcacggcacaaggaagccntggggcgcgctngctgtgaaacngtcctgacctgtgatcacacatgacagtgaggaaaccaagtgcaactccttgggtttttttagattctgcctgacacggaacaccaggtctgctcgtcttttttgtgtttatattgctattaggtcattctttgggtttctagagacgcccctaagtcacctgcttcattagacggtttccaggttttctcccaggtgacgctgttagcgcctcagctggcggtgacagccggcccgagccgtggcgccaccagacaccgcagagctgtcca

SEQ ID NO: 641987 - DNA, 247 bp, Homo sapiens
gaatctcgatagattgtgcaggtgaggttgtaggtgtctggtcgcagtcggagtgtgtgtggggggtgagtgtgccctgtgatgggagggcatcctgtccagggtggtccctgccttgcacactgagctgttgggataggctctggtcgcccaccaccttaaactggaataactgagttggaaaatgaaagaaggaatgaataaaaaattattgtaaaataaaaattgcctcccataaccatacaaa

SEQ ID NO: 641988 - DNA, 123 bp, Homo sapiens
cctcgaggccaagaattccgtaagacggcggctgagatctgacatccatatgggccggcacaccaattcccgttagggcggcatcaactaagcttgtcacagtaccgagcgcttacaatctgc

SEQ ID NO: 641989 - DNA, 331 bp, Homo sapiens
  misc_feature (23)..(23): n is a, c, g, or t
  misc_feature (40)..(40): n is a, c, g, or t
  misc_feature (53)..(53): n is a, c, g, or t
  misc_feature (62)..(63): n is a, c, g, or t
  misc_feature (71)..(71): n is a, c, g, or t
  misc_feature (96)..(96): n is a, c, g, or t
  misc_feature (103)..(103): n is a, c, g, or t
  misc_feature (116)..(116): n is a, c, g, or t
  misc_feature (121)..(121): n is a, c, g, or t
  misc_feature (131)..(131): n is a, c, g, or t
  misc_feature (145)..(145): n is a, c, g, or t
  misc_feature (152)..(152): n is a, c, g, or t
  misc_feature (157)..(157): n is a, c, g, or t
  misc_feature (163)..(163): n is a, c, g, or t
  misc_feature (172)..(172): n is a, c, g, or t
  misc_feature (186)..(186): n is a, c, g, or t
  misc_feature (207)..(207): n is a, c, g, or t
  misc_feature (229)..(230): n is a, c, g, or t
  misc_feature (239)..(239): n is a, c, g, or t
  misc_feature (258)..(258): n is a, c, g, or t
  misc_feature (260)..(260): n is a, c, g, or t
  misc_feature (270)..(270): n is a, c, g, or t
  misc_feature (272)..(272): n is a, c, g, or t
  misc_feature (279)..(279): n is a, c, g, or t
  misc_feature (289)..(289): n is a, c, g, or t
  misc_feature (301)..(301): n is a, c, g, or t
  misc_feature (306)..(306): n is a, c, g, or t
  misc_feature (315)..(315): n is a, c, g, or t
  misc_feature (326)..(326): n is a, c, g, or t
taggtggagaaagcccagctcgnactttattcgctcctcncggggcagggggntccaggagnncttcggtnggggcgggtgccgctctcctccttncaccatncacaggctttctnggctngcgcaggatnggcgctcggccctngcggatnggctngccatngcgcaggtncggggcggtacttnttcttgcggatcatgtgtctnatgctgctgagcgtgggcgcgnncatttcttnttgatgggtgggtcccaananaggaggtggnangcttccnctggccgganctccgcttaatngaccnccacgacanctttggccgtngggtg

SEQ ID NO: 641990 - DNA, 213 bp, Homo sapiens
tcgaggatcttaagcttagtaggcacacctgtctgagttagtccacttatttaggggcacaaaccttagggaaggaattgcagggtcatatggtaaatctgcttcccttcattcataacttttttcttttttgattgaaatatagttgatttacaatgcgttagtttcaggtgtacagcacagtgattcagttatatatatatacactcacaa

SEQ ID NO: 641991 - DNA, 318 bp, Homo sapiens
gatccctccctcagctgcaaaaagttaaggatggcactcaccactccttttcaacatagtactggaagtcctagccagagcaatcagacaagagaaagaaatgaaggacatccaaaatggtaaagaggaagtcaaactgttactgtttgctgatgatatgattgtttaccttgaaaaccctaaggactcctctaggaagcacctagaactgataaaagaattcagcaaagtttccggatacaagattaatgtacagaaatcagtagctcttccatacaacaacagtgaccaaacagataaacaaatcaagaacttaac

SEQ ID NO: 641992 - DNA, 343 bp, Homo sapiens
catgcctacaagaagtacatcaaagattacatgaaatcaatcaacgggaaaacttgaagtaacatgagaccagaaagagtaaaaccttttatgacaggggcagcagtacaaatcaagcacatccttgctactattcaaaaactaccagttctttattgtgtgacaaacatgaatccagatggcatggtagctctattggacgaccgtgaggatggtgtgaccccatatatgatctactctttaaggatggtttagaaatggtaaacagtaaactaatgtggcaattattctggctctatcacctgtcatcataacaggcttctgctcgtactccaaacaacac

SEQ ID NO: 641993 - DNA, 284 bp, Homo sapiens
ccaggggcatcactgtgagcttttttccctagaactattaacaacgcaacaactctgccagagttatgagtttgggagatcaggccattaggcctggatctgtccacctcggcctccccaacgtgcggggattacatggtgagccactgcgacctggcatgagactcttttttttaatacgctatttttttttacgccctattattggttctacgtatattacagtactattataccatggtggtgtataactctcgattaaatggtttctaacgaatccagtg

SEQ ID NO: 641994 - DNA, 363 bp, Homo sapiens
  misc_feature (10)..(10): n is a, c, g, or t
  misc_feature (99)..(99): n is a, c, g, or t
  misc_feature (145)..(145): n is a, c, g, or t
gggtgaaggnccttagggatatttagggtggtttccttaccttccttattggtttgaaggaaaccaggttgtgaataaaaattaattcaaaattagagncccaggcacagtggcttacaccctgtaatgcccagcactttgcganggccgaggcgggcgaatcatctgaggttgggagtttgacaccagactggccaacatggtaaaaccccttctctactaaaagaaaaatacaaaaaaaaaaaaaaagtagccagtcggtcgcacatgtctgtaatcccaactatgtggaaggctgaggcacaagaattgcttgaacctgggaggcagaggtcgcagtgagctgagatcgcaccactgcac

SEQ ID NO: 641995 - DNA, 132 bp, Homo sapiens
attcgcggccgcgtcgacatagacgcggttctcacaccggcaatcccatcactttaggaagctgatacaggtggctcacttgaaccaaacagtttcagaccagcctgagcaacatagggacgctctgtctgt

SEQ ID NO: 641996 - DNA, 323 bp, Homo sapiens
gaacactcttaagaagaagttctagctgaactcccatccgtcagaaaaggggcagatcttctgaactagatagatcacccaaactcatgacagatttggataaggctcaattacttgaaatagtcaaagctaatgcagctgccatgtgtgctaagtctggagtccctttaccaccaaacctaaagcctgcacctgcacctactatagaagagaaagttgctaaaaagacagcaggagctactatagaagaactaactgagaaatgtaaacagattgcacacagtaaagaagatgatgatgtaatagtgaattaaaccttatgt

SEQ ID NO: 641997 - DNA, 3888 bp, Homo sapiens
agcgggttggagggcttcgcgtctgcttcggagaccgtaagggcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaacaatgatggatacattgactatgctgaatttgcaaaatcactgcagtagatgttatttggccatctctggttatatacaaatgtgacccgtgataatgtgattgaacactttagtaatgcaaattaactcatttcaactactgctgcagcattttggtaaaaacctgtagcgattcgttacactggggtgagaagagataagagaaatgaaagagaagagaaatgggacatctaatagtccctaagtgctattaaataccttattggacaagggcttcttcagcatctgtattagtctgtattaatgctgctgataaagacgtacccgagactgggaagaaaaagaggtttacttggacttacagttccacatggctgggaggcctcaaatcatgccggaagttgaaaggcacttcttacatggcagcaagagaaaatgaggaagaagcaaaagtggaaacccctgataagccatcagatcttgtgaaacttattcactatcacaagaatagcatgggaaagactggcccatgattcaattacctccccttggtctctcccacaacacgtggaattctgtagatacaatttcaagttgagatttggtggacataccaacatatcatctacctggccccttccaaatttaatttcccaatttttaaaaccaattattccttcctaaaattccccaaagtcttaactcttttcagcattaacgaaaaatccacagtccaaagtctcatctgagacaaggcaagtcccttccacctatgagcctgtaaaatcaaaagcaagctagttacttcctagataccaacagggtacaggtattgattaaagacggctgttccaaatgggagaaattggccaaaataaaggggttacagggcccatgcaagtccgaaatccagcagggctgtcaaatttaaagttccagaataatctcctttgactccaggtctcacatccaggtcatactgatgcaagaagtgggttcccatcctcttgggcagctctgccctggctttgtagggtacagcctccctcctggctgctttcacggctgttgttcagtgcctgcgttttccaggtgcacggtgcaagctgtggatctaccattctggggtctggaggacgctggccctccttctcacagctccactaggaatgcccagtagggactcgtgtgggggctcccacaccacatttcccttctgcactgccctagcagaggttctctcccctgccgctgagagggcctctcccctgcagcaaacttttgcctgggcattgaggcatttccatacatcttctgaaaactaggcggaggtttccaaatcacaattcttgacttctgtgcacctgcagtttaacagcacatagaagctgccaaggcttggggcttccactctgaagccacagtccgagctgtatgttggcccctttcagccatgctgagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgccagttaacctaaatcatctctctcaagttcaaagttccacaaatccctatgaaggggcaaatgtcgcagtctcttgctaaacactaacaacaggtcacctttactccagttcccaacaagttcctcatcttcatctgaggccacctcagcctggactttgttgtccatattgctatcagcatttgggaaagccattcaacaagtctgtaggaagttccaaactttcccacattttcctgttttcttctgagccctccaaactgttccagcctctgcctgttacccagttccaaagtcacttccacattttgggtatttcttcagcaggacccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcaagaaacccctgatacaactgatcagatcttctgataaaatctcagatctcatgagacttattcactgtcacgagaatagcacgggaaagactggcccccatgattcaattacctgggggtgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaccaggctttgcagtggatgcttttcagtaacagtgaagtggagtgaatacccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttctcaacctgggagagacctgaatttgagtgtgttctctaatcaatagtggtttagcttctttctatttcactcgtttctagggttttttatttgcagtttaggaactattaggaatgtcaggacttcatcagcaggggtaaaactacactggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagc

SEQ ID NO: 641998 - DNA, 123 bp, Homo sapiens
tttttgagattaccggtttgagcccaccatgcctggcccttccctgggtttttggacatggaggctggtccaagttgcgaggtcacggggggaagacccactggtcaagcattgggtacctgt

SEQ ID NO: 641999 - DNA, 1606 bp, Homo sapiens
  misc_feature (1040)..(1040): n is a, c, g, or t
ccggcggtgacggtcgttctctggactgcttggtgttgttttggtcgacgttggtgtcgtttcgttgttgcttctggttggttcttcgcggtgtgtctgctccttagttgggtccctcttgtgtgttcttcctcgtgggtgtgtagtgcttctccggcctgccgttttttcgcggtggggtggtttttttcctctgcgacggggggtgttcccccctggtggtggtggggctcgcctcttgggttgtgttgatggggcgcggctcccctcggtgttgtagtgggcggctgactcccctgggccgaataataatgtgttgtatcttttcgggggcgctacctcgaagggggtagtcgccccgtgggagcagtagggtggtgtcttacatctctcccggcatggttcagtgggagaggtgtttcatccccacggtggagagggataaatatgggcggggccaagatattggggggcgtctacacccccgtggggactggtttcgtagccgtcgctccgggcccaattggtgggttggtccgtgtggcccccttgtgtcaatgtgttgaccgcggtggccccaacgcacaagaggccctagccccagtgttggaaccccccgtgtgggtccgcacaggggctcgtggggcccaccagggtgatgttttggtgaaggaaggttctatttacgggggggtgttgcacccccccagagtgcctgtgtttcacgcaagcctgcacttagtgttataagggggcaaaagttttctgctcgagaaggagaaaattggggagacacacccgcgttgttgcacggcaactttgggagaagataccccaggagatgggttgtccgccgcgtcacattgggtatacattgtgggaaatataaagaccacgcgtgcccccgcggaagaggggtttggaactctaaagaaatgttgtgaacacactcttggagagaagttctcttgggaagaaagaatatggctgagcccacgccttggagaagaagttgaaatataaaaagagcttatactcgnagaatctcccgcccggggtttttctctgccccccacaggagatgtgtgtcacaaccctgaaagcgtctgtctgtgccaaaccttgagataaggagagaggtttaaaagcgcccccatatggagcgcccggttttatatgagaagaatcttttgtgagaggagagagttgagacaccacctgagtctctgccaccgaaaaatttcacaaagacccactatagagattgtagaaaaggaaaaggccttggtataaaaaagggtgtcacaggcacattctctatagccgagagtgtgaacacacacatggagcgccagaaacacatctgcccacgagaactgaaccggctcgccagatttcaccaaacatttgccctggccgagatgaggtgttacggaccagaaaaaagagctgtgctgcccctgaagaaatggcgcgcccacaccagctcttgccctttttggagacggaatttacccgaatttttcaacgggctgctgggggccactggccctttgcccaatttcctactctcaccctggttctccatgaaaaatagtgtcctttg

SEQ ID NO: 642000 - DNA, 891 bp, Homo sapiens
ccttagccaacagcaatttacccaaactaaagtataggcgagtagaaatagacaaccgtggcgcaatagatatagctaccgtcacagggcaaagatggaaaaattataaccaagcataatatagcaaggactaacccctataccttctgcataagtgaatgaagctagaaataacttgtggcgaaggagagccaaagcgtaatgacccccgaaaaccagacgatgctacctaagaacagctaaacagagccacacccgtctatgtagcaaaatagtgggaagatttataggtagaggcgacaaacctcaccgagcctggctgatagctggttgtccaagatagaatctgtagttcaactcttagatttgcccacagaaccctctaaatccccttgctaagatttgactgttagtccagaagaggaacagctcgtggggcacactaggaaaagaaccttgtcgagagagtaaaaaatttaacacccatagtaggcctagaagcagtcaccaattaagaaagcgttcatagctcaaggacccgactacctagaaaatcccaaacatataactgaagctcctcacacccaatgtggtcctactctatcaccctatgagaagaacgtaacggtagtataaggtaacactggagaaacattctccgcccgagataagcctgggtccagaattaaaacggtgaagctgacaaatacaggccaaggatctaacacacgagccacagggcctattaccccccggccacccacaacaaggctgccctcagggggggacacagggaaagaagctcgggacaaacccgcgggaacaaacagccgcgagacacgaaaaaggcccgcgagaaagagaggggcccacgagggaacaaccagaaga

SEQ ID NO: 642001 - DNA, 199 bp, Homo sapiens
ataggtttctatgtgcttaatttgtaaaagattatgttttgcatgaaggatacatattctcaatatagatatgaagttttaagagattagaaaaaaagaagggagtttgagtgtctaaatgcaatcatgattgcatttagacaacctacatgacatgtttatcttaaaaacaatgcctccactccaaataaatcacagt

SEQ ID NO: 642002 - DNA, 893 bp, Homo sapiens
ggccgtgtgtgcagcgcccggtccccagcaaccatggctatgggagcgtctggatctgtgtggcgcgacagcatatctctgtggatagattgtgtgcactctgtgtggcaggaaaatcatggttcccctgggtgcaagtcctgttgacatgggatgtcttccctgtaagcagacatggcagtgtgtgcgtctcaggtgtcctcagaggcctggatggtgcccgcgggatggcacggcgtgactagctctcatggagtcagactacatatggtctatgtagtatctcacaagtatatgcgcagggatttcatcatcgttatacttatatctggcattaagctagctcggagtatcatgtaccttagacattacagtgttcatcgtacgatgtattccaacaattgctaactgatcgtatgggtatactactcgttatataccaggttgattccaatttgatctagtaactgtgtgagacatgtttcctctgcgaggcatgttcctgtagcatactcgtatgcctactggactctggtagtagactgatgttggtagtgctaggtaagtctcggaatgtcgggaatctggggtgataatacgcgaagttgactgcaagctcgtgtactgaagatggttgccgtgggggtcccagcaaagtcttggcagttggctgtccggtgaaggtcctcgaggtttgcatcgtaccaccgggacgtttgattccttagttgatcaacagttgttctaacctgtggctttaccaagtttacgcttccccctctgtaactccatcggtgggcgaaagaagcctttaaaggcggccgtaactttcggacgacataggactgcatttttcgcgccgggatggccattggtatgcgttccttcggacg

SEQ ID NO: 642003 - DNA, 456 bp, Homo sapiens
  misc_feature (426)..(426): n is a, c, g, or t
gtttattaaaaaagtgttagagcaggaacgaaaggaaataaagtacacttggaggagggccaggtgggcatcttgagagagcaagtacacggttttgacctttgacttggggtttatatcttggcatgcttctgggggctgcgtcccttctcccctgattcttcccttggggtgggctgtccgcatgcgcagtggcctgccgacacttgggagggccgcgtgcacagtgtctttactggagttgtgcggtgccctcttgaggcagtcttcccttaccagttcctaggggaaggtcacacgctggttaaactttgccactttgcctcgtagtgtgcatgcttgacctcactcaccaactcctgagattttttttaaattttttaatttaaagttctaggggtacatgttacacaacgtgcaggtttnttaacataggtatggcatgttgccatgttg

SEQ ID NO: 642004 - DNA, 108 bp, Homo sapiens
cggcgcattgactcacaacctgaatgacaagccgtgtgaccaatgactggtggggttggagcacgtatctgttgctcaaggactacaagcccaaccagtcattcgctc

SEQ ID NO: 642005 - DNA, 1540 bp, Homo sapiens
  misc_feature (693)..(693): n is a, c, g, or t
  misc_feature (1540)..(1540): n is a, c, g, or t
gatgcccatacgagcattattgttgacagagctgcgttgaggctgcgtatgatggagcaactgaaactctcataccggatgcagctggacctggattatatccagggccatgtatgggcgctgtggtgcaatacatgttctagcatcgccagagtgcaacaccgggaagcatacgccttggcactaggtcccgtagtgtgcagtcgcctagcttgcgcgccagttggattgcagtcgacgttagttcgactaggcttgtgtcttgcggagggtggggacgtagactacgacactcgggtggattgactaacttgctcgtactatcagggcgtacagccggcacactgggaacaaccgcaaagtaaagatctctcaggatatctgcacaattacggaaggagcatagtgccttttctaagacctcttcccaacgtgtttatagggccaacgatttctaaatgttcgcaagaaaagcacaaggaccgaaggaagtggcaccagtatcgggcacactgaaatagactgctggcgtccagtacacatcgggggcgagagggtggaagcgattaaggttaccagaaaggcgcgcccttgtgtcttgcgcaactcctgtttgaagggtgcgagaatagattccatatcgctaggacataggccatggaatagacatcgggcttctgcacaacggcgtgnaccctaccattgtttcgacggctcttgttagaaggcaactggaatcgaactacaaggtaaggatttcgggcagggtgtgagcattagtcctaggtctggggcgctgatggaccaccagggtcctgagattggaaacaaatttcttacagagcgtcacaacctaggggagttcaggtcgaacttgggggtagacccaacaaaggatcccttgacattgcgatgggggcccttttgagtacctgaccccggggggcaatgaatgataggacgagtgaagacgggtttggccacatgacttggttaattttccccccggcgatttggaagacctttctaaaggtggccttcagagttgtgtggcgcccccaaaagttggttccacaggaatttgaaccggaatggaatggccccttcaacaaattcctatttctctttgcgggtggtcaacagaacacgaaaggtaatgcgcccgttcgaaggggggaaagggggcggtgtgtgaaaccccatgggccaagaaactccgtggtgacagggcgaaaaccctgttcccctctttggttcctcgcggattgattacccttccatccttggttttccgacaggtttacccctttccgcctttgggtaccaaaaccccgcaggttctggcacgacatttcaccccgcaagagggtgccccccagcgggggttccacaaagtggcgcgaggcgcggaggctgtctttccccttcttagcgcttctcccctttgtgtgtggaagacccccgaagggggcccacatggtggagttccgcacgtctccaaagtgggagtggtcctcttgaaggtctccgcctggttcan

SEQ ID NO: 642006 - DNA, 375 bp, Homo sapiens
tacaccaccaaatcgttaagcgctccttccttcttacctagcttccttcaccaaatacgcactaggctcctggaatacttatacctaatcttcaccacgaactgctagcttgctccgcttgctcctcagtcctagcttacatcaaacactggttcctggaatcctgtctgctgctgtcttcctagattcactagaatccacttctgtgtagcaactgggtcagctgtcaattaatgctagtcctcaggatttaaaaaataatcttaactcaaagtccaatgcaaaaacattaaagttggtaattactcttgatcttgaattacttccgttacgaaagtccttcacatttttcaaactaagctactctatttaagg

SEQ ID NO: 642007 - DNA, 288 bp, Homo sapiens
gaacatgccagctcccataccatctcccattcacccattgcagcccattccagggatccattctcgttctttaggaatttctggtgactacaacttctgcagtagtgacagagaggtcacaccagcaggatccaatagagcagttctcacaacctttgttgggtcaatgattcctttttccaccatattcacgaaatctccagccatagcatcataaccaactgtctgaggaactttgcattattttctcaactatcagagatccttcaagcacctgcattcttagca

SEQ ID NO: 642008 - DNA, 384 bp, Homo sapiens
ttggttcagggttggcccctgcccggctgcggaatgaaccacatcttgctttggtgacaaacacaggcccggctccaggctcctttagcgcccagttgggtggatgcctggtggcaactgcggtccacccaggagccccgaggccttttttgaaggacattgcggacaaccccggccaggccaaagggagtgacaaaggcagccccattttgcctgcccaggcccctgcccccctggggaaaaagtacttctttttttttatttttagacaaagtttcactgttgcccaggctggcgtgcagtggtgcgatttgggttccctgcaacctccgccttttgggttcaagcgatttttttgcttcagcctcccgagtagctggggct

SEQ ID NO: 642009 - DNA, 650 bp, Homo sapiens
  misc_feature (14)..(14): n is a, c, g, or t
  misc_feature (74)..(74): n is a, c, g, or t
  misc_feature (542)..(542): n is a, c, g, or t
tgtgaaggaagtanccgcatccataacaggatgtgatggtctacagctttccttaaaagctgaaaaggtaccanggtgctcgctaggcatataatccagatatgctccagagttctgagattcttccatgaaaggttaactagaagctagaatattcttttatattttggtaacaattggctttttttcatggggggaggggagtagagggttagtatttatagtcctaacaagtcccaaaaatttttataagtgtcttcagattataaataaccctccaaattttgcaatgtttacatgttttttttttaagatgacaaatatgcttgatttgctttttaaataaaagtttagctgttctaagagattaacttcaagtaggatggctggttatgatagtttggattttctacaggttctgttgccatgccttttgggtttcagcatcactcgagtcgcagcatgtgggtggggctgtggaaacctggccaggctggacctggtcagccacacctcagagacattgtttccatttggatgtngacaggcgcaggcctgcatgctctttcctacttagcatcatcagttcttccgcctccttagcatggttctttgtaacagccatgctgggaagctctgaacaataaaat

SEQ ID NO: 642010 - DNA, 242 bp, Homo sapiens
gccccctaaaggctaaatttagggggggggaattccaatgttttcccaagggggggtttttccaaaaggtttttgtttaaaaaacctggttgttaaatttccggtggttttggcaatgccccggtgatggggaaaaaattttcttgtttttcccaataaaaccctgggtttcccccggggggaaggggaatttggtaaaccttttttggatttaaagggccaaaaaaaacccccccctttta

SEQ ID NO: 642011 - DNA, 414 bp, Homo sapiens
gcggccgcctactactactaaattcgcggccgcgatcgacggagtctggagacgacgtgcagaaatgggacctcgaaagggaaaggagaagcaggaagaacaagacatcagcctcggacctcaagtggcatacagagagaatgtatttggtgtatacaatatctttgcaacgttcaatgacactaatgtccatgtcaatgatctttcaggcaagagaaccatctgccgtagtgactggtgggatgaaggtaaaggcataacgagatggatcctcaccagatgatgctatgatggctaccaaggatgtgacacaagaggtgcaggagctgggtatcaacggcgtaaacatcaagtacagggcagaggaggaaataggacgagacgcctggacctgaggagcagacggccatcaga

SEQ ID NO: 642012 - DNA, 726 bp, Homo sapiens
  misc_feature (585)..(585): n is a, c, g, or t
  misc_feature (630)..(630): n is a, c, g, or t
gagagagagagacagaaaacctgaaaaacacctcagtgaaaaccgtgagtaattttgtttacagccttagagtggagaaatattgcagaagtataaatttaaattattcaaaagtgaaaatatttacataacaaccattaactgaagatttaaaaaaggcaaatgatgagaaggacaaactatttgcaataggtgtaacaagcaaaaagtaacatctcaagcacataaagacccagcataaaagagcagaggccctgagcaggccattcacagatgaggaagtgacaggaccccccacggaacatccacggaagcaattcaacacggtgatgagatgccacccggctccacccagattagggtgcaaaaatgtaaacgcctgataaaagtcagtgttttcaagggtgtaggggaatgaatacgcttatatcctgtataaactggtgccatcctttaggagggccagttggcaggggtaaccaaaatgttaaatatgtgagcatttctctcttttcagaaatttcacttttaggaatctttttgacagaaatactctgatttggcacgaagacgtgtgtcgataancgcccaccttctgagctgcttgagaatatcaacgaggacatttgncaagaggacgtgtgaggagcaccagcttctgtgttgtggctgtgcttgcccataatcttgatacttgagcttgcaggcagaaattcttatctggaa

SEQ ID NO: 642013 - DNA, 628 bp, Homo sapiens
ttttcacaccagctcccgtcccccgcctacggtgggtgggatcgcgcggcagagacaaaggagatcagtagggccggacatagctgcgcagggaagtagggtgtcagttggggtggtgggcttttgcgggggctgtgggggggttatatttaaactcccagcagccgttaagttggttcgtagtctgatgctgcgcgcaaccagggtggtggcggagtgcgcatgcgtggttccggggcgaagggaacgcgcgctcaccgtgcgcgctcgcggccgggtggtagtggcggaggagaaaggggtcggcgcacgcgcggttgagtcctcgagtagttcgggtctcgcggggcctcgttgttttgggtctcgcggggctagtagggggcgcacctttgggcgggggagggcggctttgtggcctgcgaagacctagggccgtgaaccgaggcaggaggcttgctgcgcgcaactcgcggacacgggggcgtgaagggagcacgggtccaggcagggggggttaggccccctgatccccctcgttacccccgactgcacggaataaggggaggaaatgatcgagatggcggccggagaatggagccgtttctggtgccggccccgccgccgc

SEQ ID NO: 642014 - DNA, 255 bp, Homo sapiens
ttgttttggtgaatactcttggaaactgacagagttaatttgtagggtgtcagagtatttgtcttttgtgtgtgtgtgactgcttactcacagtatgaaaagcaatgaaggcctgttttttatgaagaacatattgtttaagctattcgggattaatattgattgcgtatccatgtgaagtcagacatagtactttgtgtaaccccctaccaaccacgtcgacgcggccgcgaatttagtagtagtaggggccgc

SEQ ID NO: 642015 - DNA, 110 bp, Homo sapiens
agaggcctcaccagagtgggtgtggacatggcggctcgagcagtacccagagtaggtgtggttagccggccagtctttaacggggggcgtgcattcaacacagctggaag

SEQ ID NO: 642016 - DNA, 942 bp, Homo sapiens
cggggggccgtcctgccggctccacgggcactttctagcttgtgcatgggctcggtttagtacagaattgccattaaacattcgctgctccaaagagaaaaaatggaccatgaaagaaataaagaggtcagctggctgggtgcctgtgaagaatgtcaaagagactcagctgttggcgtaagcgccagcataagaaggctgactgcacgggtcacaactggttgcactcaggagcttccgttggtttaatgacttggtaggagatgcacctccctcagtaggaacgttcctctgtcaaaggcaaacccgtggttttcgagctggcaaccaatgggtcgtcgctagtgagagtaccagggtcttcagctcacagggagtgcaaggcgtaggctctgaaagaattcccttcggccggggtgtttgacacatcacgatgagatatatagatatatatccatacatcttatttgtcacgaatttagactgaaaactacacattggcaaaatagcgtggatagattcgttctctttaactgggtgtgaaccaatcctgtttctcctatgctctgcgtgactacgaggctgatggtatactactgctttgcggaattgatagcaagtggcattacaagttataggtactatggtcggggtacattgagttccgaatacaataggacaggtcaatccaagactagttaacaaaaggttgtgggctaaagtatattaaggatatcgggagaatcaggtaggattgctggagatagtaagacaagtcaggtgccgattggtgggacacgttcaatacatctaagtctacacagtgaaacacgcagtgcttgtttgaagtttcaacagtacatatacgtagggttaaaaaataggtaagagtgtgagagatggagtgtgcatctacgtgcggaagagttttcaagcggacag

SEQ ID NO: 642017 - DNA, 678 bp, Homo sapiens
gaactttcaaagcagcaaaagaagtagagagagtagaataacaaatccccatgaattgataattactgaagtgggtgatgggctcatgggcatcttgttcaccccgtgcctgcttccctgcttcccctcattctgcagaggttcttttcttttgagacagagtgtggctctgttgcccaggctggcattgtgcagtggtgcgacttcggcgcactgcagcctccgcctcccgggttcaggtgattctcctggcttcggtcctctcgggtagcttgggattgacagatgcccgccaggcacacctggctaggattttcgtatttttgttagagatggggtttcgcctgtgttggccaggcgtggtctcgaactcctgatctcaagtgatccggcgccttggcctcccaaagtgctggtgattacaggtgtgaaccacggtgtcctggccactgtacaggtctatttataggaaggtggaggagtgaagggttgagagacaagccatggggcagatgcgggtctggaggatctggtgcctacaggcccgtctcttggctcccagacggcatgaggtagcaatgagggatccacctcttggtttggtggctcgtggatgacgtctctcacctggaaccagtacagagttggagtagcgcaggatcctgtcttcagaggagg

SEQ ID NO: 642018 - DNA, 867 bp, Homo sapiens
catgtccttccggtttttaagcctctaatgggagtcgcctcctttgggtcgcacgggaacctggtccttgaagtcgctccttttatatacgtctgtttcgccctctttattacggtttgtctcgtctagttaggctcttgttcaagcatcggtaagtgtgtttatccctatgcggcgcgacgtaggctgtggttttcaccctgcacttctgtctactccgcggtctccggggtcgggcctcctcgccggtgtccccccgggttgcaggccctcataccgccgttggtaccggtggacaacggctttaagaggcccttgtcaaggtcagctgttcttcatgttgcgacgatagtagtccccctccttcgtgctggcacggtcttttatgttgccttcgtccgcgcattcgccgcttagttaagtttatgcaccccctggataagcgttcacttcaggcttgccccccttgtgggcctcgtcccccttctccctcctctgctctttgagggcgcccctcgcccccctttacatccgcggttgttatcccccagatggccgctatctggatttcctcccatcacctcgtcttcactactcctcacccataataacccacacgtactcccctacttaaacttccacttttatagagcccccgtattttgtgtatacccgcacctcgatgaatcacgcgtcttcacccccaatttctatccagcagctaaaaacaagaaccagcaacctcttgtagaaaaatacccatatacacccccacccctccttctccacctccccacaccttgagaccccccctccccccttccctccctattccccctttgaaaaaaaaaacccaaaaacaaaaca

SEQ ID NO: 642019 - DNA, 142 bp, Homo sapiens
ctctgtcttgtctcccatctggtctggaactgtttgcaagtgaagcaatatctccgtattttttatatacaaccgctcttgtagcctatggtttagttgaatgtagagaaacacagattctttatacactttgtgagattta

SEQ ID NO: 642020 - DNA, 587 bp, Homo sapiens
  misc_feature (42)..(42): n is a, c, g, or t
  misc_feature (44)..(44): n is a, c, g, or t
  misc_feature (49)..(49): n is a, c, g, or t
  misc_feature (54)..(54): n is a, c, g, or t
  misc_feature (57)..(57): n is a, c, g, or t
  misc_feature (60)..(60): n is a, c, g, or t
  misc_feature (63)..(64): n is a, c, g, or t
  misc_feature (70)..(70): n is a, c, g, or t
  misc_feature (73)..(73): n is a, c, g, or t
  misc_feature (76)..(77): n is a, c, g, or t
  misc_feature (92)..(93): n is a, c, g, or t
  misc_feature (104)..(104): n is a, c, g, or t
  misc_feature (106)..(106): n is a, c, g, or t
  misc_feature (118)..(118): n is a, c, g, or t
  misc_feature (124)..(124): n is a, c, g, or t
  misc_feature (133)..(133): n is a, c, g, or t
  misc_feature (145)..(145): n is a, c, g, or t
  misc_feature (149)..(149): n is a, c, g, or t
  misc_feature (154)..(154): n is a, c, g, or t
  misc_feature (160)..(160): n is a, c, g, or t
  misc_feature (166)..(166): n is a, c, g, or t
  misc_feature (178)..(178): n is a, c, g, or t
  misc_feature (182)..(182): n is a, c, g, or t
  misc_feature (197)..(197): n is a, c, g, or t
  misc_feature (208)..(208): n is a, c, g, or t
  misc_feature (212)..(212): n is a, c, g, or t
  misc_feature (223)..(223): n is a, c, g, or t
  misc_feature (242)..(242): n is a, c, g, or t
  misc_feature (253)..(253): n is a, c, g, or t
  misc_feature (259)..(259): n is a, c, g, or t
  misc_feature (268)..(268): n is a, c, g, or t
  misc_feature (286)..(286): n is a, c, g, or t
  misc_feature (313)..(313): n is a, c, g, or t
  misc_feature (320)..(320): n is a, c, g, or t
  misc_feature (491)..(491): n is a, c, g, or t
  misc_feature (499)..(499): n is a, c, g, or t
gccatcaatgccattgtgcgcagccgcgtgggggtggccggnangcacncaganttntcnttnntgttcntcnggnnggcgtcacgggcaannacagtttgccnantcggcgcactcnatgcgnaagcagaangtggtacccacngtgntggcnttgggnagcgangtggacatggangtgntcaccacgttcagcntgggtgaccgngccnccgtgttccangagaaggattatgacagcntggcgcaaccnggtttnttcgaccgnttcatccggtggatttgntagcgccgccgcccgggccccgcagtngagggtngtgagcccaccccgtccatggtgttaagggggcccgggtcccacacggccagcaccgttgttcattgggacaaggccttgggcttgcacttttccagttcctcccagggggtcccggtagcccgggcccccgcccagccccaggtttccccaggccctccgcaggttgccnggcctccntccccctgcagccatcccaaggttcttgacctacctggcccctgagttttggagcaagccctgacccaataaaggttttgaacccata

SEQ ID NO: 642021 - DNA, 462 bp, Homo sapiens
cacgaggtggatctcctgggagcacaggaatgccgcagcaaatgccatggccatggggtctgcgacagcagcaggcactgccactgtgacgagggctgggcacctcctgattgcatgacccagctcagagcaaccagctccctgaccacaggcctgctcctcagcctcctgttgttattggtcctcgtactacttggtgccagctactggtaccgtgcccgcctgcatcagcggctctgccagctcaagggatccagctgccaatatagggcagcccaatccggtcctcctgagcgaccaggacctccacagagggcacagcagatgccaggcactaagcaagctaatgtcagctttccagtacccccctccaggccgctgccacctaaccccgtgcccaagaaactccaggctgagctggctgaccgatccaatccccccactcgccctctgcccgctgac

SEQ ID NO: 642022 - DNA, 510 bp, Homo sapiens
  misc_feature (509)..(509): n is a, c, g, or t
tgtgaaacagcctttgtcctaaaatgttgaggacaataaggtggaggctgcagacatggcaagaaaacactgggaaccaaaaatccggcttctgtctctgaagttgattggacgtgatgggcccaggcaagatttgcctggcacatcgttcctaaggaagcaggatcccaacaatggaactttccttctctgctgtcaacaaaggactaaaaaacttctgtgtgatttgatacagacaatttagaaaacttttgtttcaaagtttcccatccagactagccaaggagagcaagggaggggagctaataagcccattaaggtgtcttcccaaacaaatgttttctttgtccttctgcccaaatgcagaaacagctgcagctttaaaaaatagcatacttttatcttttgaaggaaatatgtgaaagttttagcactggttgtctttggttgggcaagaaattgtttagtgttatttatttcttcctatttttctgaattttccaaattgng

SEQ ID NO: 642023 - DNA, 130 bp, Homo sapiens
cggcactgaggatcccggagcatatagtctgaagtaaataagtggaactcacactctattcaaagtactataaaatgtagcatcacaagtgtgatactggctagataccacataatcattgacgaaggac

SEQ ID NO: 642024 - DNA, 978 bp, Homo sapiens
  misc_feature (26)..(26): n is a, c, g, or t
  misc_feature (28)..(29): n is a, c, g, or t
  misc_feature (32)..(32): n is a, c, g, or t
  misc_feature (39)..(42): n is a, c, g, or t
  misc_feature (44)..(45): n is a, c, g, or t
  misc_feature (55)..(55): n is a, c, g, or t
  misc_feature (82)..(82): n is a, c, g, or t
  misc_feature (186)..(186): n is a, c, g, or t
  misc_feature (265)..(265): n is a, c, g, or t
  misc_feature (601)..(602): n is a, c, g, or t
tcatggggttactggaagtgcgcagncnnctnagaggannnngnngaggagaggnggcgccttctcccgagccgagcactanggtttcagaggaagccgagtcccagcagcagtgggatacttcaaaaggagaacaagtttcccaaaacggtttgccagctgaacagggatctccacggatggcanaaacggtggacacaagcgaaatggtcaacggcgctacagaacaaaggacgagctctaaagagtccagccccatcccctncccgacctctgatcgtaagccaaaattgccttccaagcccaaatggccgccactttaccggccggaaccaagaagacaccttcggcccaaatggaaggcttcctcaatcggaaacacgagtgggaggcccacattatgaaagcctcaagcaggtcctggcacaaggttaatggggacataaataaccaagaaagggttttatacaaaggcgcaaagactgctgcttctggaattccctaccacagcgaggtccctgtgagtttgaaagaagctgtctgcgaagtggcccttgattacagaggaaacacgtattcaagctaagactaaatgatggcnntgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcagcagggagtccagtcccggctagcgggaaaaggacaaagagaaagacaaagagaagcgggtcgacctttggggcaaaaagaaatgagctccggtcattaacctcctgcccttgttttacccactccccccaaaatccgcaagcaaagctcagaaccaacacattaaaccacatggaggaacatcaggcaacagagagtaatgtgtttggtttgaa

SEQ ID NO: 642025 - DNA, 267 bp, Homo sapiens
cggtgtataaagaaaagaagtctgatactgcaattgagacacccagaagctgcatttggcatacgtcctataaaataatgagtctactgtggtgaattgaattcagctagaaagtggtgacacactttgcatacttgaacaatacatgtgaacagaaattataacttattaatgaggttttacagcagtcacacttgacttggaaagtattaaacaaattaaacttgtggactttggtcattcgactcagtccttacgctgccttga

SEQ ID NO: 642026 - DNA, 374 bp, Homo sapiens
  misc_feature (26)..(26): n is a, c, g, or t
  misc_feature (28)..(29): n is a, c, g, or t
  misc_feature (32)..(32): n is a, c, g, or t
  misc_feature (39)..(42): n is a, c, g, or t
  misc_feature (44)..(45): n is a, c, g, or t
  misc_feature (55)..(55): n is a, c, g, or t
  misc_feature (82)..(82): n is a, c, g, or t
  misc_feature (186)..(186): n is a, c, g, or t
  misc_feature (265)..(265): n is a, c, g, or t
tcatggggttactggaagtgcgcagncnnctnagaggannnngnngaggagaggnggcgccttctcccgagccgagcactanggtttcagaggaagccgagtcccagcagcagtgggatacttcaaaaggagaacaagtttcccaaaacggtttgccagctgaacagggatctccacggatggcanaaacggtggacacaagcgaaatggtcaacggcgctacagaacaaaggacgagctctaaagagtccagccccatcccctncccgacctctgatcgtaagccagactgcctcccagccagagtgcgcacttacagcagaccggagcactggccagtggaggttctcatggaacaggtggagccacataga

SEQ ID NO: 642027 - DNA, 545 bp, Homo sapiens
catattagtactatttctccggagaaccacatttcttatacaaatgtatcagactttctttaggatgtctgggcattcctagtaggaattctcctggtgaaaagatcaactctactgaaatgaagcctccttagtattccaaagtacagattacattccagctgcatagttgaaatcgccgcggaacatggttttaatataacatatttggatatagatgaactgagcgcgaatggacaatatcaatgtcttgctagaactgaccaccagccccatcacagtctgtcatggctctcgtttctgttgtagaaatgcacaaatgtgatgcagctcacaatgctttgcagtattaaaagataatagcagaaagcacagtagatctggagcaacttaaaaaatctttcagtagcacataaaaagttcccctctggccccttcccaagtaaaacttttaccgtagtgtttatgtcttgtttctaaatctcttcatagattccatcaacactccagattaattatctcctcatagttgttattaagctctt

SEQ ID NO: 642028 - DNA, 637 bp, Homo sapiens
  misc_feature (116)..(116): n is a, c, g, or t
gggcacacacctgtaatcccagctacttgggaggctaaggcacaggagaattgcttgaacccaggaggtggaggttgcagtgagcccaagatcagtgccgcctagcattccagccntgggctgactaagagctgagacctctcatctctaaagaaaaaaaccaaaacaaacactctcggaaggaattctatattggtcggcgaggttgcagtgatcatatgggggtctttgttattttggccctctgggtcattccggtggttccctgttggcgccccagttttggcgtttggtccgcgccatgggtggtcgcatatcttgcgcttgcggctctccccttgatgtatctcgggggggtcgctcgtttttctcccctcattctcggcctcgcattttggttgcgccgcgaggtgggcttatacgtccccttcggcgactatatcacgcgtagagcgcccccgtggcccccaattctgtccgctgcgctttgaccttccgcctcctgcgctcgtttgcccgcggccggccgcctcgctgtcccgctggtcctcgatcgttcgtccccctctcctcgcgtgggctcttccttcgccactctgcgtcgcctgctccacggtggccctcgctgcgtcccccc

SEQ ID NO: 642029 - DNA, 208 bp, Homo sapiens
tctacctactaagctcccccaatatcttctattgctcggtctggctatgcaccggcaggtaatcatcttttctctcttctctaggtgcctaaacttctgcagaggggcggctctacacttaatactacggcttcctaggactactactattataatcagatacgggttcaggatcaggtagagagccgggcaaggggtaccgagctcg

SEQ ID NO: 642030 - DNA, 818 bp, Homo sapiens
gtatcaacgcagagtggccattatggcggggggggttaaaaaaaaaaaaaaaaaaaaaaaaaaaaaatttgtgggcggcctgggcctggaaaaagtttttaaaaccatcgttgggggcggggccccagaggataagtagagcaggggactaaacgagggtgcccagaggaaaggcgccgggggcataacataagggctgggttccctcaacaaaaataaaaaagcggccgggggggacacccggggtggtgcttggaacagatctcgcaggatggggagtccggggagggggccgatacggggatcggcatcccaccggggaggtcaaagggaagcatccattagatcaaaattcaccccccgcccgggtgggatggaacacccaccgtacaaaacgatcgccgactcccatagacaccaattcaccgacaaccggattgcaattgaaagcccacacgataagaacgctagaacaaactacataacaggcgtcaacacaaaaatggacaaaccaatacagtcccagagttcaccacagcgaacagacaaataattgtaattcgatacattacgaaaccggggagccaggccagcgaaacaacggcatagtgcgacgacaaccatggtccaccgatacggccataccaccccaacgccccagatgagtaatcactacggctaaacacggaacaacgaaccaaacacgccacgacggaagcaaatcccgccacgcgaaaggagaggaaacacaacaaaaacccgaacactcggctccgcaaccattacgagctggcaactgaccacagcaaaacagacaa

SEQ ID NO: 642031 - DNA, 417 bp, Homo sapiens
cgtcatcgctcgtccgggcgccaaggacttcaactacgtcccttcacacagatggaggtggcatgaacagaacagctgaactgcagtatcgctcgccggtgcaccagtcgcatcagtcgccaacatccgtgccgcgctcaccgttcgacgccgcaccagaaagtcgccttcattagcgcactggagagggcagattcgccacatctgggtacaagagaggacattggtcaaggcaaagtcaacggtcaactaaagggtcagtatgggactccttctggaacgcctagcagacacaccagtgttaagaaggtgaccggagtgggcggaaccacatatgagatctccgtgtgactgacagctcggggagccaatgcctgtgaggaacagcactgccatggcaaacccaactcgtgctca

SEQ ID NO: 642032 - DNA, 114 bp, Homo sapiens
ggcttctggggcccctcaccgcccctctccgggctccaggcgtgttcctgcctcagggcttccctgatagcgtcagcgcggactacttgccctaccagctgtggtattccgtgc

SEQ ID NO: 642033 - DNA, 301 bp, Homo sapiens
ctaaaaatttgctttttcattttgtgcacttgccaagttggaaatgtcatcaagtttcatcaagattgaaatggggtccaatttgctaaaaatgcctcatgcataaggaagttttgtgctctcttccacatgggagtcagcctgcacaatacattatgcacctcgtgctggaaagatctcgacatgccactcaaatactgaaacggagggagcagtcacgcttcagggtctttgcactttcagagggaggggcccctagccctcaaatattcaattcccaaataaaaccgttctatgtaaa

SEQ ID NO: 642034 - DNA, 231 bp, Homo sapiens
ctcccgacggggtggtcgaggcctgcgctaccatggcatccagatctgggagctgacaggctggagagaacccttcttgtctggtacctctcagccctttctggaatcccctagtgcggactccagtccttctctggggtccaggagtccagactcccagtgccctcctccctcagtcccaggcaggacccaggagcctggctcccagcccaaccaccccgtcgggtggag

SEQ ID NO: 642035 - DNA, 164 bp, Homo sapiens
cctagtaatcgagccggtacctcgcgacgtgtatccctgccttttatggtttctcggttagttgttccctcatttctcaacttagtcctcaagacttctgaaacgtctgtgtgccaggcacttggtgtgcctgataataccaaaagggataacacgttcgcgag

SEQ ID NO: 642036 - DNA, 150 bp, Homo sapiens
acatctgtgggatcttaccttctgtatagagtttcagagaggtcataatccagaaaacttatcatgttttcttttattccttttggagaatatctgttcagactcaggtcatgtgtttccccattctccacccccattagctgttagctt

SEQ ID NO: 642037 - DNA, 803 bp, Homo sapiens
  misc_feature (159)..(159): n is a, c, g, or t
  misc_feature (350)..(350): n is a, c, g, or t
  misc_feature (360)..(360): n is a, c, g, or t
  misc_feature (370)..(371): n is a, c, g, or t
  misc_feature (408)..(408): n is a, c, g, or t
  misc_feature (416)..(416): n is a, c, g, or t
  misc_feature (428)..(428): n is a, c, g, or t
  misc_feature (460)..(460): n is a, c, g, or t
  misc_feature (494)..(494): n is a, c, g, or t
tcttccagcttccagcatagttctatgcttagcaaaacacttgcttgtattaaatgcttgctttgcattttagccaagaactttaccctcattttacctgtgtagagatcatcctttgaagaagccaagaagaagaatttactcaaggataaatgattntcattcttttcctcttatggcatttgatgtaatttagaagttttcaagtcatagttaaactgctttttggttactcatgctctagtaccctactactaaagtaggatttgtgggtaaaaaaatcaaatcagttaggacagtgctgaacattatattctacacaactcttccaaaggattcacagtgtactntagcatgtanaatgcctaannggatatttagtgatgaatccctattaaattaactaantacatgtnttcaagcactanattttgtcagatacacttattacagacatggnataatttaaaactgtctcagccttaattagactnctactgcttagctatgatctgatagtaagtggataacccaaaaaaaaaaaaaaaaaactgagggggccgtaccaatgccttagggcgatacaatatggcgggttaaactcgactgaaacctgcgtaccaatatgctgagacaccctttcaattggaaacaaagccccccaagcttcaattcgacgatcaaggcattacgcaattttaaacctaaatgtgaaaccttttaccagccagtgaacctttaacggcccacaaccacattttggggggaataaccccagacctttgtttagatgcgtggagaag

SEQ ID NO: 642038 - DNA, 414 bp, Homo sapiens
ggtgtacttatgacttgatgattctagtgcttaccatgcactagcttatttgtctttatgacagttctattttagttctgattgtgaagatgaaaaaacaaacacacatcaagtttaactgtacagatgaactggcggcatcaatcagcgggccagagccagaatcaaacctcagcagctaggttggcacactcagtgactgaataaccttgggcaacgttacttgacctttctgtgcctcagttttcttaccctgttaggtagggatgatattaataactacctcgtagagtttctgtgaagacgtaatcgagatatgtaacatgtttgaattagtgcctcgctaggcaggtaggtcctctgtgtattatagactaaagctgcctccatcttctaaagataagttgaaaaatg

SEQ ID NO: 642039 - DNA, 361 bp, Homo sapiens
  misc_feature (10)..(10): n is a, c, g, or t
  misc_feature (31)..(31): n is a, c, g, or t
  misc_feature (67)..(67): n is a, c, g, or t
  misc_feature (92)..(92): n is a, c, g, or t
  misc_feature (203)..(203): n is a, c, g, or t
  misc_feature (299)..(299): n is a, c, g, or t
gaagttcaangagctccttttttaaaaaatnttttgaagttcaatgagctcctttatttattcattncttattatactttaagttctagggnacatgtgcacaatgtgtggtctcggtacataggtatacatgtgccatgctggcccgctgcacccatcaactcggcatttacattagggattgtctcccagtgctatcccgnccccatccctcaccccatgacaggccccagtgtatgatgttccccacccggtctccaagtgttctcattggttcaatttccacctatgagtgaggnacatgcggtgtttggtttttctgtccctgtggatagtctacttaggagtgatggggaaccta

SEQ ID NO: 642040 - DNA, 129 bp, Homo sapiens
tcgagctcggtaccgggtgggagtacggaatattagtgtaggtcgcattgatatacaactttaaataacattctcataatgggtttaacacaatcaaccaggggctaaggtttaaaggtttacaaagag

SEQ ID NO: 642041 - DNA, 618 bp, Homo sapiens
cgcatagaggattctcagcactctgttcagcatgaggtctcagcttgaggtccggtacacacgttcttctccgagtgcaggtagtccagtgctgacacaatctcaggccatagaagcgggccggtcctcgggagaacaaacgttcccggggacaggtggaagaacagctcgcccccgttggcgtactccatgacaaagcagaggcggtcgtgggtctggaaagagtacttcagggctgtgaggaaggggtgcctggagttctgcaggacgcggttctcggtgagtgtgtgggccacctcgtccttggccacgatgacttacttcttgaggatcttcatggcgtagtagcggcctgtggccttctccttcaccaggatcaccttgccgaaagtagccttgcacagcagcttcaggtactcaaactcgttcatggtcacgcggtgcttgggcttgtgcaggggacactccatctcttcaggccctgagttgcactgggtgagccgaccggaagtcatctcctcctcctccgcttcttgatgcgtcagccacagtctggatggtggttgtccactctccgctctcaggagtctcccaaggtgtgcgtggtggtccgagtcg

SEQ ID NO: 642042 - DNA, 254 bp, Homo sapiens
cttcttctttctacaatattatgtactctactgatatctaaatatatgatattctgcccttcctgctaatgcacacactataggaggtattagtgctctggggcacgaagatgatttttggctcatatactttacacacacccacacatctgggagcatatactctattacacaatgacacattgtcacaaatattatatataagaggcgctcagcagttatgaggtgatgcatcagctcactagtaggagact

SEQ ID NO: 642043 - DNA, 336 bp, Homo sapiens
atgaatgccagggacagtgtgctcagtaaagtcttccatccaaaaggggcagggcacggtggctcacgcctgtaatcccagcactttgggaggccaaggtgggcggatcacctgatgtcaggggttcgagaccagcctggccaacatggtgaaaccctgttgctactaaaaatacaaaaattggctgggtgtggtgtcacatgccagtaaccccagctactagggaggctgaggcaggagaatcacttgaacccgggaggcagaggttgcagtgagctgagattgcaccactacactccagcctggatgacagagtgagacttcatctcaaaaaaa

SEQ ID NO: 642044 - DNA, 747 bp, Homo sapiens
cttctcgggcaaccagcctccacctcccgggttcaagcgattcttctgcttcagccttctcctgcgcagctgggattacaagtgcgcaccatcatgcctggctaattcttgtatttttaatagagacggggtttctccatgttggccaggctcgtctcaaactcctgacctcaggtgatctgcccacctcggcctcccgaatctctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagagaaatgtcagtaacatggcattagaaataaatatagctgataaacagattaaaggttatgaatatataccaagaataattattctgcttatgcaatcgtaatttcggaaaaccattttgaaaagctcgctacatgaactggtgtttgtaaaagaatttcatatcggaaaatagcgggaatatataattgttaagtgttgtcaatgcaatgggagcaatggtgtgatcaatagatgtgtttgaaaaggacaacaaaaagaaagtggtcctcggtggcctcacctgaggaaccctgcggacgcttcacctataggaggggaaaatgatgacgctcgggcactgacagactgcgctccgaatagtccagtgagg

SEQ ID NO: 642045 - DNA, 88 bp, Homo sapiens
tctcccctcccccccttcaccatttcccctcggaggcgcttccccggggcggggagagccggtctcacccgggatctcacgggagacg

SEQ ID NO: 642046 - DNA, 251 bp, Homo sapiens
gtactctacagtgatcttataaggcgagtcgggtacttcacacggataacgagggcctcatacagcttcgaggaggagcgggcccagctgtccttcaacactgacacgctctgctgaccacccagagctgggccagtggaggacacgctccactgaccatccagagctgagccagggactcaacaatggggacagaagtcccctcagtgcctgccagggcccgtgcagtggatggttcgtgaccaaggggc

SEQ ID NO: 642047 - DNA, 422 bp, Homo sapiens
  misc_feature (1)..(1): n is a, c, g, or t
  misc_feature (13)..(13): n is a, c, g, or t
  misc_feature (120)..(120): n is a, c, g, or t
  misc_feature (150)..(150): n is a, c, g, or t
  misc_feature (206)..(206): n is a, c, g, or t
  misc_feature (295)..(295): n is a, c, g, or t
  misc_feature (333)..(333): n is a, c, g, or t
  misc_feature (337)..(337): n is a, c, g, or t
  misc_feature (420)..(420): n is a, c, g, or t
nagacgtcacagngggcgagcggcaggtgatgaaccgctgtttggtccggtactcaatatcaaggtatttgattaccaactggatattcctgatgttcaggcgcaaacccataccctggnaaccggtccggttaatgaccttgaactggncctgttcccggatgtacacggggatttgagtattgagatcctcgccaataaacagngttacgatgagccaacgttaatccagcatgctgaacgcctgaaaatgctgattggccagttcgccgcggatccggcgctgttgtgcggngatgtcgatattatgctgccaggtgagtattgcgcagntggngcaggtcaacgccactcaggttggagattccagaaaccacgcttagcgcgcttggtgggaagacaaagcgggaaaaacaaccngg

SEQ ID NO: 642048 - DNA, 235 bp, Homo sapiens
cgatgtgccaaagacccatctacatgcagaaggacaggagaccccgtagcctattacctgaaagctgcaagcagttcagcttatatgcaacctgggaggagaacaacgaagcagccagccacgacctgcgttacaccaatacagtgcgcactgagcgtgctagacaaagcagtgccacaccaatgagagccagcagcttgtatggacccaacaggggtacccgagctcgcaattc

SEQ ID NO: 642049 - DNA, 235 bp, Homo sapiens
gttttccccatttttttcccccccaggggtttggggggggtttttaattttgccccccccctttttccccctttttttggggcaaaaacccggggttttttttaaaacgggggtttgggggggggggcccccctttcccccccccccgggggggaagggggaggggggggcccggggaccccccggttttccccccctttttttttaaaccaataaaaaaccccttggttgggga

SEQ ID NO: 642050 - DNA, 921 bp, Homo sapiens
  misc_feature (106)..(106): n is a, c, g, or t
  misc_feature (155)..(156): n is a, c, g, or t
  misc_feature (167)..(167): n is a, c, g, or t
  misc_feature (200)..(200): n is a, c, g, or t
  misc_feature (209)..(209): n is a, c, g, or t
  misc_feature (327)..(327): n is a, c, g, or t
  misc_feature (351)..(351): n is a, c, g, or t
  misc_feature (378)..(378): n is a, c, g, or t
  misc_feature (392)..(392): n is a, c, g, or t
  misc_feature (418)..(418): n is a, c, g, or t
  misc_feature (420)..(420): n is a, c, g, or t
  misc_feature (497)..(497): n is a, c, g, or t
  misc_feature (527)..(527): n is a, c, g, or t
  misc_feature (587)..(587): n is a, c, g, or t
  misc_feature (652)..(652): n is a, c, g, or t
ggggggggaaaaaagaaaactacggctaggtacgaggcctgggtttgacgctcaagatggctgctccatagtgcgggcgggatgctcctggcgcggtaaaagatanctgctttcttcaggctatgtagacagccacaaatgggaagcaagagaannaagaacattantgtcttgctgatcttgcatctttaatggataanacatttganagaaagttgcctgttagttctttaacaatatcacggcttatagacaacatttcctctcgggaagagatagatcatgcagagtattacctttacaagtttcgacacagccccaactgcntggtacctgagaaactggactatnccacaccgtggattaggcaggtctaanaatatgatgcacanagacaaagccctatatacccgttgtnanataaggttcaatatggaatttttccagataactttacattcaatttactgatggattctttcataaagaaagaaaanttacaagagatgctttatctgtggtgtctngaggtcatgatgcaagaagcctttgaagtgccttccacccaacttctctccctctatgtnttatttcattgcctggcaaagaagacagacttcagttgggaagaggagaggaactttggtgcatnccctttgtgcttccaggcctaaaacaaaagaactcagtgggtttcagttcccagttgtatggctatgcacttcgttgggaaggtggagttgcaggaagggctacgggctgtgtgaacagaacatgctctgatatggaaaccaggtacttgaagagcccttcaagtgatggaggaaagtgtgtgctcaccagaagacataagctgtgtagagaagggctcgatgtgatgggtgcgaggtgaaggtgctgacttcagtgatggagctcaag

SEQ ID NO: 642051 - DNA, 952 bp, Homo sapiens
  misc_feature (137)..(137): n is a, c, g, or t
  misc_feature (186)..(187): n is a, c, g, or t
  misc_feature (198)..(198): n is a, c, g, or t
  misc_feature (231)..(231): n is a, c, g, or t
  misc_feature (240)..(240): n is a, c, g, or t
  misc_feature (358)..(358): n is a, c, g, or t
  misc_feature (382)..(382): n is a, c, g, or t
  misc_feature (409)..(409): n is a, c, g, or t
  misc_feature (423)..(423): n is a, c, g, or t
  misc_feature (449)..(449): n is a, c, g, or t
  misc_feature (451)..(451): n is a, c, g, or t
  misc_feature (528)..(528): n is a, c, g, or t
  misc_feature (558)..(558): n is a, c, g, or t
  misc_feature (618)..(618): n is a, c, g, or t
  misc_feature (683)..(683): n is a, c, g, or t
ggggggggaaaaaagaaaactacggctaggtacgaggcctgggtttgacgctcaagatggctgctccatagtgcgggcgggatgctcctggcgcggaagtggttcttcctcagctctctcctgcaggtaaaagatanctgctttcttcaggctatgtagacagccacaaatgggaagcaagagaannaagaacattantgtcttgctgatcttgcatctttaatggataanacatttganagaaagttgcctgttagttctttaacaatatcacggcttatagacaacatttcctctcgggaagagatagatcatgcagagtattacctttacaagtttcgacacagccccaactgcntggtacctgagaaactggactatnccacaccgtggattaggcaggtctaanaatatgatgcacanagacaaagccctatatacccgttgtnanataaggttcaatatggaatttttccagataactttacattcaatttactgatggattctttcataaagaaagaaaanttacaagagatgctttatctgtggtgtctngaggtcatgatgcaagaagcctttgaagtgccttccacccaacttctctccctctatgtnttatttcattgcctggcaaagaagacagacttcagttgggaagaggagaggaactttggtgcatnccctttgtgcttccaggcctaaaacaaaagaactcagtgggtttcagttcccagttgtatggctatgcacttcgttgggaaggtggagttgcaggaagggctacgggctgtgtgaacagaacatgctctgatatggaaaccaggtacttgaagagcccttcaagtgatggaggaaagtgtgtgctcaccagaagacataagctgtgtagagaagggctcgatgtgatgggtgcgaggtgaaggtgctgacttcagtgatggagctcaag

SEQ ID NO: 642052 - DNA, 566 bp, Homo sapiens
  misc_feature (11)..(11): n is a, c, g, or t
acgatccttantcatcccccttcgtcagagagcctctagtaggcagcgtgaggggaaatgtggggttaaaggccccacgcagagtccctactggggcactgcctagtggagctgtgagaagagggctactgttctccagaatggtagagccactggcagcttgtaccctgcacttggaaaagccacagacactcaacccagcctgtgacagcaggctgaactctgcaaagctataggagcagagctgcccaaggccttgggagcccaaccctcatatcagcgtgccacatggaaaccaaggagatcattgtggagtttcatgatttaatgactgccatgctgggttttgaacttgcatggggcctatagcccccttttttggcaggtttttccctaatgggaatatttccccaatccctgaaccctgattgtatgttggaagtaaataatttgttttttattttataggctcataggtggcagggatttgccttgtctcagatgagactttggattcctgagttaatgctggaatgagttaagactttgcggcactgttgggaagg

SEQ ID NO: 642053 - DNA, 1266 bp, Homo sapiens
tagtcacgggttagctttactacggcctgaaagtgcacacaactggtgggcgcctccatttcccgtgcgaagtttttccaaaggaacagtagcgcggcccgacggcgcatttcaatgtgacatgacaacctacgtccgaactgtcactttttgcgcggctaaccaggagatcttgttgctcaacaaagggagggtcacccccctttgctcccaaagaccttccgttttgaccaaagccacttgttggggcccgaggtctttctatccccattgtggggggcccctgggttcgcaaagacctgcgcttcgtggtctgaactgacattattgaaacgcacgggttctaaagaaacccgttcggaccggtagtttatcttacccccgggaggttacaaatgcgtgcgtacgtcttcgaaggaaggtgccatcgcgttaagcaaaacccccttgggaggagcacatgaccagtcttgggatcgaccacggaattgtcctttatgtagggcatcggacgaggctataaatgtcctgctgaaacaaattatggcacttgtccgtggaacccgagtctcgccactgtctgcggtgttcatttcatcatggcccatctcagtgtagagcgtcaacagaggagtcagcgtgagtgatctggcaatacaatctcgttgagggaatcggcggcgaaactggtgatctgtcaccaaggcgactcgacctgcgtccaagaagatcgtgacaacttaaatccctattcttttcagcgtcccggcccaaaggactgctcaatcagcactcatgatgtgtatgctctcgtgtgtgttgtgcgcgtatgtagtgcgctgtgtgtgttatagttaggtccatgtgtacaagcctgtggctctacctgcctgtcacggaggtgtagtacagctgtcctagcgtgctgcaccagttctcctgaccctgcttagagactgttcttaggcactgcaaagggcgtactgggcacacccccccgctacgcaaggataggacgaagaccccctccagagcaataggaggccccctcagccctagtggttacgagccgctgatgtatctaagaagcatgtcactttcatgttcctccctgaactccctgacctgagaagcctggggccttggggggcagttattgagcctcctctcccttctgtgggtcgctcacagagccatggcccatgggaaggacagagtggtgtgtgttcttggggcctggataaatccttgcggctcagctccctc

SEQ ID NO: 642054 - DNA, 281 bp, Homo sapiens
ctgccagactcgggtccctctctcggttgggagcccactcccttggtctcggtaccgagggagctacctcctggcctaattaaattatccactccttaaaactactccacataagtccaggtggttttatctaaaccagcatgaggacaaagaagccggagtgatcttccactccaggaggaatcaaatcaccatctacaggggaagctgaggcaggaggatcatccgagcccaggaggctgaggtcgcagagaaccaagatcatgccaccacactccagc

SEQ ID NO: 642055 - DNA, 423 bp, Homo sapiens
attcggcacgaggacaatcaaatacttaagttcttgaagagctgggtggtgggcgggggtcttcccaggtggtcagggagatgtgttagtgtagcacttggaagagagtggaacgaccaggcaaggatgtgccgtggaggtgggcagtgggagcagcccagtgtcagcatctgtattggttagaagaccaccgctaatgaggaggagcgtctctaccctgcagctgtctgtactcctgtgtcttccgtaatgtgccaagctctctgaatatatgcaaaactagtctgcaaaaagccatatgtctcagcatctggctttatttctaagtgttcaggtggaatttaagccgcgatcaaatttacaatgtcactgccagctctggacacttacttttggaataaagcaaagagtgaacactaaaaa

SEQ ID NO: 642056 - DNA, 854 bp, Homo sapiens
  misc_feature (460)..(460): n is a, c, g, or t
  misc_feature (560)..(560): n is a, c, g, or t
gctgcttgtaggagtacccgccaacaagcgggaccgagcaggaatccgtatctgggattcagaatgaagcggagactcagcaattcgagatgtttatgcgcacatgaaaagcaggatttcgtgtcagtacttctcccagatcgttatgggtgctgactgaggatgagatggggcagcccagagatacggagatgctattgcccgggtcaaggaggtcctggagtacaatgtcatttggacggcgagtataagccggggttgacggtggtagtagcattccgggagctggtggagccaacggaaacaaggatgctgagtagtgcgtccagcgggcctggagctgtgggctgtctgtgtggagagctgctgctaagcttgactgtccatggtggtacgatgacatcatggcattcactcctcttaaccggcgtggcgagcagatggtggctggctaatcagnaaggccggggcgtggggtgttggatgccattcaatggatgactaaggcgtcgcaggtaagctagggtagtctagggcggctcgctgaagactcgtactgncacgggcagctaggacctagttacacgtgtaatgcgtgaatcggaggctgtcgttctctgcaagacgttccctaataagacgtgcagatgtgggagcaagagcccctgaggaccgtctctcaacagttcccccgcagggacacaatcgtcggagtctatggtcatgcattgcacttgaagagcgagggtgcagaatcgtatgagtgccagtacaaggataagcttgtctaatccttttacccttcgtatagctgcagggaatggacagtggcatgaattcgatggcgagaaggg

SEQ ID NO: 642057 - DNA, 582 bp, Homo sapiens
  misc_feature (526)..(526): n is a, c, g, or t
  misc_feature (537)..(537): n is a, c, g, or t
tcctgcatctctttgactctctgaagcccccatcccaggttgagttgatcttctacatcttgtctttctgcaagagcgcaacagttccctttgcatctgtcagtcttatcccatactgcctagcccaggatcctgggacagacacacaagaagtctttgtaaggcatgcagagtctttggtatttaaagtcaaccgccatgcaaaggactaggaacaactaaagcctctgaaacccattgtgaggccagaggtgttgacatcggccctggtaagcctgtctttctttgctatcttaaccaaaaggtgaatttttacaaagcttacagggctgtttgaggaaagtgtgaatgctggaaactgagtcattctggatggttccctgaagattcgcttaccagcctcctgtcggatacagaagagcaagcccaggctagagatccaactgagaatgctcttgcggtgcagaatcttccggctgggaaaaaggaaagagcaccatgcatttgccaggaagagaagaagatnaggagaagganagtgtttatgtatcgagcaaaccagatgcaatctatgtctaccgg

SEQ ID NO: 642058 - DNA, 212 bp, Homo sapiens
tacaggtctacgtactaacgtgtagagccactggtgctgttctcactaagattccatattctgctgtgagtctccagacccgtgatgcgtcggagatcactaacagtgcttccaggcacagagtaaaacttcagattcatggccccgcaacacaagagctttattaggagggatttcaacatccccaatccacttccaatcatatcgagggg

SEQ ID NO: 642059 - DNA, 116 bp, Homo sapiens
ggccccgcatgcaccttttcttcaccttcatcctcatccctcttcgtcaatatcttctaatccttcctcctcttcatcatcatcatcatcttcttctccttctccttcttcatcat

SEQ ID NO: 642060 - DNA, 283 bp, Homo sapiens
gctcgacatttagcagagtggccacgtacccacctgaaactttaaaagtaagagtgggggccgggcgcggtggctcactcctgtaatcccagcactttgggaggccaaggcgggcagatcacctgaggttgggagtttgagaccagcctgaccaacatggagaaaccccatctctactaaaaatacaaaattagccgggtgtggtggtgcatgcctgtaatcccagctactcaggaggctgagtcaggagaatcacttgaacccaggaggcagatgttgtggt

SEQ ID NO: 642061 - DNA, 1050 bp, Homo sapiens
agcggcctgcgtcatggctcaaggattcaatgcatattttaaagaatttattattaaatcagttattgtgtacagatatgtgtctagcaaagccacacaaggagccctacaccttatacccacagtactctaccactgggagtatttttatatcataccactagaccaaagaactcctgaggtcactatatatgagactaccacgaagtccattgacgtctaaaatccccagtacagtatagtaatatacaagagacacaaccccatgagtcccaactaggactcttaacgcccacctatacagagagagacaaacatactaaaaaagagaaccttgcacaccatagagcacccccattgtcacagacaccttgattagccccacatatagcccttgacgtgagtccccaaagatgtgaacttaagtagactataagtggcccatggacccaaggacaattgacaaacaccccctatgtaatacattgtgggactgacagctaatggcatgacacagtggtgacgaccccaatccaatgaataggcacaatggaaacctattgatgacaccacaaaaagagtgcaaaaggtacaaaaaagtttatgggagcactgagtcattaaaatacagttagaagactaaaggagaaaaagtgtagccaccaccaatacattaataaccacatagggagacccatttcacccgaatgaactggaaatatgcagaaaaggaaatgcaaacgtagtccaactccaaattccatatccgaccacgaaaacaaaagctgagaacagtatccacacttttgcagggcaaaagacccccaaaagaaacgcacacaaaaacacccaacagaaaaaaaaacccaaataagaaaaaggaaaccaaattgtgacgacaacaaaagagcaaatcgagagggaggaagactacacaccgcgaagaagcaaacagcaacgagcaccaaaaacaaagggacaaaagatatcaccaccaacaccaaccagaagacagccacaaaaaaacaaacgaaacagagagagtagagg

SEQ ID NO: 642062 - DNA, 383 bp, Homo sapiens
  misc_feature (36)..(37): n is a, c, g, or t
tgttgcccaggccgagatcgcaccactacactccanngcctgtgcgaaggggagcaagactccctctcaaaaaaacaaaaaaacaaaaaacaaaaaaacacaacccaggcgcagtggctcactcctgtaatgccagtactttgggagctgacgcgagtgaactgcttgagcccaggagttcaagaccagcctgggcaacatactgagatctcatctctacaaaaaacacaacaattagctgggcatgatggcatgtgcctgtagtcccagctactgaggaggctaaggtgggaggatcgcttgagcccaggaggttgaggctgcagtgagctataatggcaccactgcacttccacctggacgacagagtgagacgctgtctc

SEQ ID NO: 642063 - DNA, 168 bp, Homo sapiens
ggtcaatgttcaaactgaggcgacgcagttctttgttttctatctccatactctttagtgtctggataatagataccctgacctgatgcgtcgtctgtttcgaacattgaccactgctgcgatccgtagacttgtttaatcattcttacatacttccttaagggtatc

SEQ ID NO: 642064 - DNA, 1257 bp, Homo sapiens
acttgccccatgggagactaggagactgtatcagaaacatgattacaggcacgtctccggctgactgtgcttgtccatgagttgtgctgctggtgttggtgaagtgttgaaggctggttatctccaataatgtcgcagacccgagagcagtgcccgtatcatggactgtaccacttcgtgggctgtgaaacaggcgtagttgtgtcgagtgttaatcgatcagtggatatccacatgagggcctcccatattcggaggcagacacgagaatatcgaggaagatagttgaaggaagtcggtcactgacatcaagaaaaatcgtcatacgaacacctcgacatccagatacgccagtattgtgcctaactattctgggtctggaattgcgtgactaagcgaatgcgtggacgcccaatgtgctgtaacactgccgtgggattcactggcgatggaaaagatcgcccctggtaaggattggccaaatgccaggtggaacctacgacgtgaggtatgacggctgtccgtggattctgtgcagcttcttagcacacccgaagtctcgatccaaaccatgacctacagctccatttggagcacatgccatcttgcccaggatgtgtctctatccaaaagattgggtgagaaataagcgtagcgtgataccctggttgggcgcgacctggatgagactggatgttgcgtcaaacatgccctggttcatgggtagcgctcagccatttagggcggcccaagttcatattgtttaacacactggaacacgttcaccaactcgtgatagataaactggtccccgactgcaaagctgtctatgaagttgaaagctcttgtccttgagagcaccaacatgctggggcttccaatggtcggagcaaactggtgggtctggccaaacggacaggctccgcacggtgagccacaacgtttgcttgggagacagctgacatgaatgaacccgcaccaaaatggaaacgcagccttggcgttccgcacgcctcagaccgcgaacttgctccatgatgcacattcccggggccacacttacagctgccggaaaaaggccccggtcctggaacacgcgagaacggaataccactcggggttgccaaggttgggatgatgccgggcagcgaaaagacctggaatggaccggaacctggcagagagactgggaagaaaggcgccgaaccattcacgtcaggctgatccaacctgatgaagcacatgctcgtgacagcc

SEQ ID NO: 642065 - DNA, 814 bp, Homo sapiens
gatcgtcgtaggtgccgtggtagtagacgtatagttccatcggagttgtttgcagtagcatcccttggtccacctgtgggaaggccccataacggagacaggcttcctctaggtgttatgagggaaccaatcagttatctgctactgcattagggttggatacactcacagctccacgtccggattcggtgttaacagagatattagtctgaatactgggttttaccggtgactatgcttgctcaattgcatttgtgcaacattctgttgatgtttggcacccatgcctgtatcggtgaaactattggggtgcaattgtatgtgtgctctatacttttggaaaacgtgctatagatactgtgttgcctgaagcgaagcgtttgtgatagtatacgtctgcttgtggagagaccggtgacgtcgctcgtgtctgttgaaatgcctagtgttgaggaataatgtgaactgtgacattgtgtttgaaatgacacaacttactgaaaaaacttgtgctgaataatttgctgtctgttaatcacattgcaatgatggttgaaaagaactacactaattgacattgcgtgggctttgtgtgctccctgttgtttaaaatgtcatttgttgagcaagagttgtatagtattgatctacttacttgaggctgtcaatttttcactacagtgttttgtaaatgtatccaccgagaccatgatgccctgttttgtgcatcaacttgtgattattagtattcataaaggacatttatgaactgaagtgtatatcttacaagcatttaacatctatggtctttaga

SEQ ID NO: 642066 - DNA, 413 bp, Homo sapiens
ccatttttaacacactggaggggacttggcaaggctcatgtgttcagattcttctttgtttttctgtgtcttcagtgatggtattttttttctccaggtatatggtgggtacctctggaataaaggttttatgacctacacaaggggaagagcagctaagtttcatagcctgcttcaggggagaagggatgaggggaagatgagagtgaccttcctgcttttactgttttctcaaatgtcaaggggtcatattttggggtagcatgtcctgaacccaaaggatctgacagactatagaagaatgggcattactgctgaatctggttcagatctttaaatttataactagggttttccaaaatagaaaagaaatttttttctattttttcttgttgttgactcgttgttgctcc

SEQ ID NO: 642067 - DNA, 212 bp, Homo sapiens
aacaggaattacgctacatcgaggcgttgtctgccattgttgaaaccgggcagaaaatgctggaagcgggcgaaagtgcgctggatgtggtgacggaagcggtgcgtctgctggaagagtgtccactgtttaacgccggaattggcgctgtctttacgcgtgatgaaacccatgaactggacgcctgtgtgatggatggtaacaccctgaaa

SEQ ID NO: 642068 - DNA, 553 bp, Homo sapiens
  misc_feature (369)..(369): n is a, c, g, or t
  misc_feature (420)..(420): n is a, c, g, or t
ggccacacaggcccgggaccatgggacctgttgtacgcccgcgggccaagaatgtgagtttcgtcccctggatcctagcggagctgctgggcgctgcgctgccagcgaatccgttcacacccggcgtgcatacctagacacgccctggggcctcggccaaacacttggacggcatgtgcctgcgcactaatttttccctggaacgggttgtgtagagatcatggaggccttactcggtgcctggcgctggacacagtgctgtgctcaagctatctgctcatgttacaagtatacccatttcacaggtgaggcaactgaggctcggcgagtcaggcgactagcttatggtcacagctccagacccgcggngagcgaggatcggaagagtagcttttagacacatgtagcgctcacattatnttgtcttaaccgaccctggtccgcagctcttttggcttaaccgaacggggacattttggactggacccctccggtttcggctaattcttggccaggtcacccccatagactttgtgctgtggagggtttgttt

SEQ ID NO: 642069 - DNA, 386 bp, Homo sapiens
  misc_feature (311)..(311): n is a, c, g, or t
  misc_feature (329)..(329): n is a, c, g, or t
tgtgaaagcacacaccgtggggttgcgccgttgtcctgtctaaaaaagttactgtaaaacttcgatcacgccgtcggcgctcatgttgacctggctggtgccggcttccacttcaggcgtcggtgctgaatcggccatggcggctttcatcatcatgccgccattgcgggcgtagggcatcgggtagccattagtgttgaagttcaggttgacgatcttgtaggccttgccaccgagtgcatcggtagccagttgcgcacgcgccttgaatgcagccacggcatctttgagcagcgcatcttcgctggccntgcgcgtggcatcggcgntggcgaagtacatgctgtccatcttcagagtgtggggtgtgctttcacggggtatcg

SEQ ID NO: 642070 - DNA, 157 bp, Homo sapiens
  misc_feature (147)..(148): n is a, c, g, or t
tcaccactctccacttcacatgtatagtataagaaaagcactacctccatgagaactataccaccgatggaattgaagtcgtttgtttaacgctgtgtgaatataaagagtagtttgcagctgtgtggtagtggtatgggtaccganngctcgaatt

SEQ ID NO: 642071 - DNA, 939 bp, Homo sapiens
tataaaactgaccctgtcttctggatgaacggtcccttacggtagtccttgactgggtgactaaatactgtctacataatgatagcatatacctacggaggatgctctctcttcatcgcacagctatgtatgcttagggtctgtgtaatctagtgaaatagagatatagagtgcctattatgacaatgaaggtaagatgagccatatgtgtctgtcgactctattgacctcaaggggaagctgaggcaggaacatgactctgtggggcgcgagggagggaaggagcccttaccgttcgtagagtaggaatgtagggattccgaaaaggatatttggaatccgttagtgtccataaagtgaaagtgctatagtttggttagacgtgaacactgttgataaagagggtcgcagtgttgtgattaatttggttagacgcaggaaagattgctgggttttaattgttcaggtgtaaaatatccgggcctaattcatatctactcgattctacctcaattgttatgtctgcataatgcttttgattatcgtactgaaatatccttgtctcattcatcagatgatacaacccaattgttcagtacaattgtagaaagatgtgcagtaaggaataaataggatatatacacatagtatattcgaggtacctcagtgacaacagatatgttgctggagtgagaagcgtaggtgtatcagaatacgatttgagaggaagacaccgtcttgttgaatgtcagaggcaggtgtttgaaataaggcttttgtaaagcttttcattgggaggtaccaagtatctacttggggaaggggggttccacgcagggaaataatatgcagggtggcggttgcaccggtatgtgtaaaactggattatcacagggggggaccagacaaaccgggcgggggggaaaggggcccgcaggg

SEQ ID NO: 642072 - DNA, 477 bp, Homo sapiens
  misc_feature (197)..(197): n is a, c, g, or t
  misc_feature (277)..(277): n is a, c, g, or t
tgaggatctcactcgatccgctgatccagcacgtatctcccatgcgcagtggagccccagccaagaagcccgccacaccagcagaggattgacgaggattaattgacatttgaccttgtttggcagtgacaattgaggaggaggacaaggaggcggcacagcttgcgggagtgagcggctacggcagttacgcggangaagaaggccaatgaagccttgcacgtggtgtgccaagtcctcctatccgtgctggatgttcaagccttgggggatgatngagaacggactattggcccagcttggatggccttggttgtgcgctctatccgagcttggacgtgggctggtcctgggggggcttccaaagctggttgccctgtgggcctacgcgtatccgagaagctacagtattcagtgtgtggtgacaggacgacaagtgtggggacatgccttgcttggatccagcggatcgcagtg

SEQ ID NO: 642073 - DNA, 124 bp, Homo sapiens
ctagaggatccccctttgaaaaaattaagaaagaaaggagattctgctgaatgtctaagtttctctggaagatggactgactaagagagaaactgaagcttgggctttgggaggttattggcat

SEQ ID NO: 642074 - DNA, 282 bp, Homo sapiens
  misc_feature (37)..(37): n is a, c, g, or t
tgtgagatcttttcagcaaattgcgtacgtctcctgncatgctcaggccaggcacccggaattgtgccctgctgtagtccgtagttattcttctcgtttcgctgttggtgcgacgtcacttatttctctatccatgctcgatcgccaattacactacgatgtactagatgattagactctcgaggtcagtacccacgtggccttcagctttgacctgatacatattcatcacaatttgcacggagtccctgtctcggttgaacgagacaggaccactgaggc

SEQ ID NO: 642075 - DNA, 137 bp, Homo sapiens
  misc_feature (8)..(8): n is a, c, g, or t
  misc_feature (61)..(61): n is a, c, g, or t
  misc_feature (78)..(78): n is a, c, g, or t
tcccccgncccggtgtgcgctcggggacggtacgtgaccgaccaaactaaccaactacacnggacctctttcgacggncctgtaacttggaactgacgtccacctttacacactcctttaaccgacggactccactt

SEQ ID NO: 642076 - DNA, 106 bp, Homo sapiens
gatcgacaggactgcagctaaattccaaataccagagactgaatttcagccttgctaagggaacatctcgatgttgaacctttgtgtgtttgtacagggcattctc

SEQ ID NO: 642077 - DNA, 146 bp, Homo sapiens
  misc_feature (73)..(73): n is a, c, g, or t
gtcttcgtagccaaagatagagagttgataaagcagcgggccatcacgagatgtaacttacatagagatctanctctctgtggactggtgagaactactaagactaaacttagaaactaagacatctggaggcaggaatgaagcac

SEQ ID NO: 642078 - DNA, 371 bp, Homo sapiens
  misc_feature (280)..(280): n is a, c, g, or t
  misc_feature (364)..(364): n is a, c, g, or t
  misc_feature (369)..(369): n is a, c, g, or t
gattccattgtaagacatttattctcccctaaattaattattaattttaaaatgtaatgcaatcttggctggatgcggtggctaacacttgtaatcccagcactttgggaggccaaggcgggctgatcacttgaggcccaggagttcgtgcccagcctggccaacatggtaaaaccccgtctctattaaaaatacaaaaattagctgggcgtgatggcgcacgcctgcagtcccagctactcgggaggctgaggcaggagaatcgcttgaaccggggaancggaagttgcagtgagctgagattgagccactgcactccagcctgggtgacagaacaagactccatctaaaaacaacaaaaaanaggtnaa

SEQ ID NO: 642079 - DNA, 223 bp, Homo sapiens
  misc_feature (22)..(22): n is a, c, g, or t
atgctaggattatccagcatcntgcttcgcgcgtctgtgtggctcagttgcaagtttatgggtatcactattgggtgcatcagaccccacaaagtgggccagttccactggcatcttgattcataccagcttggttggtgcactctgctgctgtctcctttggtgtttctgtcccggtggcacgggatcattcgttggcagcgtcccggaagcattttgctag

SEQ ID NO: 642080 - DNA, 247 bp, Homo sapiens
ccttgatgttatcataaacatgtacttacctaagtcctgtcctttggcaaattatggggtatgagacccagcatttttgcctttccctgaggggtcaatttcagcgatcctacccattccttttgaagcacttatgctctttttatatggtatgtaagctctcggtttggggagtaacagtgcaaaaatttacctgttttgttgccacatgtttttaaactttccaataaatccccttttactgcca

SEQ ID NO: 642081 - DNA, 611 bp, Homo sapiens
cccacctcccaatatctcatcaaccaccgacttatccccccccccccaatgactaatccaaactaacctccaacaccaatgataacccatacccccacccttaaggacgaacctgatctcttataactagtatcccttaatcatttttattgccccacactaacctcctcggactcctgcctcactcatgttacacccaccacccccactatctataaacctagccactggccatccccttatgagcgggcgccacgtgattataggctttcgcttctaagattaaaaaatgccctagcccacctttttaccacaccaagggaacaccttacaccccttatccccatactagttattatcgaaaccactcagcctactcattcaacccatagccctggccgtacgcctaaccgctaacattactgcaggccacctactcatgcacctaattggaagcgccaacccctagccatatcaacccttaaccttccctctacacttatcatcttcaccattctaattttactgactatcctagaaatcgctgtcgccttaatcccagcctacgttttcacacttttagtaagcctctacctgcacgaccacacata

SEQ ID NO: 642082 - DNA, 1869 bp, Homo sapiens
  misc_feature (1519)..(1519): n is a, c, g, or t
tgacatattatatataatagtattagaactcattccctgaactgatgtaaatcttcatagtgtcagacatactgaccaaaaccacaatctagactacaaagtatatggtacaagagtactcaaattgtattatttataactcttccgcagttggcaaaatcttaacaggaacggtatctcctatattttacacgaatttcattggtcccaccttttactaaacagtggcagcagacttttcacacgtctaaagcaactactggcacatatcagtcaccaatacagtacaacttctctttctggccactatcctccagtaaccaaatttagccacttatacactctctggtagggcccaaattctttactcatagggacgtttaaagctggattctatctcaaaaaactttaacgccacgaacgtggggtataaaaacaatttcctggttgtcttcgacttaacggtaaaccttgaaatagcaattattaaacgattaacaatcattaacaccacacaagtttggctcataaggtttggcactggttcaaccaagctgtgggacaaccaggttcgtacttcctcggcgcaacaactaacaggtcaattgcatcctggacaccctcattgacaacggcccaaatgggtctcttaagaacagccatctgttacttcacattacaacccacagcgcacaattcagccccaaatctatgggtaaggccaacttttctcgacacacgggtacaactcactcatgatgcatcaacacacaacgcgcacagcagtcacttttctgccacaataggtgcttcaactaaggcgcgaacaacagcgtgactccacataaggacagcagacctctttgtccaatcacaaggcctatagggacataatcgatagcggcaccatgctgctgtgccgctaggctaccatatgagttgggttgcggcgacatatagatcccctttaactcaccaacgttgtcggttccacacacacacggtcttcattacacatatcaacaaatcacacgtgtgggctggtggcacacaacacttcatttccccctcaacaccacactgtgcaggcggcgcacacccagaacaacaggcgggtcggcacaaccacaacttctcaaaacgggcgccaaacacgacgtgggatgacacacacagtagcacaaccagagatcaacaccgggcgtttaaaaacagcaccagcggagctcaagagtccaaagacaacctcctccagtggtccgcaaagagagatcgcataagcgaatgcgtcaacaacatataacctagacaccaccacactccaacagaccaccgtgcgctatacaccacaacgcggaacacgagcttagaactatactatggcagctcgttgcgaccgcacctaactagctagctcgctcgaccgcggcacactcaccactcccacttcggactacctgctaccgctcgcgtcactgctcttttgtcttctttgttgctcttatgtaataatttttgncacaagccacccacagcgcaagcagacagtaccgatcccgcaccccctcgggacgaagcaaacgagcagggaagagaaagagaagtaggcgacaggcgttaggagcaaggcagcacgccggcgcagacgcgaggaaagcaaagcacagagagcacgaacacacaacgagagaacagcgacaagagaagcaggaccaggagagaagaaggcagcgagaacgagaagagtaaagcggcagtcagagcagacacgagagaagcaaaacggagcaggaagaggcgccgcaacaacgacaccaccacaggacagcacccaagaccaaacacaccagcacagacgcaacgggaacc

SEQ ID NO: 642083 - DNA, 377 bp, Homo sapiens
ggccaatcagcaggatgtgggtggggtcagtcaacgggaataaaagcaggctgcctgcgttagtagtggcaattggctcaggttctcttccacgctcacgctatgggagttaagttgagtttgatctttgagataacttgctgctggtcattctttgggtacacacatgagtttatgagctgtaacactcttcgtgaagctctgcagcctcaatcctgagggcaccgagaccatgaacccagtggggaggaatgagtaactccagacgcgctgcctttagaggtgtaatactcactgtgacagtctgcagcttcactcctgaagccagtgagaccacaaatccaccagaaggaagaaactccaaaaaacgtcttgaa

SEQ ID NO: 642084 - DNA, 304 bp, Homo sapiens
agaacacgtgaaatggagaatttcagggctaacatttcttgttttgtttctgaaaacatcggcatgtcctaaaaagtgtcgcctgtgcccatcatctctcaggcttgggagcaggacaccgccggctcactttaaagccaagggaaagaatttggacaaccaactacgtctggagaagacaccaatgtcagcagagctccgctttcatctgtgggcgaaggattacctagatgccaagctacctaaaagggaagcgccccctgtcctatgatcacgtgacttgcttcaccttgtcaatcacttg

SEQ ID NO: 642085 - DNA, 721 bp, Homo sapiens
gccttagaaaattagatccaaaaaaaatagtagagtttggggaaaatgtcaccctctgtttaaatcttttgtccctgtagagcaaagctgaaaaaaggtattgcaataggaggcacaaatagaagaaccttgagtgtgatcttagaaaagaagacgatggatgaatataggtgaattagaattgaagctgatgccaattttctgattgtaagtccatctttttccattataggattaaaagcacaagatttgttaagacctgaaaacacatactaattgagtcctgaaactgagtgttagagtaataatgaaaggaaaatacttgcattatttcaaaataccccaaggtaccttggattgagtccgatcattcccagttaaacattaattccattgtttgcagagtgatacaagtaaaccaagatgccccagtgctctgttagaagatgtgattgacaaagctcctttctgcaaatgtttgcccattctgtgactaattcataaaagttggtttgtttaatttttaacacaagtggaaacaatgatacaaaaaggacatgtgataaaaaaattgttttgggtgggacaggggcctttgaaaaagcttttaaaaacacattgggtggggggcgggggccctgagggtagggggaactgtggctatcaggggggtccagggaaaagcggggtaagaaccagtggtgggtttcgccgattaaac

SEQ ID NO: 642086 - DNA, 167 bp, Homo sapiens
cttttctataataatgctacggaattgtgtactctaaaatggttatttgctgtacatggtggctcacgcctataatcccagcactttgggaagccaggatgggaagactgcttgagccctgaagtctgagagcagcctgggcaacatagagagaccctgtctcttaa

SEQ ID NO: 642087 - DNA, 340 bp, Homo sapiens
gcaatgtaccaataggttttcttgggtgaaagagaaagccaggcccggcacagtggctcatgcctgtaatcgcagcgctttgggaggctgaggcaggtggatcacctgaggtcaggagttcgagaccagcctggccaacatggtaaaacccagtctctactaaaaatacaaaaattagccaagtgtggtggcgtgcgcctgtaatcccagctactcgggaggctgaggtgggagaatcgcttgaacccgggaggcggaggttgcagtgagcctagatcacgccattgcacaccagcctgggccataagggcaagactctgtctcaaaaaaataaaaaatt

SEQ ID NO: 642088 - DNA, 755 bp, Homo sapiens
aagccatctttgcattgttcctcatccgcctccttgcccgccgcagtcgcctccgccgcgcccaagaataaaggtaaaggaggtaaaaaacagacgtcaggggtaagaagtgagaatgaatctgaaaaaagagaactggtattcaaggaggatggtcaggagtatgctcaggtaatcaaaagtgtgggaaatggacggctagaagcaatgtgtatcgatggtgtaaagaggttatgtcacgatcagaggaagaattgagaaaaaggggttggataaatacctcggacgttattatgggaggtctccgagattaccaggataacaaagctgatgtaatgttaaaatacaatgcgagacgaagctagaagtctgagaggcatacggcgagcttccagagcatgctagaatcaatgaaagtgatacatttggtcctggagatgatgatgaaatggcagtttttgagtgaccatgggagatgagtgatgaggatcttgagtgaccctctaacattgaactcagcattttttacattccatctttttctgaagatggtcctagcaggatttggattgtggagcatgacaaagaaggattctaaatctcatgatgcattgaatggcaatttgttaaacgcacgactgattcgtctccacgatatcttcggtaccccaaaccctgctctagtgctgacctatctcactgaaggtagcccctggtctctcaagtgggagcttgggtgaacccggcacccatcc

SEQ ID NO: 642089 - DNA, 240 bp, Homo sapiens
  misc_feature (122)..(122): n is a, c, g, or t
  misc_feature (144)..(144): n is a, c, g, or t
  misc_feature (203)..(203): n is a, c, g, or t
  misc_feature (216)..(216): n is a, c, g, or t
cacgagttcatacaggacagcatccccatgtggggtggggaggaaagggtcgattctatctcatctaatgtggttctagaaacctcatggattccaggcaagaagcttagcactgtactctngggaaggggaatacttgcaccnttgtttcttttgtttttcctacggagttagcagaacgcctttcagacaggacttcacanaaatccaccaagngaaaggcttctcttgactgcgggc

SEQ ID NO: 642090 - DNA, 430 bp, Homo sapiens
cctgtgctgcctgtgactccgctcctgaacacccaccaccgagatgtcctgccagcagagccagcagcagtgccagccccctcccaagtgcactcccaagtgcactcccaagtgccccgcccctaaatgtccccctaagtgccctccagtctcttcctgctgcagtgtcagctccggaggctgctgtggctccagctctgggggcggctgtggctccaactctgggggctgctgcagctctgggggtggtggctgctgcctgagccaccacaggcgccacaggtcccaccgtcgcagaccccagagctctgactgctgcagccagccctcggggggctccagctgctgcggtgggggcagcagccagcactctggaggctgctgctgaagtggaccttgacttcctcttccttctgattctgcctgaata

SEQ ID NO: 642091 - DNA, 1086 bp, Homo sapiens
  misc_feature (90)..(90): n is a, c, g, or t
  misc_feature (94)..(94): n is a, c, g, or t
  misc_feature (118)..(118): n is a, c, g, or t
  misc_feature (125)..(125): n is a, c, g, or t
  misc_feature (127)..(127): n is a, c, g, or t
  misc_feature (166)..(166): n is a, c, g, or t
  misc_feature (185)..(185): n is a, c, g, or t
  misc_feature (189)..(189): n is a, c, g, or t
  misc_feature (224)..(224): n is a, c, g, or t
  misc_feature (242)..(242): n is a, c, g, or t
  misc_feature (252)..(252): n is a, c, g, or t
  misc_feature (278)..(278): n is a, c, g, or t
  misc_feature (283)..(284): n is a, c, g, or t
  misc_feature (290)..(291): n is a, c, g, or t
  misc_feature (294)..(294): n is a, c, g, or t
agcggggtaatttttttaaatggaagcttctagcaagccccccaccccaatcaacctctatgctttcttcttaaaaaaaaaaaaaaaggnaaanaggaaaaaaaaaaaggaaaaccanaagcccngntgtctgtctgtgcccaagcccttccaccagaaaagctantctaggtgtgagagcccanatgntctgtagccatcaaaaataataataataacctggnacagtttacaatcgtggntttctttcanaaggcctttttgggaaagaagaaagngcagnncaccgnnttnccactgggcggtttgggtttggtggcaacaggcaggggaggagtgggggacgcgttggtgctaagctggatttcccatgggcaacagcaggggcacgctgggaccccagaaacccagaaccctcatcctgtgggccagaggggccggaccattggacccctttcagggattccaccaaaagcccaagaccggtcaccgtgaccaggtgggcaatgcactggttcccagggaaaccctcctcctctcctggggacctcccttccgtccgtggcctcccttggcgtctcaagcccctccttgtggcccaacccaagtcttcccagggaaaatccggccagctggggttggggtgcctggagcaaaggtggcaaaaggctgcccatgaacaaggagtggctatgaccggggacatgggacaacagggacctccggcgtcggggtcccaaaaatccctcgcatcagcagacaatcgtggtggcccgggattgaagggggctggaactcccggggacccatagggaaacaaccacataaatccagccttttccaaaacagggagaaccgatcagaatgcgccggaaatatgcctgggacctgggatggacacacagttgggaaccactagtcgggggggtgggcggaccaccgggaagcccaaacaagagcagtcgctgggctccagcacagataactccaaaaacacgaagccgaaagaggacccttccccaccggagagggtgaccctgggcccactaacacataaccacaggaactggggctcccggagaaccg

SEQ ID NO: 642092 - DNA, 282 bp, Homo sapiens
gtctttgcgtctcattgatattggttaaggctgttaaaaaaaaagccggaacttaaagtagcatacttgtactgcattctggacatttaactgactcattttttcacgtatattactgagagcactatatatcatgggagtatttgagtctgaattaattaatttcgttcaatgcttattcaggaatatttccagtgtttgctatatctgcaataaaccgtgttccttctcactaacttggaaggaacaactaagcagcaacattctgtatgttgtgctcct

SEQ ID NO: 642093 - DNA, 400 bp, Homo sapiens
  misc_feature (57)..(58): n is a, c, g, or t
  misc_feature (60)..(60): n is a, c, g, or t
  misc_feature (67)..(67): n is a, c, g, or t
  misc_feature (70)..(70): n is a, c, g, or t
  misc_feature (304)..(304): n is a, c, g, or t
  misc_feature (331)..(331): n is a, c, g, or t
  misc_feature (352)..(352): n is a, c, g, or t
  misc_feature (397)..(397): n is a, c, g, or t
ttcggcacaggacaggcttcattgggacagccctaacccagctgctgaatgccagannancgaagancgnttggtctcccgaaagcccgggcccggccgattcacgtgggatgagctcgctgcatcggggctgccgagctgcgatgccgccgtcaacctgggccggagagaacatcctcaaccctctccgaagatggaatgaaaccttccaaaaagaggttctcgggcagccgcctaggagaccacccaattgctgggtaaagcattcaccaaaggccccacaaccccccaagggctgggggtntttagttcacagggtgttaggctttanttaccaggcccagtttttganttgcgggagttattggattgaaggacaagcccaggggaggggganttt

SEQ ID NO: 642094 - DNA, 285 bp, Homo sapiens
cacagccacccgaactcctgcctcctaataaaaacctctgagggagaggaaactctctctctctcttctcttcctccgcggcacccctcagcgacgcgccaggagctcaatgggctgcgctgccgtactactgcgccacatctctgcgacccgtacccacactctgcaaccccatcgcataccagatcctgacgtccggatgcaccaaaacacgaaggaaccacagcacacaacgcaacacacataaactgcctcacatgcacagtcattacatacgggaataaa

SEQ ID NO: 642095 - DNA, 131 bp, Homo sapiens
  misc_feature (15)..(15): n is a, c, g, or t
ctagaggagtcttanagctgaggagagctgaggagtgggacagtgggggcagcaaagtgactggggaagtactggacattctaactcgccctgcagagagtgtggaaagactcacaggcgtgagcttctcc

SEQ ID NO: 642096 - DNA, 1446 bp, Homo sapiens
  misc_feature (191)..(191): n is a, c, g, or t
  misc_feature (255)..(255): n is a, c, g, or t
  misc_feature (307)..(307): n is a, c, g, or t
  misc_feature (310)..(310): n is a, c, g, or t
  misc_feature (312)..(312): n is a, c, g, or t
  misc_feature (423)..(423): n is a, c, g, or t
  misc_feature (426)..(426): n is a, c, g, or t
  misc_feature (486)..(486): n is a, c, g, or t
  misc_feature (532)..(532): n is a, c, g, or t
  misc_feature (568)..(568): n is a, c, g, or t
  misc_feature (580)..(580): n is a, c, g, or t
  misc_feature (617)..(617): n is a, c, g, or t
  misc_feature (743)..(743): n is a, c, g, or t
  misc_feature (868)..(868): n is a, c, g, or t
  misc_feature (871)..(871): n is a, c, g, or t
  misc_feature (877)..(877): n is a, c, g, or t
  misc_feature (911)..(911): n is a, c, g, or t
  misc_feature (975)..(975): n is a, c, g, or t
  misc_feature (984)..(984): n is a, c, g, or t
  misc_feature (1002)..(1002): n is a, c, g, or t
  misc_feature (1053)..(1053): n is a, c, g, or t
  misc_feature (1080)..(1080): n is a, c, g, or t
  misc_feature (1090)..(1090): n is a, c, g, or t
  misc_feature (1128)..(1128): n is a, c, g, or t
  misc_feature (1134)..(1134): n is a, c, g, or t
  misc_feature (1139)..(1139): n is a, c, g, or t
  misc_feature (1151)..(1152): n is a, c, g, or t
  misc_feature (1192)..(1192): n is a, c, g, or t
  misc_feature (1207)..(1207): n is a, c, g, or t
  misc_feature (1221)..(1221): n is a, c, g, or t
  misc_feature (1251)..(1251): n is a, c, g, or t
  misc_feature (1420)..(1420): n is a, c, g, or t
ttcatacggcagaagcgcagccatcttgggttagcgcacgtcctgggtatattacgggctcatctaatgagactcctgtgtggtctctctctctcgaacgctgcaccagagaaagcgatatggccaatacagcgcaaagagcagcaccgtgtacaatagatgtaggcgtcatacaacttgctaagtgagtncgcgaacacagccagatcatcaacactaagacacgttacagaacgcattcctatcgctctctcncttcgatatcacgtctactatacttgcagcgggcacacaaaaatatcaatanatncntacgaatagtaccgacgtgctcacatgctatcgctcgactcagctggcgcagttgcgtgcgcactgagtattcatccaccgtcgttggctgtacaagtcattagatatagnaangagatcaatattattgacgataaggatagtgatagcacaaacaggagccagagcgcgaanctcagacgctcgctctatactcataacattacttatatacacaacnacttcatcttagatctaatatcattgatgtgcatcnacaccatacaancgacaatatcatcactatgagccacttgacgcggtcntctacatcacacacagtctacactgtgcgtagagttagcagtacagtgtgaagcagcgaacgctcgtgagaaatgagtcggagtgtgattgatctctctatctctacgagagcttgtaccatatantagaatatactctacatacactatcatatacgtatacacaacatgagagatagacacacagcacgaaagagagcgagagaatatcggataacacatatcagtcgtccctctgcggtggacgacantanagtaantactatagtaataagttcgtcctcgtatcaagtntctcacacttctgcattatatagtatacagacaccgaacaacacgtcctcgctcactcgcctantccgcaacnttaacactcacatctcgntatacaatacagtgagatcctgtcgcgtcgcagcgagcacgcatgctcgcnctcgctcgcgctctcatcgtgcagtgntgagtttgantgcgtagatatacacgtcatcacacgatgattaaacanatatgntgatncgagtatgtacnntctcgtcgatgtctgtatatcgatgcgacacactcatgcnacacatacatgaatnatgtactagtgtantatagttatagaccgccgtagactctggtntgtctactagtgtgcatgttggtgtgcgtgacgtaatgaatatgtgtgcaagtcacgtagtgtgtcctatatcgtgattttgaatgagtagtgagctcagatcgtcagacggtcacatgtgatggtcgtcgtgttcatcgctgcagctgatatcgtgtgatgtctcatnatgctgcatagagtacgcactagccg

SEQ ID NO: 642097 - DNA, 345 bp, Homo sapiens
  misc_feature (16)..(17): n is a, c, g, or t
tctcatccagccggcnncagtcagcgatgcctcgggtctttgggctcaaagctccccaaccagccgccctcttacctcctggctgtagcgtggagaataaatgtccacctaggctttcacatcttctcctggagtggggccaggctctcctcaaacggtgcgccattccctgccagctgctgctgccgtttccaaatctggatcctcttcagcactagggctttggctgcctctagctctccagtggtctcctgcagtagcatggccagggcctcacttggcccagtcccattagcaggagtttctatcaagctgtgcagagacacttggccagcctcagccccc

SEQ ID NO: 642098 - DNA, 138 bp, Homo sapiens
cttctgtgactctatggatgactctgctaaatcgtgtgagacagatgagtgtgtatactgcttcacatgaccgacctccaggcaaagagatgccgtccttgtgtcacgaacgaggccatgctctgttgagagtcagag

SEQ ID NO: 642099 - DNA, 272 bp, Homo sapiens
ttttcccggttttttttttaaaaatttcccccccttttttgggcccttaggaggtttaaccaccttggcccccaaccccattgtttccccctttttggcccccccccaccccagagtaatttttccttttagggaccttttttaatccaaatgtgtttatttttgtttgtttgtgtttgtgtgtgtgtgtgtgtttttttttttttttttattttttaagggaattttccctttttttttttttaattaaaccccctctggctcccctttta

SEQ ID NO: 642100 - DNA, 716 bp, Homo sapiens
  misc_feature (268)..(268): n is a, c, g, or t
caggagacccggcgctttcttccttctgcagcatgaggctgtggcggggccgggggtggggtcggggccaggaggaataggtcgtcagagaataaaaggaggttgtccatagattgactttaacgcatgcaatcagtaaaacattgagctcttcagctccggctttctggctctgaaacattggaagaccaagaaggtttgatgtcttgtgtgacgccacctgaattagaaaccaagatgaacatatagccaaatggtggtctggtgnttgttttcacgcaacactcgaattcatcatgtatggagctatcaagagacataattgcagagcggctaggggtggagatgggcaaagtgcaggtttaccaggaacctaacagagaaacaagagtacaaattccagagtctgtgaggggaaaagatgttttgcatcatccaaactgtttcgaaggacgtgaacaccgaccatcatggagctcctgatcatggtgtatgcatgtaagagctcttgtgccaatgagcatcataggcgtgataccctactttccttacagcaagcagtgcacagatgagcaagaagaggctccattgtctctaaattgctgcttccatgatgtgcaaagctggtctagctcatcttattactatggattgacaccagaaggaaattcagggcttcttcaatattcctgtggacaattttaagagcatatccc

SEQ ID NO: 642101 - DNA, 481 bp, Homo sapiens
  misc_feature (2)..(2): n is a, c, g, or t
  misc_feature (28)..(28): n is a, c, g, or t
  misc_feature (106)..(106): n is a, c, g, or t
cngaccaccgatataaacacctgtactnccatcgggtcgtgattttacttccgcttcccaagaatcgacactggtgccatagtcattgatggttaggcctataccngttcggagttttcaatggtgaattgagtggctgttagtgttgagctatgcccaataatgatgccgtcatcgttactcttaatggtgctgcctgtgcctaagtcagcatgggtatagtcaccaattaagttaaatccgatggcagaggtttgaccaacaacatctactgtgagtcggttagctgtcagggagctgtttttgccctgaataatgattccttttgcatatccagaggcgtcgttgacattgacggtgacatcattacccaggttgatattgccaggcgtgtttcctgctggggtcattacaccatagaggtttcctgatggatcggcggtatctcctgtaattctgtcaccatcattaatagtaatat

SEQ ID NO: 642102 - DNA, 619 bp, Homo sapiens
accgcaggtctggagtgcagggcgcggtcatcggactcactgcagcctccaccatagcctggttcaagcaagttctccggcctcagcgtcctgaggtagctgagattacaggagccgggccaccacacccagctaatttgaatgtatttttaggtagagacagggtttcatcatgttggccagactggccgcgaattcctagacctcaggcaatccacccgcctcggcctcccaaagagctgggattacaggcgtgagccaccgcaccctgccgaaaaaaacttttatattatttggagacggaggctcgctcgtggtcccccagggcgtggagtgtgcaggtggcgagatctcagctcacggcaagctccgacttcccgggattcagcgcacatatcatccgtgcctcagacctcccgagatagctgggagccagggacgcccagcctaaaaaactttcacaagtcaatattactacgatttaacattagagtgtggacatgtgatttaatcgctatagctaaaatacgtcaaatatacgtggctcatggtgcttgaccctgatgctaaccctgacaggatgaaggaaacgtcatatacttccagggtagttcaggag

SEQ ID NO: 642103 - DNA, 973 bp, Homo sapiens
aaccaatacagacagcaataaccggcctgcgcacgggaggggtcgacctgtccagtgctctcggcagtcacgcgtgagaccgtgcccgtagtggacatcgcggttgaaaccgccgcggtgtggagccacggatgtcgccgatccacacgtgtgctgtccgcgtacgcgccgtgttgtccccacaaacaagggcccgcggggttcgcgaacaaataccttggccgcggcgcccgcaaaatttggtgcacacaggcgtgggaaattcttgccccccaaggcctgcccacatgaggttcgccccgcccctccgtttcaggggccaagcaacaacctccgtttcctggtgcccctggaggcgcccaccgcccgctttgctggggggtcccccccgcgcggggacgcggttggaaatgtccgagccgtgtgacaaaaaagcttgtaaccccaaaatgtgggcgcccacaacaccccacagcgtcggggcttgggttactccccaccgcacgatctccggggcttgtagaaaacactcacgaggggccgctggcaccaccgagttatacaccactctgggcggaaatctccccccgggcgcgagaaacacagggggaaaaatttgtgtccaaggcctccagtgggcgcaccctttctccccccggccacagggcggagatctttccccgggtatcaaccagtcgggtaacctggggtcctcttaaacgcctgagcgctttcccccccaatttgcagagtgggccccattccctcgcgtccctccctagtcaaaaccatattgtgcaccctgcttcgatgagcactggtctccacggaggtgtcatctcattccccgtgtcgccccttgtccctccccttgggctcccgtatgagcccccccccccggggaaaatcatttggggttttaagtttaaaaaaataaaaaacccctcacacaaaaaaaaccaaaacataaaaa

SEQ ID NO: 642104 - DNA, 124 bp, Homo sapiens
ctagcatgtctcgtgtcgaggtcgtcaccgcggaaagaggagagtgggcccactctcctctttccgtgtgtgccctcgatgaccggtgtacctgaggctcgatattctgtaaatcatgagtcag

SEQ ID NO: 642105 - DNA, 343 bp, Homo sapiens
acgggaatcgcaaggtataaaagtaactcctctaactttttgttttggcaggacaagggtatggacgacaaaattattcatacaacaattgcaaagcatcactgctgtatattttcctccagctcagtgtggaacatcctgcaaacttgcatctcctgctgcagtcttgggttccagctgcatcacgggtaacacagcatctcctggatgcaggaagctgcatgcatctggaatgcttattaatttaccccacaaataatttactaaaggccaatcttcccagtggaaattattccatcgatttttgtgactttctgatgggaatgctaaaaagaagagttgt

SEQ ID NO: 642106 - DNA, 276 bp, Homo sapiens
ttatggtcctgtggatggtacggaagcagctactcctatggacagtgctcttgggcggttggaagtggcgttcagattcctgccagtggacccagccatggggggtggcctcagctctgtcggaggcggccgtccaccatcatgctacgtcaccacctcctcctccagcaggaagagctattagcactaaagtgcgtctgctagctctcggtcccacagtcctcaggcccctctctggctgcagagccctctcctcatgttgcctttcggagaaga

SEQ ID NO: 642107 - DNA, 144 bp, Homo sapiens
gatccccctggggttctggaggaaacggatggcggacaggtgctggctgatatgaggggggtgtgactggtgcccctgcgctgcccccgccgtcgtccctatgtcattctcgagtgtgggggggatccgtgcatacttcacgct

SEQ ID NO: 642108 - DNA, 653 bp, Homo sapiens
  misc_feature (16)..(16): n is a, c, g, or t
ccttgtcggtaccccncgagtattgggatatcgtcgaccagcgctgctcgcccagattggtgtggccgtccgggtgcctggaggtgtgcagggagcctggaatcccaaccatctcccttgacagacccagagcctgtccagaatctagctgcctgagagagggcgagaagggccagaatgggtgactgactcgtccgctggcggctgacttccctgcctgcctggcagaacgtggaacctgactgccctgaggcctgagctgctcgcccagaccttgtcatgactccgaggccagtaagttgggggctcctgccgcagggggcgaagaggagtggggacatgcagcagagacagctggggaagaaaaaacataggagacgcccgtccaagaatgacgcggcacctggaaagcgtactacaatgctgacctgggaagagaagaaaaagttcgacgagcaaacggagccttcgagactttcaaggatccagagccgagatgttcgccaagggccagccggtcgcagcccatataacaccagggcagatcctcaatggaatgatcaacgaccaggaggagccggatctcaagaaaccggactgatactccaaggggggccggcggccaaaatccgacgagaccagacgattgacga

SEQ ID NO: 642109 - DNA, 948 bp, Homo sapiens
ggagagagagaactagtctcgagttttgtgggtgttttttttccacgctaaattcattaattttcctggtataaaaaccctatgtggtacccacgaagctggagccctgattcccgtgcacggaaactcgggggggggtcttggacgaggttggttcagtgaacttcctgtgatagggagacttgggcttgaatacagtctcctttcgcagaaggctcgggggttcaggtaccgtgataggctctatagaaatggaattcaaggggtggccttatgggaaagattgcccagggtgtggcagttgcacgcccccggtgctgagggtgaaagcagcttcatcgaataccagccaatcagtgagcagcatctctaaggccacagggtgacggaaacgactgccagctgcccctgggagatgacaagggaatgaggcgataccagacaaaaagagccgcaggggccgtgatcaccatggaaaggaaaagagagtggtgggggcgcatatgacacgtattacttgtgatcacccccaagagtataacgccgtcgtgaccaacaaggagggagaccaaagtgagaaaagctttgtggccaagagatgtaagtggcgcccacaggtgaaatttgcggagatgcgaccaacactctcacttttgagaacacactatcaaacaaaccacaaaaagcaggacgtttgaaccattttgttgagcgtccccgcagaataagcaaaacgcaaaagtgcactttaaaaccgtgtgttgaacactgagcgaggaaaaacggggctatggactctatagcaacggttggcacttaaactctatcaaaaacacctctatccttatgaaaaagaacgggccccatagagaaaaaaaagtctcaaggaatttctctgcatttacccttaaaattaagggccggggaaaaaaacaagattaagcctcc

SEQ ID NO: 642110 - DNA, 170 bp, Homo sapiens
gtagatggagctgcctacctgtcagttttccccattatttcatcatcagtcagtggggactttgacaggtcctttctttgtccagtgatcactctgcaggccactgccctcactactctggatcatgacttctgtgcgcgttttgccgatccagcccacgaggggatcct

SEQ ID NO: 642111 - DNA, 348 bp, Homo sapiens
ccccctcccccttttggggtttttttgggggggggggttttccccaaacccccaaatttttttttaaaaacccccccttttgccccggtttttaagggggggtttaattcccccgggtttggggggtttaaaaggccccccaaacccggggcccgggttttttaaaggggaaggggggggccgaatccgggttgggggtttttggggccattaagggggcctttaaaaggggcttttttttttttggggggggcgggcccaagccccgggggttaatggtttaaaggttcccccttttttttttccccaaaagggggggaaaaaagccccccccccctttaaacccca

SEQ ID NO: 642112 - DNA, 1194 bp, Homo sapiens
agagcatatctgccgacacaagtaagtgaggaagaaatgatgtgagacgatgaagaacgagaaaatgaaaaccacctcttggtatgttccagagtcacggttcgaccgcagattcacggggatgagtgaacgaagcagagtgaagaagtgggtgagggaacgccgcagatgcatgcgccctgacagagggcgacatctgtgccacgacatccaccatgacctgtcgacccatcgagactcaagcaggagctgcccaagatacctgccggcacctgccagggactgccggagcgatcgagcgagcttccagctgccctgaacaggcactcgacgcgaggcacaaccctactgtcgcagctggctcctacaagagcccacacacagaccaacgaacaacacagcattgcacaactccgtcggccctcctcaacgccggccttgactcgcattgtgcagcacgtgacgacagcgcatcgcgctctaccccgcattccaaccgcatcgactgaacggggcagcactctacaccagaccactaccctccacagtgaccccacacaattccacaaacctctcgctcaacaccgctccaaggcagcaagactcgcgtagcgtggcggcaagacaaaccattgggaaccaatagcatctaaacatacgtagacatcgacacctactgataggcgagcacccgaaccatacccacgaagcccctgccttcggccccacccactgcaaccaccgcaccccctctacgctcgcaccaactacactacgatcgttgagcacatcactcccccattgcaccttgacatacccagcgcatagctcataggctcatgccaagcaataggaaacacacacattgcacagccaacacactccgcaacacccatggaaaccagaaaaaaacacataaaagaaacaaatacaaaaacaatgcctggatggaaacccaacggaccaggaccaacccgcaaaaaacagcaaaacgggaaagaaacacacaacatgagcaaacagcgcaaactacaggaacaaacccccgccgcacaacgaccaaacaacccgcgaacaaacaagacccacagcaggcgaaccgcgcaaccacaacagccccgcacgcggcaaaggaccacggacaaccaaacaccggaacaaccgacaatactgcaacggcgagcaccaaccaaa

SEQ ID NO: 642113 - DNA, 646 bp, Homo sapiens
  misc_feature (628)..(628): n is a, c, g, or t
  misc_feature (634)..(634): n is a, c, g, or t
gagaaaagaaaagaaagaaagaaagtgagccagaacaatcagacaagagaaaggaataaagggcatccaaatcagtaaagaggaagtcaaactgtcactgttcactgatgatatgactgtatacttagaaaaccctaaagactcatccaaaaagctcctagatctgataaatgaattcagtaaagtttcaggatacaaaatcaatgtacacaaatcagtagtactgctatataccaagagtgaccaagctaagaatcaaatcaataactcagccccttttacaatagctgcaaaaaataaaatacttaggaatatacctaatcaaggaggtgaaagacctctccaaggaaaactacaaaatgctgctgaaagaaatcataggtgacacaaacaagtggaaacatatcccgtgctcatggatgagtagaatcaatattgtgaaaatgaccatactgccaaaagcaatctaaaaattcaatgcaattcccatcaaaataccatcatcagctgggcacggtggttcacacccgtaatctcagcacttcgggaggccaaggtggatggatcacttaattgccagagctccaggtcagcctggccaatatggtgaaaccccatctctactagnatacanttgcccgggtgt

SEQ ID NO: 642114 - DNA, 303 bp, Homo sapiens
  misc_feature (181)..(181): n is a, c, g, or t
  misc_feature (283)..(283): n is a, c, g, or t
caataaattgttggtcattgattccccaagtttttcgcaataaaatctacagccatcaaaaagttttaacagttcgttttctggacaagtcgatgaatcaactttcatttgtcaaaagacgtaaaaaaaccagttttttataatcaaacgcttgcgcaaagcacatgaaaaaacgcaggangcagcaccaaaaaaagcagttattttataaacgcaactgttacaatcattctatctcggatgaaagccgtctcttaaaaaacaagcctgatcaatgccaacnattattaggggtcctgctag

SEQ ID NO: 642115 - DNA, 160 bp, Homo sapiens
gcggccgcctactactactactacactgctcgaattcaagcttctaacgatgtacggggacatggttgtctttgggtgccccaactgaccacacccccattcccccactccagataaagcttcagttatatctcaaaaaaaaacacccagggcggccgct

SEQ ID NO: 642116 - DNA, 335 bp, Homo sapiens
cactcaaaaagcatttactggagcatcacggtgtactagggggtggctaaaggctaggggggtaaggcagagaaattaatcaatcccggtaagagttcacggtaaaacagaaatgacagccatatgtgtatgacttggtgtgtgtgtgtctctatatctatcagaccgtatgactacatatatataagtgaggtatgggggacgcgacggacgacggacctggacctttcgaatttggactagaagatacaggacgggcttcatggaggacggtacaccttgggcccaggcttaacgacgacagggctaggcttgggaccaagtggacgaccagg

SEQ ID NO: 642117 - DNA, 925 bp, Homo sapiens
  misc_feature (73)..(73): n is a, c, g, or t
agcggacttcaaaatccgggtcaaagggtgtcgcttcggtctcttctccccggctgatcccagcactctccgngacagcgcctcctgactcagcccaggaccggcttcttctcacgacctgctggagactggacgcccacacctgacccggaactcggaggcgtgcttcctccacccgccggctagcagccccgggccctgagctcccgccgacgccgctggggggcccgacaggcccctcggcgctgatgctgagtgggatcgagggcccggggcggcggcggagtacgggcctctggcgccttaggccagcgcaggtgtcggttcttaggctctccaggctcgctagctcccgccccggcttggatgggtctccctgcgccataaatgtggctgctgaggcggcggtggccgtggcccgtcgcgctgctgctgcggcgctccaagttcatctccgccccggggctctcctgccccacctcggggctgcgcacccgtccttatcccctggccctggccttgcagcgtggcgacaatggacaagatcctggagggccttgtgagttcctcgcatcccctgcccctcaagcgggtgattgtgcggaaggtggtggaatcggcggagcactggctagacgaggcgcagtgcgaggccatgtttgacctgacgacccggctcatcctggagggccaggaccctttccagcggcaggtggggcaccaggtgctggaggcctacgcacgataccaccggccagagttcgagtccttcttcaacaagaccttcgtgttgggcctccttcatcagggctaccactctctggacatggttgtctttgggtgccccaactgaccacacccccattcccccactccagataaagcttcagttatatctcaaaaaaaaacacccagggcggccgct

SEQ ID NO: 642118 - DNA, 591 bp, Homo sapiens
tctaaaataataatcctgtgtgagattgcttaatatacggaacacacatcacaacaagaagatgtaagtgtgctgaaggaaccagcatgcggagtctcagcatcctccagggcttgccaagcttccgggagctccagaaaccggaattgggagttgttgagctatgaccgccacctcccgcgcgaagactgccgggctgtgcgactttctgaactcctgaggaggaaatgctggataaaccctgccgattccgatgaagccagaaaggagccgcaggcaggtcccctggagaacccgaagaagtggcctgtgaagtgaaagcaggccctgttgtagaccacagcaagcagggcaggtcttgcttgagaccccccagttctgggtctgacttgggggaaagcccccccattaacaggaggggaatttctttatccccaacagtaactaaggaggtggtgtcctgaactgattgcccaatgacagcatttcctcaaacttactcccacaagctactcaaccaacactatggggtgaatgaggcaacacaagccttgtttcttatgaaatgaagtgtcctctaccacttagcct

SEQ ID NO: 642119 - DNA, 434 bp, Homo sapiens
gctggcttcagaggagaaggtccagaagtggatgtgaaccgtgtcgcaagggctgatcttgacgtctcaggaccaaggtggaggttgatgttgccacgatgtgaatattgaaggtccagatgcgagactgaagggcccgtaaattcaagatgccagagatgaacatcatgatgcccccaggatctccatgcctgactttgatttgcatctgaaaggccctagggtgaaatggagatgtggatgtttctctgcctaacgatggaaggtggatctaaaggcccctgaagttgacatcaagggccccaaagtggactttgatgccccagatgtggatgttcatggcccagactggcatctgaaaatgcccaaagtgacaatgcccaaattcagcatgccaggatttaaaggagagggcccagaagtggatgtgaatt

SEQ ID NO: 642120 - DNA, 122 bp, Homo sapiens
ttcctgtctccatatacatatgatgaatgcaacctattgttttctatttctctcttttttcctgcctgccttttgttttcttcccttattgtgtttcagtcagtagttgagttcaatgcttg

SEQ ID NO: 642121 - DNA, 435 bp, Homo sapiens
ggtcgcatgatggacattcagaggacgctgaacgtcaatatggtgtcgaactccgagattcccattaataatctgtctccttgacccaaaacacttggaactaatgaccatgggtttctacagaatttaatgaccatgaaaaagcaggaacgatgattgcatcttgcaaggacagggttcttgaagttaggaccttggaaaaagcgatgcgggtttccccaaccttaagtacattatcgggaaggaccattgggttgaagcactgccttaagaaggccgaatgccaagacgaagagaaccagaaacaatgccaggacctcggcgccttcaccggacatggttgtctttgggtgccccaactgaccacacccccattcccccactccagataaagcttcagttatatctcaaaaaaaaacacccagggcggccgct

SEQ ID NO: 642122 - DNA, 312 bp, Homo sapiens
tctcagttgtgcatcgtgctgcagctcgtctcactgagtagagaagaatgaagagatcagagtggacgaaggattacaagtccctttgcaatgtcctagtcgaggatattttctatacaggccacggaatggaagaaggtcagcagggtgtcatttaaaatggatgccagctaatttaccacagagcaatgctatggaatacaaaatgtactgacgatttggtttgcttctgaaaaacatccttgctaacatgtactcggttgaaaatccctgtgtttgtcacttgtgctcagtcgtaacagtggtagtaac

SEQ ID NO: 642123 - DNA, 249 bp, Homo sapiens
  misc_feature (50)..(50): n is a, c, g, or t
  misc_feature (81)..(81): n is a, c, g, or t
  misc_feature (156)..(156): n is a, c, g, or t
taaaggggcttagaaacccttccactccctcaaccttccccctacctctngagctcccctgtcacacaaactcgacctcangacgcccgtcggaaagagtaccttactgtacttagttgaaaaaagaaacaaagtagaaaattcacatgcacgaanggacaagcacgtacacaagtatttgagttgtgaaattagtaccaaagtactcgtaatttttcgtttccccttttcccacacattaccacatgt

SEQ ID NO: 642124 - DNA, 115 bp, Homo sapiens
ccgcttgtgatggtgccgcagccgttccatttcggctttgcgctgtccgcctcgtcggtgctggggttcgtgtagactggcttcgtctcgtcgatcggatccatcaaagatgttg

SEQ ID NO: 642125 - DNA, 109 bp, Homo sapiens
atcatcattgccctgcagcctggtagtcgtacagtgcgactggatgtgatccccagatctgttctcgtactcgtcgtatgtgcttgtcctctgctgtggatagtggccc

SEQ ID NO: 642126 - DNA, 697 bp, Homo sapiens
  misc_feature (499)..(499): n is a, c, g, or t
gggaacgacggcggccatggcggcctcggggcccgggtgtcgcatctgtgtgcttgtgtcccgaggtgccatccgccagccttcttcactgcgctgctctcgctgctggtttccgggcctcgtcctgtttcctgctgcagcatgtcccctggcgccctcgggcctcacgcttgaaagtccgaggcccttcgcagactggcataggtcttaccaggctggtaagccttacatctttgttcttagcgatgaatcccagtctccctgtccctgcggcgcttctcagtcatctgggcagctttggctgggtcgctttcctgagtagcaaccgtgggcacgcgtccgcctactgcttcttctaccgttggatcttacggccgcatcttgctactcgctgagtcattctatccctcgtccagttccgtatgcgctgtgttccctcgacttgctcaatacggctagtcgcggacaagtggacgtgagttgccaggaggtttctacnctcccacgttggtgctctttgcccattgcttgggtagtcaccaccagtccgttctcctggatgaaggcgggcccttggtgtccaggcatggattcgtgcggctcagtcctggttccgtggctcctgctgggttgcctcgtgggtcattccccagaactttttcctcagtaatgtctgcgggctgtccctccgggctgg

SEQ ID NO: 642127 - DNA, 795 bp, Homo sapiens
  misc_feature (668)..(668): n is a, c, g, or t
  misc_feature (701)..(701): n is a, c, g, or t
  misc_feature (736)..(736): n is a, c, g, or t
  misc_feature (754)..(754): n is a, c, g, or t
  misc_feature (785)..(785): n is a, c, g, or t
ctccactcttctggtgtgagatgggaccggagggcggagaggggacgcggaagctcctatctctccagccacaatcggcacccaggttcaggcgggttcctcttctggggttgggcatcctcagatgcctgggggccggggaggcgggggcttcatctctgcttctgggctgcagattcgagattgccctaagccctctgacccggcctgtcctagcctctggctgcccttctttctgcctcttgttctttctgccttctgtctgcttcctgtctctgggtatgtccatctctctcttccctattctggctgtgtctgtctgctctccctcttgctgccttccctacctggctttgtccctctgcatcggtttttctgtgtctctttgtgtctcgctccctccctccacatctctccatctcactgtgtctctctttactaatgcctctctttgtctctgtctttatctctgtctctccccaaccccactccccagctctattcctattctctgggttgctgcctctggggactgaagcagcccaacagggagcccggagacgcctcggggcactgccgggggtcctcatcctggtcacctccacatgcccgtcaactccgcgcagtttggatcttcccgctggcggctgtgggacgtggaggggcgnccggaaaaggaagacacagggcccagcatctgnttcgggagccccggggcccctggacccccctctgnccatttattaagggcgcngggtcccgagggaccgagatgatcatgattncatcagtcag

SEQ ID NO: 642128 - DNA, 754 bp, Homo sapiens
  misc_feature (37)..(38): n is a, c, g, or t
  misc_feature (260)..(260): n is a, c, g, or t
  misc_feature (285)..(285): n is a, c, g, or t
  misc_feature (287)..(287): n is a, c, g, or t
  misc_feature (293)..(293): n is a, c, g, or t
ggtggaaccgccgccaggtcgctgttggtccacgccnnccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctacggcaagcaggaggtgactccgacggctggngaagaaggggttgccccagaattgnangtgtgnggtcagacgagccaaactgactatatctccacgattatgcctatggtgccactgggcacccaggcgtctttcccaccacatgttgcactctcgtcttcgatgtgtggagcgttctattaactgtgggatgtggacggggataggggctcctcctccctttagtcccccgtgtgtcgtgggacttgcgcccgtgggggggacttgtgggtggccctcacgagaactgttgtggcgcctgtgagatcccattattgggagagcgttttccgttgggtgtgtccactcccactttgctgatagacaactcttgcgcctgagctgagattgttgtgtctggtgtcacttcaagggctttggccttcccggacaacctcttggtttccttctctccccccttttcttccttcggtaatgttgttggtttaaccttaaaaactaattatgcgcaattaaaacctcaa

SEQ ID NO: 642129 - DNA, 367 bp, Homo sapiens
  misc_feature (23)..(23): n is a, c, g, or t
  misc_feature (35)..(35): n is a, c, g, or t
  misc_feature (78)..(78): n is a, c, g, or t
  misc_feature (141)..(141): n is a, c, g, or t
  misc_feature (147)..(147): n is a, c, g, or t
  misc_feature (152)..(152): n is a, c, g, or t
  misc_feature (164)..(164): n is a, c, g, or t
  misc_feature (196)..(196): n is a, c, g, or t
  misc_feature (201)..(201): n is a, c, g, or t
  misc_feature (224)..(224): n is a, c, g, or t
  misc_feature (226)..(226): n is a, c, g, or t
  misc_feature (291)..(291): n is a, c, g, or t
  misc_feature (317)..(318): n is a, c, g, or t
  misc_feature (325)..(325): n is a, c, g, or t
ggatagatggaattggaaggatnctaccgggaganttcttacatagtgctcaggagttctcgccgtaaaatgtttacngctgaaagatgagcaggaccagggcggtataggcagagccctagccgagaaacctgctggccnctgccngtttncatttcccgcgntggttgtgtggcattactttcagaattgcacnttccngcttgtcatgacgttttgacacncntgccatgacgtgtgtttctgtgaacatgaagttctgcggtagtgcctccgggggcagaggaaaanaagaagtgttactccgttttgtacgnnataaatncgggcatatgtttaataaaacggttctattgtagtaacttgt

SEQ ID NO: 642130 - DNA, 214 bp, Homo sapiens
tcctgggcgtatggtcattttgatgatactgattcctccaatcctgaacatgggatgttttccaactttgtgtcatctacaatttctttccatcagatgttttatagtctgtctgtcagagatccttgaactccttggtcaaatgtattactaggtatattattttattttcttgtaactgggattaagttcttgatttggttctcagcctgat

SEQ ID NO: 642131 - DNA, 443 bp, Homo sapiens
ttgtcaggggtatccggggagcttcgtaacctgaatgatgcgctctgcaatcagcaggcagcacggctgtgcaggcgccacatctgagacctggatcttggtcacatacggggttaggcggaatggctgtaccgatgtcctggatcccggtcaggacctcctctgatacggcagaaagacggacttctccttgggtaaagtcccttgagtgcttgaaccttgctgagtgcccctgtgccccccagtgtgggcagggcgaggatgggagcagttggaacgcataggaagacttcccacattcctgggggagccagtgagctccagagaaggcgggtaccccggaaacacgttccggcttgcaaacgcaagagggacggctggctgctccgaaattgtaacgaattcgggcccgtcaggacggagacagccactgacacgggcct

SEQ ID NO: 642132 - DNA, 843 bp, Homo sapiens
  misc_feature (37)..(38): n is a, c, g, or t
  misc_feature (349)..(349): n is a, c, g, or t
  misc_feature (374)..(374): n is a, c, g, or t
  misc_feature (376)..(376): n is a, c, g, or t
  misc_feature (382)..(382): n is a, c, g, or t
ggtggaaccgccgccaggtcgctgttggtccacgccnnccgtcgcgccgcccgcccgctcagcgtccgccgccgccatgggagtgcaggtggaaaccatctccccaggagacggtgagtagtggcgcgcggcgggtctggagtacctctgtccgctcgcgcgcaatcggcttcagcatgcccgtcttctgttctcctcagggtgcgcaccttccccaagcgcggccagacctgcgtggtgcactacaccgggatgcttgaagatggaaagaaatttgattcctcccgggacagaaacaagccctttaagtttatgctacggcaagcaggaggtgactccgacggctggngaagaaggggttgccccagaattgnangtgtgnggtcagacgagccaaactgactatatctccacgattatgcctatggtgccactgggcacccaggcgtctttcccaccacatgttgcactctcgtcttcgatgtgtggagcgttctattaactgtgggatgtggacggggataggggctcctcctccctttagtcccccgtgtgtcgtgggacttgcgcccgtgggggggacttgtgggtggccctcacgagaactgttgtggcgcctgtgagatcccattattgggagagcgttttccgttgggtgtgtccactcccactttgctgatagacaactcttgcgcctgagctgagattgttgtgtctggtgtcacttcaagggctttggccttcccggacaacctcttggtttccttctctccccccttttcttccttcggtaatgttgttggtttaaccttaaaaactaattatgcgcaattaaaacctcaa

SEQ ID NO: 642133 - DNA, 1715 bp, Homo sapiens
  misc_feature (188)..(188): n is a, c, g, or t
  misc_feature (536)..(536): n is a, c, g, or t
  misc_feature (900)..(900): n is a, c, g, or t
tccctataaatacttcttaatttattttaaaaaaatgtggtgcgtgtttaacccttttatcacggggacaacgaaggctattgttgaaagagttcacaaacacttttgtgctcaaagtggtacatcatgtgagaaggtgcttttgtgacgatagtctcacgtggtttatactccatcgtggaactcgnagtatattactctgggcgcaacggggacaagggtcctaagatatccccatggaacccaagtctggcaagaagattctacaaggtctaactataaggggcgagaaacagtatttgggagagacacaccaagaaagaaagggacaattttctttgctctatccacaagtgtgtttcacctcttttgcagagaactgtaaatagtgccacctctttctccttaactcaaagaggcccttctctttaaacacggtggtgttcaaacaataaaggagttttctcccagaaaacgagagccttattataaacacttctcctatttcacgcgccggagaagagagaggccacacnagagacagatgtgcgggtatcttcgcgtgggcgcgaaggaacataaagagtcaaccgaggccagagggtagcacaacaacactttattcttttatttcagcggtgggaagctctctccaagacgtgcggggtataagagcgccgcgtggatggtgttggtttctatgcccaaccgaaggattcttcctttcagacaaaagcgccggagaagttggggggcgcggacaaacatatacaatctcttcaaacacacatgtgcgtggttgtcctccccacaaacacaagtcgcttctccataagcacgacacgcgggtggctttctcaactccttacaacgcgtgcgttatcaccttagtggagacgncaagggggtgctacacagtgttttgtggggccccccaaattgcgggggactttccaggaacaacagtgggctccctattattttaccattgaaacgcaaggcatgtggtcctgggttcccacggcttaattacacacactacgagttgtgtctgggtgtttgagcacccccatatatttcccacaaaagggccccatgattaaaaaatcacgagaaacataaaacttgctgtcacaagggtttaaacaacccgagaagaaagatgttcaggttacttgaggctccccagaaattttctgcccgacatcgaagatttaattcccatttgggcttcagatgtgagaacattacctcgtcttcaaaaataattcgcgggggcgggggcccaaaacaaacagagggtgggtgggggccccccgacattaattctctcaaacagggtgtccccatccaaccttgaaaggcgcccggggcccacaacacgggggggtggaaaaccggtgggggagctccccaggcacacacacaagttgacataaacaccgtgtggtgtgcccagcgtaatagcccgcgcaaaagggggagaccacacaagacaaggggcagcagaagataacacagcgtggaagctacggaccaacaaccaaaagtagatgacagcaacaggggccgcacgacacaggagatgtagttacaaacacgcgtggaccgacgagcgtatatgaaaaagagtgagtgccaacgaagacagcatcggactacacacaactcaccgaattaaaaatcagaagaacgagtagcttattgagcgaaac

SEQ ID NO: 642134 - DNA, 238 bp, Homo sapiens
ctcgtagggactccaaaccccagtatccctctgcccaacactgtacctcagttcattgccagagagccatatagctcacagtgcctgcactttaccccagtagcccagaagtgtgggccccgtaccctgtgtacccagcggagttagcgcctgctctacctcctgctttcacctatccgcttcactgcatgcccagtgtttctctcctgaggcaaagcccaacacacctgtctttgtc

SEQ ID NO: 642135 - DNA, 1518 bp, Homo sapiens
agagagccctgagcagccccagcgccgccgccggcactagttaccatcacaccccgggaggagccgcagcatgccgcagccggccccagtcaccaatcaccgcaaccatgatgcatgctgatggccgagacccagcaagacgtgtaaagacgaccagaaaaaaggaagacaaaggaaaaagaagatagaagcggacacacatatagatgtaacaatatatgaacaattacgaaccatataatatagtgaacaaaataataggtgatatcataataaaaactaaataaaatataacataacgtaataacacatatagttaagcaaataagataataaagattattagagagacggaagcagaggagaaccacgagaaacaagaacacgagcaacgcttcagaaatcacaaaacgcacaacagacgcaaacgcaagcaacaaaatcgtaccacacgcaccaagaccgaccacaagacacaaacaaaacacaccaaaaagatacctccccagcgaggcaagtagcgacagtcaagaacccagacacgcacgagaggagaacgaaagtctcaaaaagaagccgaaagagaagacagacggcacgggggaagagcgcacgacatcaggcgcgcgagaggcgactaaagcagacagctgcacgccaccagcgagagaaacagaaacgacacaacacagagacaagcaagcccgaacaacacatcccaagaaacagagaagcgcgagacccatcaagaccaaaaccgagtgcacaggaccgaagcgaacaccagagcacagcgacagcgcagcactcagaagagagaagaagcacgaagacaagagaacggagataggagacgagagcacaaccggagagcagccaccagcgagaaagagaggcacagatcacaccgacacagcgacgactaccagccccagacgaacacgaagacagaaatacacatacgacgatgcaaagaaaaagcacagcgcgaagacacaagcgagaaacagaacagcagacaaaacagagagcgaggaaagacacggccacgagagcaagaacaacacaaacacaatgaaacacagatacaagacatagctgacatccaacgataaactgaccgacacaacgcaaagagacgaaagacagcggaagagaaagagagagctgcacgaacataacacaggagcagcagacaccaatcagagaggagagcgcgagcgacggtagcagctagagagaggcaggaggcgaagagagcgatacgagcagagcgagcaaaagagcaagcagagatcgaagacatagccgagagatcagagcgagcatagtacaaccagacacaggaccgaggtaagcagagcgaccgtacacgtcaagagcacagagagagacagctagtcccacagcagtgaccgagtcgtgcgcagcctgccggcagcacgagcgagagcacgggaacagtcgacgacggcccgaggcagggacagggcttcgctactgatccccttgtgcgac

SEQ ID NO: 642136 - DNA, 441 bp, Homo sapiens
ctcgtgcctactgtgatcagtatggcgctgacctgggttcttacagtcctgagcctcctacctctgctggaagcccagatccgattgtgtgccaacctaggaccactgcccatcaccaacgccaccctggaccggatcactggcaagtaggtatatatcgtataggcctttcgcgatggagtacatgaagtcgcttcaggagatccaagcaagcttagttgactcaactcacaacaagactgatgacacgatctctctgagagagtaccagacccgtcagaaccagtgctcatataactccagatacctgaatgtccaccgggagaatgggaccgtcttcagatactagggaggccgagaacatgttgctcacccgctgatccttacggacaccaagaccttgatgtcaggatactacctggacgatcagatctgtgcgct

SEQ ID NO: 642137 - DNA, 632 bp, Homo sapiens
  misc_feature (224)..(224): n is a, c, g, or t
  misc_feature (243)..(243): n is a, c, g, or t
  misc_feature (281)..(281): n is a, c, g, or t
  misc_feature (301)..(301): n is a, c, g, or t
  misc_feature (311)..(311): n is a, c, g, or t
  misc_feature (321)..(321): n is a, c, g, or t
  misc_feature (325)..(325): n is a, c, g, or t
  misc_feature (335)..(335): n is a, c, g, or t
  misc_feature (339)..(339): n is a, c, g, or t
  misc_feature (348)..(348): n is a, c, g, or t
  misc_feature (358)..(358): n is a, c, g, or t
  misc_feature (362)..(362): n is a, c, g, or t
  misc_feature (365)..(365): n is a, c, g, or t
  misc_feature (373)..(373): n is a, c, g, or t
  misc_feature (375)..(375): n is a, c, g, or t
  misc_feature (391)..(391): n is a, c, g, or t
  misc_feature (402)..(402): n is a, c, g, or t
  misc_feature (415)..(415): n is a, c, g, or t
  misc_feature (420)..(420): n is a, c, g, or t
  misc_feature (424)..(425): n is a, c, g, or t
  misc_feature (450)..(450): n is a, c, g, or t
  misc_feature (456)..(457): n is a, c, g, or t
  misc_feature (463)..(463): n is a, c, g, or t
  misc_feature (493)..(493): n is a, c, g, or t
  misc_feature (495)..(495): n is a, c, g, or t
  misc_feature (497)..(497): n is a, c, g, or t
  misc_feature (511)..(511): n is a, c, g, or t
  misc_feature (515)..(515): n is a, c, g, or t
  misc_feature (519)..(519): n is a, c, g, or t
  misc_feature (523)..(523): n is a, c, g, or t
  misc_feature (544)..(544): n is a, c, g, or t
  misc_feature (555)..(555): n is a, c, g, or t
  misc_feature (564)..(564): n is a, c, g, or t
  misc_feature (569)..(570): n is a, c, g, or t
  misc_feature (604)..(604): n is a, c, g, or t
taaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacacgcacccagacttcatgcgcccgtggaatgctcaccacatgttggtcgaagcggccgaccactgactttgtgactnaggcggctgtgttgcctantgtatgaagaacagcgcttcacccccatctcccgcgtncaggtgcgcacagggctttntttgagaatngggaaaaccntttnaaccccgggncatncgggacatnccaaacgcantgcnccntggagctnanagccttttttttggtnttatttttttntaacaaggggcgnggatncctnnaccaagaagaatttttttttttttnagtttnntggacngcgtggggactattggagaaaataaggggntntnctttttttttttanaatntttntctnagaatgttctagggcactctngggaacctatnaaggcaggnatttnnggccctcctcttcaggaatcttccttaagacatngcccagtcgaaggcccaggatggctttt

SEQ ID NO: 642138 - DNA, 963 bp, Homo sapiens
aaaaacgggggggtccccgcgcgggtgttccccgagctttgtgagagcacccaccgcgccgccgcaagacgttggggcaacaaagcaccctcgcacacactggtttgcggccgcgcggctccgcacaagaggaagggccgcctctggttgagacgctgcgcccgccaccacgaagaaacaacaagagggtcggtgggaggagagatacgcagcgacccttctctgccccccctgcgccgcgggcgcctttctttggaagaccaacaggggggcctccaccgcgcagaagatagagagggtctcccgcgtgtcttgggagaacacaccgttttcccagagggggggttcctctctcgtctcccccccccctctcatgaggcccgcctggttgcggcccctctgcttcttgctgttttgttggttgggggaggtggtggttgagacacacgccgggagcgaggggcattgtcttggtgtggacgcccgccacccgcgggcctcgctttgttttatattgttgttgggtggccgcctcgggaccccctctgggcacgtgttcttttcctccctctctctctcgggggggggaggattccccgccccgtgtagacgcctcaaccgcgggacagagaccccgcgccaccatcaccaagacatgtgggggcagcggcgcaccactctggccgatgtggcccaacccggagtaggggcacccaccacgacgtgctctttccatcgaaccccccccttccccaccgacgtatgtggggaagaagattgtgaagaagttttgcccgaaaacccccacagcaagacctgtgggaaacaacaaaaaacccacgggggggttttgggggggcccccccccccttttttaaaagacccccccttttttctcccctgtgggcccaaacccgcggtctttgtttgggggtaaaaaaaaacctttggggggacccccca

SEQ ID NO: 642139 - DNA, 537 bp, Homo sapiens
agacataatcactaatgacccaacgctacatctggcctggaaactctttcttttatatctcccttccctctcttctctctctctctctctctttctttatttgagacagggtttcactttgtcacccaggaggctggagtgcagtgatgctatcacagctcactgcagcctcaacctccaggctcaagcgatccccctgcctcagcctcccaagtagctgggaccacgggcacccgccaccatgcccggctaattttgtgcattttttgtagagacagggtttcgccatgttgcccaggctggtctcgaactcctgagctcaaatgatcctcctatcttggccttgccatatgcaaaggccaagaaccacgtgacgaaatttgcatatggcaaggccaaagggcatcaactccaagccaaaggtctgttcctttcttgtctaatatctcgaaatagttgattccatacatctccaggtcctgagcactcttcaggtattccaacatagcattatctttgagcatcccacggtgtccc

SEQ ID NO: 642140 - DNA, 635 bp, Homo sapiens
  misc_feature (578)..(578): n is a, c, g, or t
taatgtctgtgagactttcggtaaaatctaaagtacctgtatctgttcaactaaaaactctatatcagtccttgggaaacctctcatcgtcaaaactttatgttcactttgctgtgtagatagccagtcaaccagcagtattagtgctgtcttcaaagatttaagctctataaaattgggaacattatctaagatcattttccctaagcattgacacatagcttcatctgaggtgagcatatggcagctgtcgaatctgcatctgtgtctgtctacccaagagtgcaaaatacagtgtttacttgaactttcaactttgtaactgcaaagaattccagttcagccggacgagcatgagtatatcaaataagctcgtccgtaaggattttcatgtaccaccaaattgtttggattttttctttccatcttcacataccagggtcattaaacagtgtgtttccttaaacactcatattacagttccacaggtcaaatttcgtcaatgcgtatttatttattccagcccaggaactataaacgcacgtttcaccatatatgaccctcagaaggtggaaacntaccccaagatctaagtttggcgtcataacctccactatggcttattcctggggaaa

SEQ ID NO: 642141 - DNA, 935 bp, Homo sapiens
ggtagcgctcgacacacacgtatggttttcctcgtgtcgtaattggccggtccgtcttcgaccgtccatcgggacctccactgagtctctcagtgccatccctgtagtcgtctctgtaaccactcatatgtcatggacggatggttccacgactgtcactttccggtgtaggtttatggctcagtcagtttcaatctgttcaccggatccactgttgggacttccccccttcgttctctggttgccaaacctttcattggccggtccttgctgcgatcgatgtctgtatgatggttctcttgctatttgtcgtggcgttaactaaggagtctgggggcttccctacgtcgttggcgctgcctgtttcctcctctgatctctcaatggcccgtctctttggactataaggaggtgtcttgcgtcccgtccattttgggtgtctggcgatgttccgatcggacagttggtagtcatgggtggtgtccactacgaagcggctatgtgggccgatgcgtgttcctatctacgacaatctaatccaacgtcagtcctttgcgtcttgtcaggagatgccctcaatgctggctgtcatcatagaatgcgtggcttgccgagcggctggagcgcgcggctcattcaagcagtcatcattcaagtacagaggtcccagccagagtgaggcagctgcagctgcctggactcttctgcttgtcacttgtcaggaatgttgttttggtaccaccacagggaatactgcgttcaaatcaacgtatttatatggtatctgctgtgactgcggcacatacaccccagcgcgcacagatgcgtgtgacccagaggcgtagatcgcagctttgtcctgggagacgttcatacttggaatctatttaacgtgcttaaagaaccttttatatatatatatatatataaatata

SEQ ID NO: 642142 - DNA, 234 bp, Homo sapiens
ttgctaccccttctttgtggtatccctatgtgggataattatgagcgtgctccatctgcctgcgacaaacagacctaaaatcgctcattgcatacgctgcaatcggccacatggccctcgctagtaacaggcatgctgatccagagcccctggaggcttcaccggcgcaggcactttcagtatatcggccaggggtctacatcctcattcactattgtgcctcagagtagagca

SEQ ID NO: 642143 - DNA, 351 bp, Homo sapiens
agacagggtcttggggaaaaaaaaaatttaaatgtgagaagcggttaggcttgtcaggagctgttggcagacaatgaaagcttttcaaatgtctttaaaggtttagcatccctactctacaccctcatccaatggtgtaagatgactcgctgtcccccaaatactcttgtagacttttatgcctttgatcatggctgcttgaccttacatagtattcgtgtcacttgctaaagctttgcttatcccttatacccacctggaatgacatactcctggagagatttactcctttagccgcgagctcattgctttccactatgacggcatttgcagtaagtcttcccgggcaag

SEQ ID NO: 642144 - DNA, 335 bp, Homo sapiens
attatgggtactgagcagatgcagcgcagcctccaggacgggtgacctaatggccagaaaggagccctgaacggtgcaaggagccctaaacagccaggaggaagaagacgtcattgtcgcagagggtaagccggcccgtccaggaacggggaggcacacagcactagcaacaaacttgggactcagcagaaaatactctgtcatactgcctggtggtggattggtgttaacagcaaaaacaatcaattggttacaaaaggaagtatgtatctgaccatttggataccccctatacttagaccttgaagttatgtttcctttttcttatctggaac

SEQ ID NO: 642145 - DNA, 460 bp, Homo sapiens
  misc_feature (60)..(60): n is a, c, g, or t
  misc_feature (134)..(134): n is a, c, g, or t
  misc_feature (329)..(329): n is a, c, g, or t
  misc_feature (409)..(409): n is a, c, g, or t
cagaaattatgcaagccggaagacagtagggtgaaatttttaaagtgtttagcaaaaaanacaaaaaacaaaaaacaaaaaactactaacctagaattccgtaccctgtgaaattatccttcaaaaataaaggngaaataagacaaaaatcgatcatttaaggatgcagagaaaagagaactcttatacattgttggtgggaatgtaaactagtacatccactatggaaaatactacggggatttcacaaaacactaaaatagagtccatttggtcagccatcccactattgggtatctcctcaaaggaaaagaaatcaatatatcacnggggtggctgtacttacacatttattgcagcactattcctaatagcaaagatatcaacctgtgtgtctatcaactaatgnatggataagtgttacagatatacatatacatacagatgtacatgtatatat

SEQ ID NO: 642146 - DNA, 349 bp, Homo sapiens
tgctcgtaccattcattgcggtgagcatcttacaaaaaaaacaaaaaacaaaaacaaaaaaacattaaggcctggcacggtggaccacccgagtaatcctagcactctaggaggccgaggaaggtgggatcacctgaggtcaggagttcgagaccagcatggccaacatggcaaaaccccatctctactaaaaataaaaaattgaggccaggcacgatggctcacgcctgtaatcccagcactttgggaggccgaggtgggtggatcacgaggtcaggagttcaagaccagcatggccaacatggcaaaaccccatctctactaaaaataaaaaattggggccgggcac

SEQ ID NO: 642147 - DNA, 125 bp, Homo sapiens
atgagccccgttcattaggaaagatgccgcacattagtaaagattccgggattagtaaagatgccgcttattagtgaagatgccgttcgttagtaaagatgccgagcattagtaaagattccgct

SEQ ID NO: 642148 - DNA, 198 bp, Homo sapiens
aacgccaggatcttaaccaactgtagcaaggccagggatcgaacacgcaactcatagttcctagtcggacccgctaaccactgagtcatgacaggaactccgatctttttgaaatttaaacacattagaaagtagccagccggttggaattattgatgaaaagaaactgctctcctgaggcctgtgctccttaggaag

SEQ ID NO: 642149 - DNA, 147 bp, Homo sapiens
gtgctgggattacaggcatagtatgctcccagccagctttgacattctttgtatgtagctgtcacagctggcaaagactaacgtaaggcacatagtctcagcatgaagaaagtgtgtcatttggctgcgtttaatcctcgctgctcc

SEQ ID NO: 642150 - DNA, 201 bp, Homo sapiens
tgtcgtactgttgtgtaaccgtggtgatacgagtaatggggatagtggagctggtggtgacggtgacgtggtgacagtggtgacagtgacggtggtgacagtggtggtggtgacagtgacggtggtgacagtgacggtgacagttacgtaatgacagtgatggtgatggtgacgttagtgacgtttgcttgctgccactgt

SEQ ID NO: 642151 - DNA, 226 bp, Homo sapiens
ggaaaggccaggtttccggggggaaggcttaggcagtgacaccgagcccagcctcctcctccagccaggaaggagaacgaacacactgagagagatgagcgatgggtcacagaccgggatggaagaccggcgggcagagagtgccgggaaataggagggaagtacaggagacgaggacggaggaagaagcccaaaagagcaggtgcagatgggcacccggccacca

SEQ ID NO: 642152 - DNA, 210 bp, Homo sapiens
tcgagctcggtaccggaacaggtagctgccgcgctcgtcggggttgcgacagcgagtattgccgcgtgacgccggacggcgcggtgacgtcgatatgggcacccggttcgtacgcatcgaacggctggccgtcgacgcgcgaaacccgaaaacagcggatgtcctgcgccgcgtcgatcagcgcgtcgatccggacttggtggcggttcg

SEQ ID NO: 642153 - DNA, 729 bp, Homo sapiens
  misc_feature (511)..(511): n is a, c, g, or t
cggggtcgcggacgtggacggggccggggccgaggccgcggagctcgcggaggcaaggccgaggataaggagaggatgcccgtcagcaagatgagccgattggtcaaggacatgaagatcaggtccctggaggagatctatctcttctacctggccattaaggaatcagagatcattgatttatttctgtgggcctatctcaaggatgaggttttgaagattatgccagtgcgcagacccgagccgtccagcgcaccaggttcaaggcattaggtgctatcggggactacaaagtgcacgttggtctgaatgttaagtgctgcaaggaggtgttcaccgacatacgcggggccataatcctggacaagctctacatcgtccccgtgcgcagaggctactgagtgaacaagatcggtaagccccacactgacccttgctaggcgacaggccgctgcggctctgagctggtacgtctgatgcctgtacccagtggcactggcatcgtgtgcgnacctgagccttacaagctgatcatgatggctggcatcgatgactgatacactctaatccgaggctcgactgtcacccttggactgcgacatgggcacttttggatgccatatgtaagacctacagctacctgacacaggatctatgcaagcaggactggttaaccaagactcctatcaggagctcactgccacctcggtgagctcaccagtgtgcggg

SEQ ID NO: 642154 - DNA, 792 bp, Homo sapiens
gtggctcacgcctgtaatcccagcactttgggaggccgagacgggtggatcacctgaggtcaggagttcgagaccagcctgaccaacgtggtgaaaccctgtctctactaaatacaaaatattagccggacgtgggggcgcgtgcctgtaatcccagctacttgggaggctgaggcaggagaatcgcttgaacccgggatggcggaggttgcagtgagccgagattccgccagtgcactccagcctggacaacaagagctaaaactctgtctcagaaaaaaaaaaaaaagggtccctggaaaaagtcgcaaaacagcgagcttttcgccagttgccagggattccggttaaaacgagagagactaacgggagggagcgcgagcatagcgcgcgagagagagagcgagagcgcgcgcgccgatgacgttcacgctcggagtctcggccatcttagctgtaggatagaggcggcaacctcgcgaagtgcggagcgggtgggcctatataaaatgtcgcaggtgcggaggccgtgggctttgtgctggggcctggctgtagccgaagacagcggtaattgccacgcacgggcttatgggctggtggggtccccgcgctggcttcgccttttcatacccggatggagctgtctcgataccgggtggcccaggtggaccccggggccttgtactttggcgttgctcggccgtgtcctacggatgtgtcctccggccggaaggcatacgagcctgggctcccactataggcgcgttccggggcggagaccgcatccag

SEQ ID NO: 642155 - DNA, 529 bp, Homo sapiens
ggccggggcgcggtggctcacgcctgtaatcccagctctcagggaggctaagaggcgggaggatagcttgagcccaggagttcgagacctgcctgggcaatatagcgagaccggttctccagaaaaggaaaaaaaaaaccaaaagacaaaaaaaaaaaaaaaaaaaaaaaaaaaaattttggggggggcttgggactagaaaaagtgtttttaaaaacattcggtgtgggggggggggccccaatttttggtttatgtgcaaaatttgggcaaaagggggtgcccaagaggaagacccaggtccggcatgcaaccacgaggcgggtgggattttcccccaccccaaataaaaaaaaaggccggcgggggagcacacacgggagggtgttggtggaacaacaacccaccaagagggggaggtcccggggaggcccacgacgggtgatcacaaacaacaagagggggtcccaaggggaggaccacacaatcacaaattccccccgcggcgcggggagaaaaagaaaaaaga

SEQ ID NO: 642156 - DNA, 772 bp, Homo sapiens
tggcccatgccacgatcatccccaaggtcttcgcccatgctccggagaccccatctaccctgcaccgcatgactacgctcttctgcatcaatgtgctgtctgaggtctattgggcaggacatcaccaccatagcacatgctacccacgtgttctgcgcatgtgctggggacccggttgccaatgtccgcttcaatgctgccacaaagtctctgccagaagatagggcccatccttggactacagcaccttgcagagtgaagtcaagcccatcctagagaagctgacccaggaccaggatgtggacctcaaatacatttgcccaggaggctctgacatgttctgtctctcgcctcgatgactggacgaggagctaaactactggcctctgggtagtccaccctccgaaccctcctacaagtcccatctttggggagacactaggaggggcctttggctgtcactccctgtgcatggtctgaccgcaggcccctgtcccccagcaccggttcgccatccgtctccccagccttgggaagatcgtctcacatgtccacctcccaacgggctaggggagcatcggggttcggacaggacagtgaccttgggaggaaggggctactccgcccacgtcagggagagatgtgagcatcccgggtcactggatcctagcatgctgtaatgggaacccctcccaccatttacattctccacctcccgtcctccccatcagcggtttttttacgataccccctggcctcgtctttatatata

SEQ ID NO: 642157 - DNA, 398 bp, Homo sapiens
  misc_feature (49)..(49): n is a, c, g, or t
tgcacctgcgtttagaggatcccacgaacaccgccccgtcgatggttanagcaccctacatcctcatcttgcaccagtcacgtcagtgccccagacccagcatatttgcaatgcctctgtgccgtccaaggaacgttaaatatcaataataaaaacagtaacaatgaccagcaaggaccccagtttctccacttgctagttgtgtgatcttgaagaacctgaacttctccgagccttagttagctcatctattacacatgagggcagtacttctacttgcctttgtagagctcttgggacaggtcacgactgtaaagccatgagcaaggccttggtgcaattccacagaggaggcaacagtgttagttgacggaaagaaagaggagggatgggctcgt

SEQ ID NO: 642158 - DNA, 854 bp, Homo sapiens
  misc_feature (308)..(308): n is a, c, g, or t
gcaaaaggggaggaaattgaaactgagtggcccactatgggaagagggtgaaagcccagggctacatgcatggcctctgggtgacaggcagaggctaacatggaggttcggatgcgaccttggcctggttggccatgaccatctttgtagctgtctgtcagtcactatcatcagtctgcttcaccttgctcctgcttgctagcctttacaaggacgttgccgcgaccacgtccggttgtcaccgacacctagcatccaccacttgtggatgcagtgccccttatcctcagtcctccaagatgtgccgncccagtgctaaccctggaaccaagctaccagggctaccagcaccatgaccgcctcagccaggggatgccagcagtcagcctacccaactgcagtacccatgcaccttactcagtccagcccatgggcccaccgggctaccactgagaccctggctggattgagcatgctgcgccctagcccgccagccagcctccttacaacccggtactacatggatgccccgaaggcggcctctgagcattccctggccgtctctggctgccacttggttatgtcgtgtgtgtgcgtgagtggtgtgcaggcgcggttccttacgcgcccagtgtgtgctgtgtgtgtccaggtgcggttccttacgccccatgtgtgctgtgtgtgtcctagactgtatatgtggcttccctctggtgctgacaaggatggggaacaatccttggccagagtgggctgggaccagagtgcgctctcttcctcagctgaaggttctgcttcctaaatctcaagccacatcagagcatggggtggcgggggagcccctgtgaagg

SEQ ID NO: 642159 - DNA, 232 bp, Homo sapiens
ggttttggggggggggaaaaaaatttttttttggccccgcgcccaaaaaggggaaaaatgggggcccccccccttgttttttaaaaggggggggggggggtttttttaaattttttgggggggggttaaccagggtgtttttcaaaatcccccccgttccccctttggggtggccggggccctttctttttaaagtttttttttatttttttcccggctttcccccaaatta

SEQ ID NO: 642160 - DNA, 591 bp, Homo sapiens
agcggagagactgctgagcccgtccgtccgccgccaccacccactccggacacagaacatccatgctcatggataaaaatgagctggttcaagaaggccaaactgggccggagcaggctggagcgatgatcgatgagcatggcagcctcgcatgacagtctgtaactggagcaaggagctcgaattatccgaatgaggagacggaatcttcgtctcgagtggctggatagcaatattgttgtcaggatgccctgtagcgtcatctaggatgggtccgtctcaatgtacttgaacaagacgacggaaggtgcctgacgaaacacaacagcagatggcgtcgacgaatacatgagagaaaatctgagacggagctaagagatatctgccatggatgtactgtctctttgggcaaaagtgcttgatccccaatgcttcacaagccagagagcaaagtcttctatttgaaagagtgaaaggagattactaccgttacttggctgaggttgccgctggtgatgacaatgaaagggattgtcgatcagtcacagcaagcataccaagaagcttgtgaagatcagcgaaaaacggaca

SEQ ID NO: 642161 - DNA, 483 bp, Homo sapiens
aggaaaggttttctctctatctttaaatacaatttttttttaaattttatcctttctacaaaaaaatttttttatttacatacaattatattaattgatggaactgctaaaatttttttaaaggggatcacttcttgccctttgttcctggttttattccattatttttttttttctcttagagggctaagtggttttatttctcttaataatagatttgcataagtcttttcctttttgtaatgtttctaacctattttattcttaatcactttttagtaaataaatattaaatattgtcctattatcaataccacttcccttaatatatataactctttatactctttatatcacattattacttacaccttacactttaattcattctaatggttcaattttaacttaatgtaattattctttttaatcgatctatgccccttgtaatatccatacatttagggaatcacgttctttaaa

SEQ ID NO: 642162 - DNA, 131 bp, Homo sapiens
gcgaatccaggtgctaacggtctcagttgagaactgtggtccccctgagaccccagtgtcttcctggtctggctggtacagcatggtgaaccgttgattctgctgacttggtacctgatgctctgaattct

SEQ ID NO: 642163 - DNA, 117 bp, Homo sapiens
aaaatttggccccccccgggggggggttccccccgggggttttgaaaaaaaaggccccccccccccccccaaaaaacaagttttggggaaaaaaaaaagccggggttttttttttta

SEQ ID NO: 642164 - DNA, 476 bp, Homo sapiens
caaagattctcctttatgtctgtgcttgtcgggaatccccctgactcccaaagatggggtccctgctccgtctcacagggatctattagtatatgtggcttagccatcatacatttgccagtgttgtttcatcatctgcctaattatactgttatggaatattgacagttcgttatctaatcgttactacagattatgctggagtgagcaatctctgtgtacataggttctagtactcctattggaatattttctttatataggcgttttttatatattcacttttttttgggagacaagagtcttgctcctgttgcccaggctggattgcagtggcgcaattggagctcactgcaacctccatttcccgggttcaagtgattgtcccacctcagcctcctgaatagctgggattataggtgcatgctaccatgcctggctactttaggggttttaagcagagaacagggtttcac

SEQ ID NO: 642165 - DNA, 241 bp, Homo sapiens
  misc_feature (26)..(26): n is a, c, g, or t
  misc_feature (37)..(37): n is a, c, g, or t
  misc_feature (195)..(195): n is a, c, g, or t
aagcaatcctaagcaaaaagaacaantctgaaggtgncatcacattacctaacttcaaaatacactacagggctatagttaccaaaacagtatggtactggtaaaaaagtagttacatagaccgtggaacaaaatagagataaagccgaatacttacaaccaactgatctttggcaaagcatacaaaagcataanttggggaaaggacatcccattaaataaatggtgatggggaaaattg

SEQ ID NO: 642166 - DNA, 385 bp, Homo sapiens
  misc_feature (168)..(169): n is a, c, g, or t
  misc_feature (274)..(274): n is a, c, g, or t
  misc_feature (281)..(281): n is a, c, g, or t
  misc_feature (295)..(295): n is a, c, g, or t
  misc_feature (307)..(307): n is a, c, g, or t
  misc_feature (327)..(327): n is a, c, g, or t
  misc_feature (332)..(332): n is a, c, g, or t
  misc_feature (337)..(337): n is a, c, g, or t
  misc_feature (369)..(369): n is a, c, g, or t
aaaaccccacaacagcctgttcccaagcaaaaccagctccaactccagagcagggcaaccaccagggcaactgtggcagcaggcaagaaagaagaacattatgccctatgtcctttgaagagccttcctgcccgacctgtggccagtgtgtgcctcacctgtgtgagnntggcgatgggaggagactggtcagctctgcctccacccactgtgcccagcctccctggtgcttgggaagagagcagggttccttacattcagctgctgtcccttngtctttnccaagggtgccccnggttcatttagnaattttgcctcttgaaaggntgctnaaaancttgggttttggtaaaatttaattcggttcantggggctttttttggg

SEQ ID NO: 642167 - DNA, 453 bp, Homo sapiens
tacagattgtgagacaccgcacaatcaatttaaactcttcatgtctggactgatatatcctaggtataagcctaagaaaattgccttaagtaagactgaacagtgccttgactctcttgctctcagacaaatacccaactttccagagtgtatattattgaaaaccacaaaagttgaaaatgggagacagctaacttggaaactctccctcatccctctttctctgtcattgtcagagtcagtgataagaatgagaggtaagtgctcttgcccatgtatcgtacttttgcagtggatggggtccttgactctctgagagtcatggcccttaagaacatctggagcagccactgaggactttgtcagcaacttctcattccaggcaacaacccacagtggcagccagcagccctcagctccgcgggaagcggtaggggggaagtacgtggactt

SEQ ID NO: 642168 - DNA, 238 bp, Homo sapiens
tgagtatgtcggggcaggtgcttcggggcgggggattccacgaggtgaagtcgcgtgcaggtatagactgagggtgtatcggcccggaggaatgaggttgggggagtggtagacgtgggttggttcggggaatcggtgaatggggggagggagcgtgcgcgtatgtgaccctctggggagtatccccgaatttccgtggtgtggcgggatttgtgtgaggggagtcgaggggggacac

SEQ ID NO: 642169 - DNA, 636 bp, Homo sapiens
taaccacttctgctgtcatggtagtaggggaaggtaaattgggaaatggcattgacataaaatgaaaatgtttacggacacttttctttttggcttcttcactgtgtattgtgataaagatccacgttaaaagcttcatcgtggtttttctccgtggtttcttcgttgttttccccccaagaggtggtactgtcactgttttccactaaatggcgtgctctctataaagggcatgtgctgaatagcagcagtcacagagtgaacctttataagatgtgccacgaggtgacgttaaaacttacatcacttacaacaagagctaacttaacatatgtcactacacgtgggcaaaatattcgatttcctccattctaacaaatccatagtttcacaccgtggtaaagccagaatttcacacccctcagctaatatgagttcaaaacacacactgcggggctaaacagggggggattctacagtgcctcgggggaattagaatctccgcccattagtctacgacggtggcgacaatttataatttccctcccatcttacacgcgataacacttcaactggttaatttcccccttaaattgcgcattaacaactaccactgcgctcgtgtcaccctacaca

SEQ ID NO: 642170 - DNA, 493 bp, Homo sapiens
cgagtccaagctgattctcctgcctcagtctcacgagtagcccggattacaggtagtgcaccaacacacccggctcatttttgtatttgagtagagatggggttcaccatgttggccaggctggtctcgaattcctgactttaagttatctgcccaccttggcctcccacagtgctgggattacaggtgtgagccactgtgcccagcctacctggctacttttacatgtatttgtagagatgggatttcactatgttgcccaggctctcaaactcctggcctcaagcagtcctcttgccttggtctcccaaagtgctgggattacagatttgagccacagtgctggctggtgctcagatcttgaacagtcagaacaatatactgttgaagcaaatttaaaagaaatataaaaggacaacgttagcaacagttcttaccacgtagatggaacatttatcatttttccaacctccctgctggattttaccaaagc

SEQ ID NO: 642171 - DNA, 842 bp, Homo sapiens
ttttcgtttttttggaaacgaagtacactcttgtggccaaggctggagtgcaagggcacgatctgtggctcaccacaacctgccgcctcccgaggttcaagcgattctccgtgcctcagcctcccaagtagctgggattataggcatgcgccaccacgccgtggctaatttggtattttggttttagtagagacgggctttctcccgacgtgaggtgatcccagagtgctgggattacaggcatgagccattgcgccgtggcctagaaaagcagtttctaaaaccaggtgttcttatttcctttccagtttcttcgtgttcactttctacattcaacttcagtttaatttcaatgagacttagagactttccctaaaatgccccgagatggctgtggggggatatagtcaagtcaccagagttcaagccccagcaactacagggctttacaggaagtgttcgatgcaaattggtatattttagaccggaaacgtgctccttttttttttatgtttttttccgcattttgggaccggggtgtgtcctccctcgcggggttcgggactccaaaaggtgggacaaaagtttcaagttcaaaattagccaacagagtttttataatagctaaagtgggtggtgaactgggtgagtggcccctgggagagttttcatccgtgtcctcataaaattttccccaatactacagaatcccagagagaacccaaggttcccaattgcgggggtatccggacattggggtccatcataggggggccctcaaccctcttttaaaattgagcctttcttaaacgtgcaagaacgggaagagaaccagaagtggg

SEQ ID NO: 642172 - DNA, 421 bp, Homo sapiens
tgtcggccaaaacaaccccgcggttggcacacaggtttaaacacctgcctggggctcctccctaaaggaccctgcctgaaagcaaaaatggaggccttttgttcccggcggattttttgttttatatcctacaatgtgctttgcttgttgctggggggaaaatgttttccacaaatgaatttttcctccaaagggggatagggccttgggcccccctttttcaagggccggggggggggttttccattggatttgaaaggggggcccttttttagtccctgttactcaaatgtttacccccccgggggccccccccgtcccccaaaattttgggtgttttcaaatcacgggtcccttggggcggttttaaacccctgtttgccccgcctttttttttttttaaataaggttagcccctcca

SEQ ID NO: 642173 - DNA, 588 bp, Homo sapiens
  misc_feature (26)..(26): n is a, c, g, or t
  misc_feature (138)..(138): n is a, c, g, or t
  misc_feature (215)..(215): n is a, c, g, or t
  misc_feature (220)..(220): n is a, c, g, or t
  misc_feature (281)..(281): n is a, c, g, or t
  misc_feature (300)..(300): n is a, c, g, or t
  misc_feature (400)..(400): n is a, c, g, or t
  misc_feature (417)..(417): n is a, c, g, or t
  misc_feature (464)..(464): n is a, c, g, or t
  misc_feature (469)..(469): n is a, c, g, or t
  misc_feature (489)..(489): n is a, c, g, or t
  misc_feature (582)..(582): n is a, c, g, or t
  misc_feature (584)..(584): n is a, c, g, or t
  misc_feature (588)..(588): n is a, c, g, or t
attatgtttttttcaaatatattaanatcactaccatcttgtttgtttatcgtatatagatatttaaggagaaagatctttacttttcaaactgcatcttatatttctactttaaacagatcttatttcaaacatgcnacaacgccacttgtaataaagctttggaatgggtgctcattctattatttcactacaaacagcatagaaagcaaganaagtngggaatttattctaaaatagaatggaggttgttatctacagcagccctcctcactcctctnttgccatttttagcaagtnctccttgttgatcttgaacagtctccaaccctctccactggacagatcagaagcacctctccttttatagaagttgatggatggttcattccattctgcnaccaagaagtgcatgcngctgcagcgacacctcattgcaacctggcttagattcttcagaattnctgancctatgccaaagcctctctnatcactcatcacgaagaagtgctcaagagacaataacttgccaatgcacgggtcataggtgaaatagtacatggcaaaaccaacaatgctgtntncttn

SEQ ID NO: 642174 - DNA, 259 bp, Homo sapiens
acggtgacgggaagctgtggccccgtataccgatgatttgttagatattccatctatattgttatgcagttcacttggtcgttatgggacacttgtacaggtcccggtcatcctttaccctgttctgtcctaatgtaccatctcgccatgtccctgtgtaatattatagctgggatattgacatccacctctcctgtagacacactctccatgtcctctcttgtgtcacattcgtgtgtgcggcgctttgatgcattct

SEQ ID NO: 642175 - DNA, 399 bp, Homo sapiens
ttacagggtttcattccatggtgtcctgtcttgacttgggcatgtgttagagaacttgtgaagtcactgccttcatttaaaagatttggggaacaaaaaaatctgacttattaaaaaatctctctatagcccttattgtgaggcattttatcaagatgctatagaaatcagagtcccatttgctggctactagaagttaacaaatataaacatttccccaaaagaaaccatctaactagttgacgaccttacgccaagagggttctttctgctctatgaatgaatccgcctatgctggcggacaaatacaatccattgtaaatgtcatggtttcactagaggggggtgagacgccacccgtcagcggactcctcaggcacctagagaggaaggtcatgc

SEQ ID NO: 642176 - DNA, 166 bp, Homo sapiens
ccgaaatactttgacgcctggtggggatagcgatgatatggtagcggaggtgaaatatgctcgctgatgtctacgtctagttcctactgtagatatttggtgttgctcacactataaaccctagagtaagccaatttgtatatcatagcctgggtacccgtctata

SEQ ID NO: 642177 - DNA, 1887 bp, Homo sapiens
caccccagaagggtcagctctaagcagaaagtcattgttgacaggaagaggggtcagactttcccttttccggccagcttcctgggtaccaaaatagcaacgcggcacaacaaagagttggggcggtggaggcctcccaaatgggctggaggacacaccgaccccaccccatgctgcccacccgcctgtgggatccaccatgccacatgacagccagcctgacagcaccagtcgctggtgagtctggtagccctggaaaccctctcacagccagccgagatgtgagggacacagagagaggaggtgccatttcagacccctatgcctggcacgttggggtgagaaggacacaccagtcagagctggttctgaggctcgcatccggagggagatcctggaaccagggctgaggctcgcatcctgagggacatgctggaaccagggggcatccgagttggggacacagtctgggaaggtgtctaaaggaagtgagaattgaaggagggacagagcgctacccagaagggcataactagaggctgggaccaggtcaggaaacatgtccctcaggtgtagaagctgcaagtgagaaaccaacgtggtaggaacctcagcaggctggctccagctccagaagctgttggagttgaggatttgttctctgtagaggagcaacatcacctgtgtagtctggttcctaggctaggccatcctctagaattctgtgtgagccagaatgttcaactaataagagaaggctgcacattgtgggtggagagcgggaaagagagggggcttgcagcatctgcaggggccagaaactacatgcacagagaagctttctcaatcggaaaagagcttaggaaacattgaactggagaacaacggaagcaaacctgtgtccgggagtggctccagtgaaacccacctctttctctgtgtatggaattccaaacacccgttgtacaggaggaagcagctacagatcgtcctactcaccagctgggtggcaccaccggctttaagtaatgggtaaactggctcaagcaagcctgggactcagagacagatgtgcgaagcagagatgttgccatgcctaggctgagggctttcagccaatcggtgaggggaatggaggagaaaggagagaggggtgttgggttgagggccgggatgttaagaaaaggattgtatcctgggagatgggctaaggatcaagaggatgaggagaaacaccccctcccacagcctctgcagcacccagagttgcaagatccaaagagatgttcctttctgtcctctctttgctgtccccctcccctcctggccctcccagcattgcagacccttgcctctggtttgcagctgggctaagggcaaaagcagaagcaagagcctgagctgctttttcctgcctggatttctgttcttgcagttgccacagagctggctccttctcatcatgctagtcttggcttaaacgttacatcctccaagaggcctttgctggccaccgcagtgacgtattccaccctgacatcactatcacagtccctgctttagttttaagacagcacttaccacgaactggtattttctctcgtttccttgtttatttttgtctctgccatctagaatggaagctccccgagagcaggaaccttgtctgtgttgttcatggctatatccccagcactcagaacagggcctggcacagagtaggtgctcaaatatttagttgattcatgatgaataataattgctaacattggttgagtgttactacatgacaagtacttatttcacatattaactcatgggccagtgagctataggcctctgggcaaatccagctccctgcttgtttttataaatacattttattgg

SEQ ID NO: 642178 - DNA, 365 bp, Homo sapiens
ccccccaaaaaactctccagtagcttctttcagtgtcacaaacatgcatgcagcatttttctcatgatgaggtttcaccccattcattcagggtggtctttggtgtttcaaatctttttttaactcaataagatttacggggtgtattttatacagaaatgcattataaatgtttttaattgtgttctgttttttgcagtctttaagtgccatgccaattgttcttatattctcatagaagttcgctcaaaatactcaacaggggaataggcagcggacagtcagacatggttggaatttaggctttctaagaaaaactttattttgcataagcatgtggtcagatcatttcgtgcatatgcagc

SEQ ID NO: 642179 - DNA, 148 bp, Homo sapiens
ttgtgtctgttgctcgttccactggaggggcacacagcgctggagtgggcatcaattccgactccaggcattcccccattcgcatcttgggggactcacaccaagcatccaccactccttaaggagacagtacctatcgatctgctct

SEQ ID NO: 642180 - DNA, 259 bp, Homo sapiens
gagtagctcggattacagacattgccaccacgccaggctaattttgcgtttttagtagaaacggggtttctccatgttagtcaggctggtctcgaactcctgtacctcaggtgatctgtccgcctcggcctcccaaagtgctgggattacaggtgtgagctaacgcgcccggcccttggcctgatcattgtaaagattcaggtaactgagctctagggggtcaagagactgtggccacttaggcagctgcattgttcgt

SEQ ID NO: 642181 - DNA, 955 bp, Homo sapiens
gtttgatattgttccctgtcttccttatttccctcttagatctgagacttgttattagagaaataggatagtaaattaagtttcgagtactctattatgttacagatatttgcttgtccaatgagaaatccttaaaatatggccttttctgtatttatagattgtctttcattaacaataaggcacaaaggcatcgcagaaacgatgggaaaatgtgatgaagagcatcccaagagctgaaaatgcattggcaaaaaaaaaaaaaatcatttaaatcattataattatgtttaaacggttttcctttaacacaaaaggctgaatcttcactattgaagacttgtcaaaggtaccttgattaaagacagcagcttttccagtttggccattagaataaaaagacgtgaatggttcgtgaaaagcacttgaaagtacagaactctggaattggtggtgacgggacactggaaaaagaccagaacattgggatccatgttccctgacataattgtgtgacagaaataggaaggcagtctgagggaaaactgccataatttttccctaggactgggaaaggccgataaatttgtccctgttaacaaatgcctatgtgctgaataaagtttattcctactcattgggttaatgttaattcccatccctgtggacactttttgcctgcgtttcaagggtataagcaaaatctcctcctttggtcccttttacatttcggtggctgacattaaggtggacccgaagaggagggcaactattttactcatggaagttggtttcagaggaacccgtttcgttaggtcggcactactgtaacgcggtccatgagtaacaacgtcacgcgtcacgtcgagggatgactccgatagtacgagactttacggggtagagctacaatggcgagcaaaaacaggaatacacaagcggcacacctctcaga

SEQ ID NO: 642182 - DNA, 386 bp, Homo sapiens
  misc_feature (43)..(43): n is a, c, g, or t
  misc_feature (83)..(83): n is a, c, g, or t
tcgccagtgatattagagcagggtcatcctcagttccccttgntgtgcaattggaattccccacccaccccccaaatatcccngtggcctacactcaagaataaaattgcagctggacattgtggctcatgcctgtaatcccagcactttgggaggctgaggcaggtggatcacaaggtcaggagttcgagaccagcctggccaatatagtgaaaccccgtctctactaacaatacaaaaattagccaggtgcctgcagacctggctacttgtgcagccgaggcaggagaatcttgaacccaggaggcagaggttgcagtgagcggagatcgtgccactgcactccagcctgggtgacagagcaagactctctctcgaaaaaaaaa

SEQ ID NO: 642183 - DNA, 1139 bp, Homo sapiens
gtcctgctttctgtttgtctgttgtttgtctatctgtgctttgtttttatttaacaacagataagagaggggtaggggcaaacagcacggaagggcggcaagaaggaaggagagaacgcacgggtactctgtggttgcatccattgtccgggtcgtgttttatcacggcctgtgcttgttacccaaccgcgtctctcgtgttgtctacctagattgtccttgcttgtgttcttaacaactacaccttcgtggtgatactacttatacaaaaacaaaccaactggggtgaccgcggcaccaaagtttttccgtgtgcttgttaccacaatgacccgtccccccggggtttttgatgtattttcgtcggtcgcggcgcttggacctgtttctcttaacgcatgagtgcttcccacatccttggtttttttagccgccccgccggtgggtgttttccacagaaccctgggtaaccaaatagttgctggatcttcccaaaggtggggtgtccacacctgtctatctcgggtgcgctggtccttatattatctctccggtcgctcaatggatcacgctgtgcacagccacaagatgttaccgcggttggtttcactcacggcgctgcaccatatgaccccatagtgggtgttgcgcacgacgtgtagtatgcaaccagcactagtggctcattgatagtgctccgcccaatgaggaatatctttgtgggagattgtgttaaagagcgctttgtgtgggtcccaaaccccttgttagggagcccccccctcgaagatccctaaaatttagcgcacctgtgtagaggataaatatattctcgcgctgtctaatctctctgatacggttgcctgtgcggacatcaccccggtgagaagagtgggctcacactggaaggcgctataatctagttttcctattgtcctcgaaaaaattttctttgggggtgtcacacaaaaacacaggtgtctcccacaataggggcgcttggtcctcctccaacaaagggagagggggcacaaattgggagcgcttctttcttaccgcacttttcacacagggaatatcgtgcccgtttttgtcttaaagctgttctacttttgttccgagcacaaagatacaaagaa

SEQ ID NO: 642184 - DNA, 621 bp, Homo sapiens
tggcacaccattatacagaaccatgttgttttcgtgcccgcaattataattggtaaccccttttgcaccaggaacaccaaaaagtcttcacattgtataatgttaccactccctccggcgaacctccttgtaattgtccgagccgcccccctctcctcgcctcaggcaatttcttacctcccttcttgagcactctgctctatataaaaaaaaccttgggtgtatataatggatttctcttttaataacgcgcgccgctacaattaagtctaacggccagccatcaccctccagcgtcacttctttgaggtggaatagaaaagtaaaaattctgcagtctcccccgctgttcatagacaccgccaccccgctctcatttcttgctattactcactataaagcggcccccccactaagagcaccacgcatacgcttatacagagcccccgtctggttcgcaatacgtatacaaaacacactttgtctaatatcttttatatattcctccacccacttttaatatgtacgcttttctccgcacaaaaaaaataaaaatatttttttttaatacacctcgtacagaatagaataaatgaccaaaagggcccccccaacaaaaca

SEQ ID NO: 642185 - DNA, 481 bp, Homo sapiens
gtacggaagttaggtttgtaggttccagagaggatctgtctttgggaggagtgtggagagactgagatggagggaggggtcatatggaatagatgcgggcgctacttggcatatgtccattgtgaggcactgtccattgtgaggcaccaccgggatcatcagggattggtggagagggagtataatgccccaggattggtaagggagggcccagaccgaagaaggtggggcggatagcagaaccttttggtctcccgctggattgctcctaagcctcacgctcccttgccccgtggtgtcctgtagcttccctaatcttctccgtgacctgtagctaaaaccttccaacagcgcttgagaacttgattttgaacccggatcctcttcccaggacccccttacttctcctcctcctcctcctccatcatcctccaggtgcccaacagcccccttctcctcctttccattccgtactcccaca

SEQ ID NO: 642186 - DNA, 246 bp, Homo sapiens
ctgctccgcccctctctgagggccaaaaaacttcagctcagggccacatgatcacaggaggctctggggacagcacctggccaggacttggagacactgtaggatgtaatatctgcacatagctgctactatagcaagcgggcctggggtgaccgagacccagtcccaaagacctactaaccagacagcatggtctacttggtggcgagcggaacatggtagagagggagtacgtctgtgtgttaa

SEQ ID NO: 642187 - DNA, 287 bp, Homo sapiens
  misc_feature (191)..(191): n is a, c, g, or t
tgctctactacggctgccggcgctcggatgaggactatctgtaccgcgagagctggcgcgcttccacaaggacggcgccctcacgcagcttaatgtggccttttcccgtgagcaggcccacaaggtctatgttcagcacctgctcaagagggacaaagagcacctgtggaagctgatccacgaaggtggtngcccacatctatgtctgcggggatgctcgaaatatggccaaagatgtgcagaacacattctatgacatcgtggccgaagtttgggcccatggagca

SEQ ID NO: 642188 - DNA, 882 bp, Homo sapiens
gacttgagccgcggctatttctggcgcgggcgcggctccgagaaggcatccgcattggctaccagcggcggccgcgggggagccaggccggtcctcagcgcccagccaccgccgactcccgtgaaacccggaagcgcgcaccgacagtgccgggggagccgaagctcgcgcatcccagtccatcgagctgctttcctacgctgccatccgttgaggagaacgggagaggatcgaacgtgacgtccgaggtctccgcaatgctacctcaagcctaggcccttgggctccaacgctggaaacaaggacggcgctgagaagccggggccggggcaggccaagggcagaggcagccttccggtgagtctccggggaccatgcagcgtagggtaccaggaggtcagaaaggatgcctcgacgttgataggtgtcaggagcttaagagatctcggggccgaccacccgggaatgcaaaagatacaagggtgctagtccacatgaacctcggaagagagaccaccacagcatagctccagcgaaggaacatctatgaggttgacccaaactagactgggaactaaggcggaacgagtgatggtgctgtcctcgcatccgagttcctcggaagttcgcgaagcacttgacctaatgccgtgtcgccatgttcctcagtggaaggagcagtttccttctgggacttgcactcgtcgttggtctcgtcccagggcggttttagagaaacagacacaagtgtactccaagctgtccacgggtggaggctaacccgttgggcttatgagtgacctggagtgacaagtgagtcaccctggggtaagttctcaggagtggtcagggattggttgactgcagaaaatacccgaggtc

SEQ ID NO: 642189 - DNA, 378 bp, Homo sapiens
ggtagcctgtattaatctttaatagaataagcgtatgtggatttcactggtctccttaccactctatcacttcatcctgccttaccatctggctgcctgacattctagcaacacacaaagctcacatcatcatggcttatatttcctgctgcacaaccttcctatggtcctcaatccatgtcagggctggtcatttgtaaactccacaacacgcctgcagggactagcaacaggtgcagttcaaatggcatgcaagtgcaactaggcatgcacagcagcagctaggagagcaagggcagcacagtgcatagtggccaacactgtccccatctaacaaagggcacgccatgcactcttgctatcccacgatggacaatg

SEQ ID NO: 642190 - DNA, 744 bp, Homo sapiens
  misc_feature (3)..(3): n is a, c, g, or t
  misc_feature (78)..(78): n is a, c, g, or t
  misc_feature (84)..(84): n is a, c, g, or t
  misc_feature (281)..(281): n is a, c, g, or t
  misc_feature (299)..(299): n is a, c, g, or t
  misc_feature (311)..(311): n is a, c, g, or t
  misc_feature (335)..(335): n is a, c, g, or t
  misc_feature (350)..(350): n is a, c, g, or t
  misc_feature (357)..(357): n is a, c, g, or t
  misc_feature (654)..(654): n is a, c, g, or t
  misc_feature (656)..(656): n is a, c, g, or t
  misc_feature (659)..(661): n is a, c, g, or t
  misc_feature (673)..(673): n is a, c, g, or t
  misc_feature (683)..(683): n is a, c, g, or t
  misc_feature (700)..(700): n is a, c, g, or t
ccngctctcttgtaatgatatagccagaaaaacgtgttgccttgaaccacttccctcatctctcctccaagacactgnggactnggtcaccagctcctcccttgttctctaagttccactgggctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaangtaggcaggcccatgggnccaggtcttggngctgagcctctcccctgtactctnccgaaaaatcctctncctctgnggctggatcctagccttatcctctgatctccatggctccctcctcccccctgccgactcctgggttgggctgttgcctcagtccccccacagatgcttttctgtctctgcctccccccccctgagcccctcccttgctctgcccccccatatggtcatagcccagatccgcccctaccccttatcccccgctgcctcttctgtgggtgccccaggtccttgtttgctgttgatttctttccaggggggttgcacagggatcctggtttcaatgccggttggaaatagaaatttccananaannnagtattgggtanatattttttntgaatacaaagtgatgngtttaaatactgcaattaaagtgatactgaaacccaaaaaaaaa

SEQ ID NO: 642191 - DNA, 245 bp, Homo sapiens
tattttttcttgagacagggtcaactctatccatcaggctggagtagcggtagcacaatcagggctcactgcagcctcaatcacctaggcacaggtaatcctcccacctcaggccccaaagtgctgggataacaggcgtagagcaccgtgcccaggctagtaaccactgtttatctataaatttgtactcagggtgtaaatagagcacgctaattgattttttgaatatggaaccggatagcttg

SEQ ID NO: 642192 - DNA, 314 bp, Homo sapiens
agctgggcgtggtggtgcatgcctgtaatcccagcttcttgggaggctgaggcaggagcatcacttgaacctgggaggtggaggttgcagtgagcaaagatagcgccatttcactccagcctgggcaataagagcaaaactctgtctcaatttaaaaaaaaaaaaaagaaagaaaagaaaacaaccaaaacttcaggaaacattggacacacttatagaaatgcaaaatgctctggaaaatctcatcgatagaattaaataagtagaagaaagaaattcagcgcttgtcttcaaattaactcaatccaacaaag

SEQ ID NO: 642193 - DNA, 328 bp, Homo sapiens
agtccccctcagccatggcttgatgcaggccccaggccctccttttttgggggtcaaatgactgtgtcctggacatttgatgccccccctgccctgcctgttgcaaacgtgatgctcccgggtgcagtggagaaattaggagactgggccaagcaaaaggctgcaaccaacccagaagcccttcctcagaaggctggagaaatgattggggaatgcatgggccccggggccctgggctccctcccaaacccctttcagaaacaacgtgggatgaaaaagcaagccggttcatccggtttgatgccctttttataaagctcaaaaccca

SEQ ID NO: 642194 - DNA, 1005 bp, Homo sapiens
gttgactatactctacgaaccacgaagacatggaacagtatacctattattgcaggcgcatgagactggagtcctaggcacagctctaagtgctccttattcgagccgagcatgggccagccgaggcaagctgtctaggtaacagaccacagtctacagacgattatcgtcacgagcccatggcatgtgtaagtaatcgttgcgttcatagtaatacccatcataatcggaggcttcggcaactgactagttcccctaataatcggtgcccccgatatggcgtttccccgcataaacaacatagagcttctgactcttacctccctctctcctactccgtgctcgcatctgctatagtggaggccggagcaggaacaggttgaacagtctaccctcccttaggagggaactactcccaacctggagcctccgtagacctagaccatcgttctccctgtacgcctagtcaggtgtctcctctatcgttaggggccagtcaattgcgatcacaacaattcatcaaagtatagaaaccccctgcccatagacccgaatgaccgaaacgccccgtcttcgtctgatccgcctaatcacagcagttcctacttctcctatctctgcccagtcctagctgggtgggcatcaccatactaagtaaacagagcgcaactcgaacaaccaccttcttcgacgcgcgtgagggaggagaccgcatcctataccaagcgacctattctgaatttgcgggcacccggaagttctattccttatcctaccagggtttggaatagtctcacatatggtaattaatacgcgggcaccaaagaagccgtgaatccctaggcaaggccgaggatgaaataaaagagccagggttatgggtgagcacccaatatacggagaagatagacagagaattatccgtgagaaaaaggaccaccgcgaaataaagaccacacacagagaaaaataggcggggcacaaatacacgagagggcaaaaaca

SEQ ID NO: 642195 - DNA, 250 bp, Homo sapiens
gacgatcggcgatattgactcgtgaagatcggcgctattggccttccttaagtctggtgcctcggcgtgtgcaggtatgggcactcggcgtgtgcagtctggacgtctcggcgtgtcgagaagatcggcgattttgcatgggcattcggcgtgtgcacgtgaagatcggcgatttcggtttggagattcggcgtgtgcatgcacacgccgagtacccagactgagcagaccgtggtcgccgatcttcacg

SEQ ID NO: 642196 - DNA, 1658 bp, Homo sapiens
agtcagatggtaagcaaagatgcaaataaaaatatcagcttctgataagtgcagtggagaaaaataaacaagaaaaaaaatgctactgtgttcatttcttagtatgtgccaaaaaatgatctcattgaatccccaagataatcctaggaattatgtcctattcctatcatccccatttacagatgaagaaagtgaggcacagagaggctagggtggttgctgaaggtcacacagccaggaagttacagagtcagggctggaactcaggacagcctgaaaccacagccctcgttcatattcagtaaaacccggcagtgaacccccagcagtgttcacatccctggcacatactgggcacatatcaatttggaacccagtggaatgactgaattgtgtctctgcccacaatacgagtgccataattttcctcatgcgaaatggcaggtgtgttaacctcttgcaacatcatcagggctggaggaggacttcagactgagctgggacatggggagagcctctgtccccaggttgttttctgctgggcaactcccctccagagttcagttctgctggcacatgcctaagtgattagctggctctgagcctgagcatggcatagctcaccagggtgggctctcacagctcccaggaaccagcaaatagccggtggaggaaagcactgattccctattcgcctttttctgccattatcagcaccagtggctttccaaagatgagttgatataagcatcctgtcagaaaggatacagcctaataaatggaatgtcccttcccctctctaggcctcagtttgcctatctgtcaaatgaggagagtggattaaagtgcacttttcaaactgtctttcctggctctacagagctttcttaggggctgctgaagatgatggggagctgatgattagaagagagtggctgtggccaaatattggaaactcaatagtgtctctgaggatacttaggctttgaggggggatcccagtgcctaaagggacctggctgataatacgaaagaattcagcctctgggtagggactggagcaaactgagcccacgtttcatccaagggggcggccacttctcagctccagtcccctggggccacttgtggccagatcctctgagtttttggtaaaacttgaacatatggatttttatgttaaatgttccaattttaaaaagtcggtcatgaactcaaaatcttctaaaacagtgtgaggcagacaaagcatatctgtgggttacatttggccctaggccagcaatttggaactctgttctagaaggctggggatgaactttattctctccgtccttccaatttaatgagcattaggattgtggtgagatgattggaagaagtgttggtggctgggcgcagtggctcacgcactttcggaggccgaggtgggtggatcatttgaggccaggagttcgagaccagcctggacaatatagtgaaacaccatctgtactaaaaatacaaaaagtagctgggcgtgctggtgggtgcctgtaatcccagctactccagaagctgaggcatgagaatcgcttaagcccaggaggcggaggttgcagtgagctgagaccgtgccactgcactccagcctgggcgacagaatgagactccgtctc

SEQ ID NO: 642197 - DNA, 119 bp, Homo sapiens
gagctcgtaccggaaggcatcaaacgctgatggggaggctggaagacgcagccgccggactgggcagtatcctcaagcagacctacagcatagtttgacacaaactcgcacaaccatga

SEQ ID NO: 642198 - DNA, 265 bp, Homo sapiens
cgcttcacgattacctgtggccccactgattgctgtctctctcttatgtactttagccaacaagccttgaggagacaatcatccatgaaagccatctcaggcttcaggaagacgcgccttgaatcttcgaacagtatgactggccggatgtgtacacccatcacatcatctttctatgcatattcacatgcactcagcagtgagtctaatgagaacctgtccagatgtatttggaagcaaccctaaagcccatattgcagccaag

SEQ ID NO: 642199 - DNA, 592 bp, Homo sapiens
tctacctcaaatttattagcagtatgtactttaattattaattattaatctgtaaaacagttaatagtaatatccacctcatgtaaacccttagaacataccaagtaccatatatacgttttttaaaaatcaaattttttaaattaaggagtttgcagcagatttttattttgactgctctggacccattttttgcccctcaaatgcaagcagtatcagttgccaaaagccatcccatatatttctggcacttgactctggaaagaactgccttcactgtggtgcatgctttgaattggcattttatggtatttgtaacactacctcttgaaccatactcttgagtcttggacaactacggtagaaattcaatctgtggctactaaaatgaggcacagttgaatctcctgacgagcattctaggcagctcagctgcctgcagtctttagatcaggagaccataacacacatcttacctagggaaaataaaaagtagtagtatagttacttttattacttccaagcaatagttattgtttcaagccttcacagaaatattttaacttgtgaaagtattgcttctaaaaggagg

SEQ ID NO: 642200 - DNA, 364 bp, Homo sapiens
cacgtcccacgcctcgagaaatgcacgagacgaacgcccgcgcgaggttcggtggagcccgtaacgtgccccggagaatgctccgctagcacatcgcatcactcggtgcccaggaccaccgcatccactccacgatgaaacgtggccgaaggttgaacaaggtcaccacaggcacggtttatatggccacgtttaaaaacttaatgctattctgcggggccacattcgtaaggagatgggtgagtccagattagattcccttctccgattggcccaggccgatggcatcgtttccaagaacttttgactggagagaatcaccagatgtggaatatttgtccataaataaattaatggaaaccct

SEQ ID NO: 642201 - DNA, 399 bp, Homo sapiens
gttatcttaatcatctactatacttttgcataactgtacacactacctctttcactcttgtaattctctatctataggatccatgagctatctagatgatatgatcttctttattcctcttctgctttcagcattctatttggcctaatattaaggatacgatttccataagaagcttgtatagaataatttaacattaagtgcttcgtgacacgaaaggaattgcgaggattagtcattaacccagattgtctacgagtttctccgttgcatttccacctatgtcagctatgatttacgataaagtagaatctagagattactgccattgcaatatttaattgccttggcccgaaaggtgagggctctaggttcttaatcaaattcagactgatcctg

SEQ ID NO: 642202 - DNA, 850 bp, Homo sapiens
gaggggtttggtttaggagagttctgcataagaacagaactttattaaggattagagggaacgatacaacaggtattactgcgtgtaatgtgatgtctaatttcatgtggcttagcagcaattaataacctgatttaaggtctttattcagaatgttaatttgcattctctgccgtgtgtaatgttcttaagtaatgaagctaaaattaacccatttcatttagggaattatctatttaatttgactttggctagtgtggtagctttatagatagcttttgcttaggagggatcaggaagtccatacgaaatataaaaaatatctagaagtagtctaagagtgcttaattattctattttaccgttgatataggagataaaggtgaatcgtgtaggtgcttcctcctttgggaattatggtggatcttaaaacttaaaagttgcctgaaggtatgatatgaacggttcaggtatataagccttaattgtctaagataatttaacttttgtcatgggaaggggaagccagagtcagtgttgtcacacattcattgttattaatagaagatagacacttattccagtccaaaaatgcaacctaggagatggattgaacagtgtcgggcggcctcagccggaaaagcatcagaaacgccagctgggggcgcggccaagaagtgaggacacgccgcgcggtcctagaccccgcggatgtcggcggttcccaagaaagccgcgacaggtgctgaaaccagggtccgggagcgggaacagccagggataggccccgggagaacccgaaccggcgggaaatcacgcacggccggaagcgaccaccacccacacggtc

SEQ ID NO: 642203 - DNA, 187 bp, Homo sapiens
tatatttatagatcagtgtctcacttgccaatcccaattgtagatataatagctgcccattataaaagggcagttcaggtcatgccactcttggtagctatgggaatagccataagtactagtactagaattacagagataatgacttccatggcccaatatgaaaaattcacttccaagtcgacgc

SEQ ID NO: 642204 - DNA, 1115 bp, Homo sapiens
  misc_feature (185)..(185): n is a, c, g, or t
ggagagaactagtctcgagttttttatgtttttaaaagggcttcttttaatgaaacaaatccaaaaaatgtacagtcaggctcaatttgtgcagttcacaagctgtggaggaaacagacagaacgacagcgttcaggacagctcagagctaacccaagaacgaggcctggactttgccgccaggnggaattctctctcgtggagtggcactggggccggggccaccgggctgggcacaggcgcagcaggcacgggctactcttcacttctgccccaggttgcctgggcaaggtctgtgctccacatttttcatagaattatcacctttcttcccttcaaattctaaagaaggtcctccggagcttgccttcaagaggaaagtcccttctcgtgcagtccaagatgactccaaggtcttcccttgccaccattaagacttggcaccctgctggatttggcccaagaaaggcttagattttcttacaggggtggtcccacaaagattttaggagggccatttggtgtcttccctcacagggttggtcctgtgggtctcatcaaaaccctaattggaacaatttgggatccaccacctggaggcctgaaaactcgggagctatccctgcttgtgggggtcgactcccttgaaggtgggggtttgtggccatgggcccaaggagccgaggaaggctggcgccggagcagaagcggctcaaaggttcggacccgaggggctgctggggaaaactcccaacaccaaaagccgcttcgagagagcaggcctaccttggtacctacccgatatgtaggtagccgtttagccgcctggaattcattggccttgcaaatccccgagccgcttgggtcccccaataattaggtggagcggatatttggggagtctctcaccacaattggggggaactttggcacaccctgggcaagggggtaagtaaaaaagacgaatgtagattgtctccaacaacccctggaggttacattgttggcgaagagtaagaaaagcgaaattttatagaggagagtccatatgatgtggagaaggggagtattgtgtgttcacaataaggcctaattagaaacgggtggagtattag

SEQ ID NO: 642205 - DNA, 278 bp, Homo sapiens
tttctacgagtcatcactgtggtacattatcacagtccgtacacctacctagaacatattatcacccaaagtccatagtcgatattggggttcactcttggtaagtgtatatactgtaggtggtgacaaatatttaatggcatttatctaccatagtaacctgatacagaatcgtttcactgtcttgaaagtcctctgtacttagtcccttcatccttccctctaccctaatgcctggggaaccactggatcttttaactattctctgtaattttact

SEQ ID NO: 642206 - DNA, 107 bp, Homo sapiens
ggcacgaggagccaccgagagagcagagaactcggtgccgccaaacaggccagctcgcgcttcatcgttccggagccgtcgtgccactccttcgatggccacagatg

SEQ ID NO: 642207 - DNA, 218 bp, Homo sapiens
tgaaatccgaattcttgggtgaaaaatacatccgcagggtttcggatgagaccaggttgttgcttgtcgaggatctcaagcccagaaagatgaattaatccttggaaggaaatgacattgagctggtttcaaattcagcggctttgattcagcaagccacaacagttaaaaacaaggatatcaggaaatttttggatggtatctatgtctctgaaagg

SEQ ID NO: 642208 - DNA, 189 bp, Homo sapiens
ttttatttttttttttatttaaatgaccaaaggtcattccaaccgggctttttattgtatttgtttttggtctttgttaagttctattggaaaaacccctgtttgtgtttttttggcagttgtttgcattaacctgttcataccccccttttgtcccttttttgaaaaaataaaaaaaattaaaggcca

SEQ ID NO: 642209 - DNA, 251 bp, Homo sapiens
  misc_feature (18)..(19): n is a, c, g, or t
  misc_feature (98)..(99): n is a, c, g, or t
  misc_feature (199)..(199): n is a, c, g, or t
  misc_feature (206)..(206): n is a, c, g, or t
  misc_feature (231)..(231): n is a, c, g, or t
  misc_feature (247)..(247): n is a, c, g, or t
agatggggtttcaccatnntggctaggctggcttcaaactcctgacctcaggtgatccgcccacctcgccctcccaaagtgctggaattacaggcgtnncacacagcgtctggccatcagcagagtttttaatttaggagaatgacaagaggtggtacagttttttagatggtacctggtggctgttaagggctaattnactgacnaacacacccaactttggcggctgcngcccaaggaaggtggncact

SEQ ID NO: 642210 - DNA, 390 bp, Homo sapiens
ttctgttcttaaacttctaataaacatttacataaaataacttttagcctttaaaaattgcccatagtttatggttgaaagtttccaggaaccaactcagcaatacataaattgatttagaaattctagttaaggccgggtgtcatcgtcacgcctgtaatcccagcactttgaaagaagccagggcctcatttgaggtcaggagctcgagaccagcctgaccaacatggtgaaacgctgtctctactaaaaatacaaaaaattagccaggcatggtggtgcgcacctgtaaccccagctactcaggaggctgaggcatgagaatcatttgaacctgggaggtggaggttgcgctgacagggccactgcactctcaaaaactgcactctc

SEQ ID NO: 642211 - DNA, 762 bp, Homo sapiens
  misc_feature (392)..(392): n is a, c, g, or t
  misc_feature (422)..(422): n is a, c, g, or t
tttaaaaacgttctcttaaatttcacagattgcagagtctgcaaactacaaaccttaagggcaccataataaagctaccctcacgccaccacgctggggcaaaacaatgggtaggtctttccgtcaaatatcctaaactcacttcaagctaattgtataacggctttccataataagaagtagccctaagaagtgaaatatttgccagggtccagagctaatgatggatggaattttaactcaactctgcctactcccaaagtatcagttatctttctctacaaagctcactttttgaggcttcaataaaatacattatccctaaaagtgacattacttttactagaacttgaaaatatgagtctgtagcctactgagactgcttttgattnccgaaagcacagtagataaggtaatgaaanacatgtaaacgagctgaaaagtctccactgtctagggctttgattttcaaagtgtgcttctcagctgggcatagtaactcacgcctgtaatcccagcactttgagagagcaaggtgggtggatcacttgaggtcaggagttcaagaacagcttggccaacatggtgaaaccctgtctctactaaaaatacaaaaattagccaggcatggtggcaggcgcctgtaatcccagctacttaggaggctgaggcaggacaatcacttgaacccgggagtagtaggttgcggtgagccgagatcacaccacagcactccagcctgggtgacagagtgagactcca

SEQ ID NO: 642212 - DNA, 1040 bp, Homo sapiens
  misc_feature (537)..(537): n is a, c, g, or t
acaaaaagagcgcccgctagtgtgtcttgtttgtccccctttcaaccctgtgttgagggtggagtcatcagacgttggacaagctaatctccgtgcctcaacttcgatgtttcccctatctttggagtcacaggcgggagggaaataagcacgctctagcttcatctcgagtggcgtcagaattctccgaagcaactccgccgatcgaagctgaagctattctggggctagactgctattagtgactcgagaggacgatgagtgcgtgtgtgtaggaataagagagttggactgctcaaaaggggtcgtggtatctatactcgtgtattgttggtacatacaggagtgtgtgtaaatgaatgtgtgtagaattatcggagtgggcacttatacaagatgggtgatatataaaatatgaacgggagtcctttggcgtcacagtgagttacaaactttacataatgtgtgtctcacctgagagaggcgcgacactctcgctacagagagagagaagagacgcgctctgagccgcgaacnctcggcatcgctgcaccagcgtgaacgcactcaacatgagtgttgtgctctttggtttgtgagccgcaactaagatgcgtggagtagcggatctactatattaatgaaaccgctagaagaatgaggctgcaaacaccatcttttcgaaaactatacgttagatcctcagctctcagtatagagagcgcggctcaacagcggccacagtcccgccgcaaagtaatatctggcagtcgaggaagcattacatgtgccacacgaggaccctctgcgaagaactatgtagatgtcactgtcttaacacacggagtggtgattaggagaaagcacatgataatgttagactcgataatgtggtggtcgcgacgccaattctcacttacactcagataagcgacgcctgcgatctcacttactagtatagagcccgatctcattacgcagttgggttgcaagaaagaacattatctacgcacacgaattgtagactgtgggggattaaa

SEQ ID NO: 642213 - DNA, 4859 bp, Homo sapiens
  misc_feature (2939)..(2939): n is a, c, g, or t
  misc_feature (3077)..(3077): n is a, c, g, or t
gcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcctagaagagcagggttggtggtggagggtgtgaccagggcctgggcccatcccacatctgccacacttcttcacttccatgcttacatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 642214 - DNA, 113 bp, Homo sapiens
cattggactgagcacatggggaatgcaatggcaaaaaatctcatgcaaacatgactatccacttattatttatagatgtgttcctgatgcctgcaaagagtatcaagatagca

SEQ ID NO: 642215 - DNA, 4226 bp, Homo sapiens
  misc_feature (2306)..(2306): n is a, c, g, or t
  misc_feature (2444)..(2444): n is a, c, g, or t
ggcactccgccgccatggagcagcgtccgcgtcaccggacttcttcgcgcgccgacgtgcccttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 642216 - DNA, 4827 bp, Homo sapiens
  misc_feature (2907)..(2907): n is a, c, g, or t
  misc_feature (3045)..(3045): n is a, c, g, or t
gcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctcccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 642217 - DNA, 784 bp, Homo sapiens
cgggtgtttccttgttcggaatcgggttggctcctctttgattttttacttctggtgacccacgcaaaagcagtcccgacctggttgtattaataataaaggctgtaaggatcagccttttgaacggtccagccgagaactaaccacagagcgcgttttagtggagtggtacttatttttaaataagatactgagtttactacaaatggaaggtttgaggcaaccttgatggagcaagtgtatgggtgccatgtttttccaacatcatgtgctcactttgtgtctctgacatattgccagaacacaagactatatttactagcagctctgtgtccttgctcattggaaaatgatctttcctcaagacttgctgacacgtttctgtttaaggcatgacaatcctaaaggccaacaattgtggacaggggcaactcttcctttcattattactggtgtagtcaattatgcaaagtctggtcaaccaaagaccaccaggctcaagccatcagtattaaaatatggccacatgctccttgatggcctatgtgatatggctttagtaactcccttaggaccaagagaatataatggaactaatgctgtgtaacttccaaatgcagctgctttctgggtcttttgaaatggcccttcagaatccaggcaacatgctgtgagaagttcaagctacatggacaagtgtagatggttctggtgaacgattccaatctagtcttggctttaaaagtcatctcagtaccatgaattcagatgattatgtcgaagc

SEQ ID NO: 642218 - DNA, 501 bp, Homo sapiens
ttcacctgggcacaatgctattggtacctttcccctgcgtgaggtggggaatccctaactgaggtcactgtcaccagagctgctgatccccctccatgtggagattgaccccgagatccagcgagtgcgcactcaggagcgggagcagatacaagaccctcaagcaacaagttcgcctaccttcatcgactaaggtgcaggtatcctaggagcaagcagaataatggtgctggagaccaagtgttggcactgctgcatggagcagggccagaacttgggtgtacaccaggaacaacctggagcccctctttgaggactacctggtgtagcatgcggagtccaccggctggacgagaaccttcactgaggcgatgcggggtgtgaggctgggcattcaggacgctcagggacacgtgcagggaccttggtggacggaccttcaacgacccctgttactaggattgctaatcaaccataggaatcattgttgacaaagaaagt

SEQ ID NO: 642219 - DNA, 358 bp, Homo sapiens
tgggtatctagaggatcctgatatgttctctataaataaaatagtggatagtgtgatgctcatccagtattggatgtagggaggagaatttgttgtatccaggagggtggaggctgagtgagcaagatcacgcactgactcagctgggtggagagtgagactttccccccccaaaaaaaaggatacgttagatgagaagcgtaatgttttctgtgtacagtaggggtgatatgaactaataataatgttttttcaaggtagctagaagattttgaattgttatcaccacaaagaaatgatagatgtgactggtgtggtggcttatgcctgtaatcttaacactttgggaggccgaggc

SEQ ID NO: 642220 - DNA, 2047 bp, Homo sapiens
  misc_feature (1882)..(1882): n is a, c, g, or t
  misc_feature (2047)..(2047): n is a, c, g, or t
gcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctgaaaaaaaaacaggcttagagaacaaaatcatgtttgggagccttcagggcacagaagaaggtttttaaagcaccattcttgtgcgccgcgcggcgccagatattttagttgacactttgcacaacgtgtgtccgaagaagacctgnggcagagtaggtgttgcgtccaccattaaaaacgcgcggcgaacacgcgtcttgacaaccagaggggtctgcagcattacggctcaaagagtgcaagaagtgtaatacccacgttgggggaaacaaatagaacacgaagcctcatcgtagcgcagatcagacggn

SEQ ID NO: 642221 - DNA, 727 bp, Homo sapiens
cgggtgtttccttgttcggaatcgggttggctcctctttgattttttacttctggtgacccacgcaaaagcagtcccgacctggttgtattaataataaaggctgtaaggatcagccttttgaacggtccagccgagaactaaccacagagcgcgttttagtggagtggtacttatttttaaataagatactgagtttactacaaatggaaggtttgaggcaaccttgatggagcaagtgtatgggtgccatgtttttccaacatcatgtgctcactttgtgtctctgacatattgccagaacacaagactatatttactagcagctctgtgtccttgctcattggaaaatgatctttcctcaagacttgctgacacgtttctgtttaaggcatgacaatcctaaaggccaacaattgtggacaggggcaactcttcctttcattattactggtgtagtcaattatgcaaagtctggtcaaccaaagaccaccaggctcaagccatcagtcttaggaccaagagaatataatggaactaatgctgtgtaacttccaaatgcagctgctttctgggtcttttgaaatggcccttcagaatccaggcaacatgctgtgagaagttcaagctacatggacaagtgtagatggttctggtgaacgattccaatctagtcttggctttaaaagtcatctcagtaccatgaattcagatgattatgtcgaagc

SEQ ID NO: 642222 - DNA, 237 bp, Homo sapiens
  misc_feature (150)..(150): n is a, c, g, or t
  misc_feature (168)..(168): n is a, c, g, or t
  misc_feature (176)..(176): n is a, c, g, or t
  misc_feature (213)..(213): n is a, c, g, or t
  misc_feature (220)..(220): n is a, c, g, or t
tgtccccacctttgtagcaggagaagtggcaagacggcaggttgacatctatgtgagagaggagagatgctacccggagttccacatccagatacaagcctggcactggcagtttctccaatggatgcccaatggccccatgggccactntctcccagtggcctggcntgacatangcagtgcagcctgggggagtgctgccacactctcctngtacccntcttccccatgcccagt

SEQ ID NO: 642223 - DNA, 1028 bp, Homo sapiens
ggtgggaaacgagcttgttcgctgcgggtagctggtggagactcgagtgtggtgacagcgaaagaacgataacagcaatgccggagcgagatagtgagccgtactcgcaacccttgagctcgcccgatggtcaacgatgtgaaatgatcctcactccttccaccaagtcaaaactctaccaatgaatgtacttcaggcaactcattctcatgacccccagggctgcagctacctctgcgaccagcttctaagtcacgtcaccaatgagatgcccttgggggagttcacatgaggatgaagatccaggcatgcacgaaggcaggagaaaagacacccgttattatgcctaatgctacgccaacaagagcttgagatgagagtagagagcgtagctgcagacgtaccgggatcgtgccaggggatctcgacgatgatgggagtgacacctgattatgacagaaccgagctgatcgagtgatgcgacacgcttatacgtagtacgcgtgctgcaggccccatgtgcgttgccgcgcggcacaaattcaagcctgcgggcagcaagcagcaagaccacgttgatccatgagagctccaaaacccgtcggggtggtgactctggcacgacacccaacttgtggtgaagaggtcttggcacccatagtccggttccctagacggttgcgagcatggcagtattggcccacgccaagcacatagcagcacgaggaacgtcgatggtgcaagccgcagccaccgaaaggaagaaacggatgaagattctgagagtaacatcgaggtttacaccacgtatggcgcggcagttacccgactgcttctgatagtccaagcttctcagcgaatgagactgtctcggcggccgactcggcccgctggccaaccggatacgcattggtgccaacaaatccccaccatctgtaccacaggtgatgaccctggaagcccatactccacacgcatgctacactcacagaactcacctcgggcacgacaagtcaagatcggagaac

SEQ ID NO: 642224 - DNA, 623 bp, Homo sapiens
atataatgctagcatataccatctgcacttctaggaatagtagtatatcgctcacacctcatatcctccctactatgcctagaaggaataatactatcgctgttcattatagcgtactctcataaccctcgaacacccactccctcttagccagatatagtgcctagtgccatactagtctttgccgcctgcgaagcagcggtgggcctagccctactagtctcaattctccaagacatatggcctaggactacgtaggataacctagaacctagctccaatgctaaaactaatcgtcccaacagattatattactatccactgacatgactttccagaaaaacacagtaattttgaatcaacacaaccagccagcagcctaattattagcatcatccctctactattttttaaccaaatcaggcaagcaagctattgtagcgtgttcccggaagcttatcctccgagccccttaacaagccccctcctaatacgtaagtaccgtgagtccgtacccgtcgaggatcatgggaagccaaacggcgacttatccagtgaaccaatatcgacgaaaaaagaacttctaccttcgtctagtacgtaatctcgcgtacaaagtctcc

SEQ ID NO: 642225 - DNA, 2270 bp, Homo sapiens
  misc_feature (1751)..(1751): n is a, c, g, or t
  misc_feature (1756)..(1756): n is a, c, g, or t
gcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctgaaaaaaaaaaaaaanaaaanaaaaaacaaaaaaaacaaaaaaaaaaaaaaaaaaaaaaaaaaaaaaaacaaaaaaaaaaaaaagagagggggggcggcgggcaagaaaaaaattttctccggggggggagcacacaatacagaccgcacaccgaacttccttagaaacaacgggggacgcacacaacatagagcgagggctcaataacaacaggacgcaccaacacagacgcacagagaatacaaacaacaaccgcgcggcgaagagaggaatacaacacgcgacacgagagcgagaagacacaaccagaaggagcaggaacgaacacccacaaccatcccccacgacgcgaggcgaaccacacacagagccggagaacacaccaccccaccccgcaaggagaagaacaaccacgcagggagggagacacacaacaccgccaccgcagagcaaacacacgcggcagaacacccaacgacacacaatagccgacgagcaaaaagaaaaccacacgaacacagagcgagaatgcag

SEQ ID NO: 642226 - DNA, 128 bp, Homo sapiens
taagattcgtcttaagctcaagatctttcctggcttggactattctggtgttatgcttcaaaatgtattaggtaatttttgtagtaattttttcaattccagaagttccattgggttctttcttaaag

SEQ ID NO: 642227 - DNA, 4040 bp, Homo sapiens
  misc_feature (2120)..(2120): n is a, c, g, or t
  misc_feature (2258)..(2258): n is a, c, g, or t
ggactgaagcaggaggcaacctggcctttgcccactgcccaatgtgcttggggtgagaacaccccttgctggcatgggtccacttgagcaggtgggcctttacggaggagggatgggggttgcccggcccgtgccaggccacagactggaagtcatgccctttacctgcaccccaggcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctcccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 642228 - DNA, 3941 bp, Homo sapiens
  misc_feature (2021)..(2021): n is a, c, g, or t
  misc_feature (2159)..(2159): n is a, c, g, or t
tcatgctcggtcccgctgtcccgtaagtgggaacagcagcgtgcggatgtgaggagagaaaggaggcggatccggaagagatatccggacttcgtgggcaggctgcccacgaagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctcccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 642229 - DNA, 4076 bp, Homo sapiens
  misc_feature (27)..(27): n is a, c, g, or t
  misc_feature (61)..(61): n is a, c, g, or t
  misc_feature (87)..(87): n is a, c, g, or t
  misc_feature (237)..(237): n is a, c, g, or t
  misc_feature (2156)..(2156): n is a, c, g, or t
  misc_feature (2294)..(2294): n is a, c, g, or t
acaaacagggatctaatccctaacctngggtacgtgtgagaccacagggagaaggccctcngaggcatgggcaccatgccaggcctntagggcaccttcctgcagcaggcagaatccccttcccaagtaggaggggaaagtgacaagaaccagggcccagggagggagcagcaaggccatgggaaagggcagccagcatccggctggatttgggctgcctctggggattcgggaggnaggactggtggaggacaaggcacacttggctcagcagcattcccctcctctccctagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctcccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 642230 - DNA, 406 bp, Homo sapiens
  misc_feature (29)..(29): n is a, c, g, or t
  misc_feature (40)..(40): n is a, c, g, or t
  misc_feature (72)..(73): n is a, c, g, or t
  misc_feature (77)..(77): n is a, c, g, or t
  misc_feature (83)..(83): n is a, c, g, or t
  misc_feature (85)..(87): n is a, c, g, or t
  misc_feature (91)..(91): n is a, c, g, or t
  misc_feature (99)..(100): n is a, c, g, or t
  misc_feature (102)..(102): n is a, c, g, or t
  misc_feature (108)..(108): n is a, c, g, or t
  misc_feature (115)..(115): n is a, c, g, or t
  misc_feature (117)..(117): n is a, c, g, or t
  misc_feature (120)..(120): n is a, c, g, or t
  misc_feature (131)..(131): n is a, c, g, or t
  misc_feature (141)..(141): n is a, c, g, or t
  misc_feature (156)..(156): n is a, c, g, or t
  misc_feature (160)..(160): n is a, c, g, or t
  misc_feature (164)..(164): n is a, c, g, or t
  misc_feature (166)..(166): n is a, c, g, or t
  misc_feature (168)..(168): n is a, c, g, or t
  misc_feature (172)..(173): n is a, c, g, or t
  misc_feature (178)..(178): n is a, c, g, or t
  misc_feature (180)..(180): n is a, c, g, or t
  misc_feature (184)..(184): n is a, c, g, or t
  misc_feature (187)..(187): n is a, c, g, or t
  misc_feature (198)..(198): n is a, c, g, or t
  misc_feature (200)..(200): n is a, c, g, or t
  misc_feature (205)..(206): n is a, c, g, or t
  misc_feature (212)..(212): n is a, c, g, or t
  misc_feature (219)..(219): n is a, c, g, or t
  misc_feature (227)..(227): n is a, c, g, or t
  misc_feature (235)..(235): n is a, c, g, or t
  misc_feature (245)..(245): n is a, c, g, or t
  misc_feature (247)..(247): n is a, c, g, or t
  misc_feature (261)..(261): n is a, c, g, or t
  misc_feature (269)..(269): n is a, c, g, or t
  misc_feature (286)..(286): n is a, c, g, or t
  misc_feature (290)..(290): n is a, c, g, or t
  misc_feature (295)..(295): n is a, c, g, or t
  misc_feature (297)..(297): n is a, c, g, or t
  misc_feature (302)..(302): n is a, c, g, or t
  misc_feature (307)..(308): n is a, c, g, or t
  misc_feature (315)..(316): n is a, c, g, or t
  misc_feature (323)..(323): n is a, c, g, or t
ccgagaccacctctatggcagagcctacncagaggagagngtatcggtgagtctaccctggggatatatcgnnacanggctcngnnncacnctacaganntnacactngctcagnantgnatacacaaccngaagacctcntgagaggcctgtacntgantcangngntagnnactangntcantgncaagggaccananatagnnatggtncagggcntggagaangaacctgnagtgatcacnanggatgggacagatntcaaggangcagacaggactaagangaangagtnancactncaggnngcatagnncacgctnacggaactgagaacgcgctgagcgtataaccagtacacttgcgcaactggtacagctattcattgatcacagacgtatcaggt

SEQ ID NO: 642231 - DNA, 519 bp, Homo sapiens
  misc_feature (74)..(74): n is a, c, g, or t
  misc_feature (328)..(328): n is a, c, g, or t
  misc_feature (332)..(332): n is a, c, g, or t
  misc_feature (338)..(338): n is a, c, g, or t
  misc_feature (348)..(348): n is a, c, g, or t
  misc_feature (351)..(351): n is a, c, g, or t
  misc_feature (354)..(354): n is a, c, g, or t
  misc_feature (473)..(473): n is a, c, g, or t
gaaccagacagcgtggtcttctgcttcttggtcattgagatgaagaagtagtatgacatcgccttgcaattcancttcactctcatccagtccttctgctgtgacaacgacatcaacatcgtgcgggtgtcgggcatgcagcgcctggcgcagctcctgggaagacggccgagacccagggcaccaccgaggcccgagacctgcattgtcttttggtcacgacccttcatatggacgcttggaaaagcccacggcttggtggaggtggccagctactgcgaagaaagctgtggcaacaaccagtgggtcccctacatctctcttcagnaacncttagncccttcccancancanaatctgtttagttttttccacaaacaaaaaatacaataaatatttgaacccccttcccccccagcacaaccccccaaaacaacccaacccacgaggaccatcgggggcagagtcgttgnagactgaagaggaagaggaggaggagaaggggagtgagcggccgct

SEQ ID NO: 642232 - DNA, 869 bp, Homo sapiens
agcgggttgggctggtgggaaggggaggcatcccgatgtgttcagaaaagtgtgtccctgatttcgctgtgcaaattgaaagtggcattactttatgcagggccttagcgggagtgaaaagagctcctggcagcccttagctcagggcactccaggccccacccggacctacagcacagactgagtggatcaaagtagcgccatgtctagccctaagtccacacacgatcctctcagggcagcgtaggcgagaccatcccatggtagggagctcattaccaccaaattataaagtttccattctgcagacagaggaagcctggtcctagcctgcaaagagttagtactcccttgctagactggcagctccttgcaagaagcggagctgtactacacattcatctactcatgacttcgcgactcgtcacttatccccatcttgaggcttccataattgcagatccgatgaactaggagctaacgtgggtacacaggacccctctagactgtctaacacaccccatccaaatacacgaagaacgaaacttcctgcaaacccatgcaaaccaggaacgcctgaacgggcgacgtgttgcacaactggcacggccacttattatcccctagcacaattgcactgacaattgcgagaaaccatacacgagaattcctttgagccatgctgcaaacaggctgagacaattcattcggttcactctgggaaaacttggaccgtccttgcaaagaacgcctacagaggaaccccctcatgccaacacacaaacaacagggttaagccacacacacccgccaacttatggcgcacaacagcaccacaataaagacataaagaccaaagctctcagacc

SEQ ID NO: 642233 - DNA, 3454 bp, Homo sapiens
  misc_feature (1534)..(1534): n is a, c, g, or t
  misc_feature (1672)..(1672): n is a, c, g, or t
ggtcggtcctcacgccatgtcacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctcccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 642234 - DNA, 3451 bp, Homo sapiens
  misc_feature (1531)..(1531): n is a, c, g, or t
  misc_feature (1669)..(1669): n is a, c, g, or t
ggtagttgagcaggcagctgaagggaggccatgtagaggtcagagaagcgcacgaggcccttgagaagtaggtggggttgtggaaggtgcggaagatgctgccgaactgcgcattgaacagggccttggtgatgcacctcagctcctgccgctctttcatccaggcagccagcaccggctgcatgaagacccccttccttggtgacatggcccacatccgctgagggcacctttattgtctgggacaggccctcagcccctcctgccccatccacccagacaagcaataaaagtggtctcctcccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 642235 - DNA, 675 bp, Homo sapiens
cggccaagaaatcccccaacacaaaccggtcgaagttaagaggggatctactttatccattggcaagttgacaagcggctgtagagcatacttaggtatcaggggtggcattgatgtgcctaaatacttgggctcttattctactttcactctaggaaatgtcggtggatacaatggaagggtgctaaaacttggagacgtactattcttaccaagcaatgaagaaaataaatcagttgagtgccttccacagaatattcctcaatcattaattcctcaaatttccgaaactaaggaatggagaattggtgtaacatgtggtccccatgggtctccagatttttttaaacctgagtccatcgaagaatttttcagtgagaagtggaaggttcattacaactccaatagatttggtgtccgtttgattggacctaaacctaagtgggcaagaagtaatggtggtgaaggtggtatgcatccttcaaacactcacgattacgtttattctctgggtgcaattaatttcacgggtgatgagccagttattattacttgcgatggtccttccttaggtggttttgtgtgtcaagctgttgtcccagaagcagaactgggaaggtggacaggttaaacccgggactccattcagtttggccactttcttacgaaagctcg

SEQ ID NO: 642236 - DNA, 903 bp, Homo sapiens
ctctcgtggtgcggctccttgcctcggtatccgtgtggtctcgcccgcgttgggttccccatcgttaggcccctttggtggcgtccacgggccctagtgtgctttggccctgggcccggaaaccaaaggtttgggagtcccttctttcccgttggccggccaacacttgtagtgctcccccaatttgggtgcccccgacgccccacagtgccgttcgtctccccgcctgtcgtgggcccccccgcgctatttgcaccatggccgtggggcgccagctcgaggacattagttttgggggagacctggcccgacgtctccccccccccttggggcccgagccccttcaaccggtgggggccgccccccaaccagagattaaaaatgtctgccgccccgcgcgtggcgaacacaaaaatgggggccccctggaccacctctggagtgtcataagggccccccactgaagcgccgtgagataggggggggcggcaaccccgcggagacgccccgaacatcttgggaggcgcccccaccgggccaaaggaaccgcgctaaccacccacacggagagatttcatcaagccgcccgccgctggccacaatataggcagaacctcgctttgtcccccggcatgcttgaatgattactcgggcacctggcatagacttcctcatagtgcccgtttctgctcccgcggtgtaggtcgggcggggtcccctttaggcccccggcaatgtctgccccgcgtctctccggtcttgggggcccgttgtcgctgtcttccccgattgtcatcatatccgctgcgcgagatcgttgcacgccccgggcggcttctgttcctcccccccttttgcttgccccgggcccccaaagggagtcctctttccccaacaaaaaca

SEQ ID NO: 642237 - DNA, 868 bp, Homo sapiens
cagcttggttccactggagacagtgttggacatgctccgggatgccatggtggccaaagtcaatacttccaaaggcttcctgattgatggctacccgcgggagtgtgcatgcaatggagaagagttttgagcgactggatttgtgacatgcccacacttgctgctgtatgttggactgcaggcccttgagaccatgaaccagctggctcttgaaactgttgatgaggaccaagctggtgctgtgttgacgacacatgaggagaccatcaaaaagcggctggatgacctattacaagggcacagaaaccgtcatctgccttctatgagaaactggtgggcgtttgttgcgcacaggtcaacgctgagggctccgtggacagttggcttcttcccagggtcttgtaccacactggaatgccctaaagtaagcaactgctggatgccgcgtttccccagggtacagagcgcccgggccacacccgtagctgattaagaagggttcctccattgggtcccacgaaagctgcaggagaacgttaccaaaccctatagcctgtcgttgttcacctgactacatagtagacgccgagtatactggttttttcaagtgagatgcttagcactaataaggacgttctacagagggcgttttggtttacaaaggttaatctccttggtaccacgatgagagtaagatcaatgttgatattggctaccttgccgcgaagtacgcaaacccaccaaacctcctagtaatcataagaccaccttttgaagcaaccgtctatatcactgttgtgatggccgggaccatacactaaacaggaaatctgctagaaactggagcagatgaggcatacagggggcg

SEQ ID NO: 642238 - DNA, 233 bp, Homo sapiens
gagtagctgtcatcactaatgccttgggaattgtggtcacagaccaaatttccgcaagcttcgctttttatgcattaccgctgtcaggtcagaacccctcgtgcacatgatacagcgggtgtaatgaatgtttgtttgatccagactgcggggactgtgacaagatgaacaaatcaactgtcattgaatcgtcttgtgtgtcagtgaattaagggttctgcaattgaggatga

SEQ ID NO: 642239 - DNA, 942 bp, Homo sapiens
  misc_feature (1)..(1): n is a, c, g, or t
  misc_feature (66)..(66): n is a, c, g, or t
  misc_feature (340)..(341): n is a, c, g, or t
  misc_feature (344)..(346): n is a, c, g, or t
  misc_feature (354)..(354): n is a, c, g, or t
  misc_feature (358)..(358): n is a, c, g, or t
  misc_feature (382)..(382): n is a, c, g, or t
  misc_feature (386)..(386): n is a, c, g, or t
  misc_feature (397)..(397): n is a, c, g, or t
  misc_feature (400)..(400): n is a, c, g, or t
  misc_feature (409)..(409): n is a, c, g, or t
  misc_feature (411)..(412): n is a, c, g, or t
  misc_feature (416)..(416): n is a, c, g, or t
  misc_feature (434)..(434): n is a, c, g, or t
  misc_feature (437)..(437): n is a, c, g, or t
  misc_feature (439)..(439): n is a, c, g, or t
  misc_feature (444)..(446): n is a, c, g, or t
  misc_feature (451)..(451): n is a, c, g, or t
  misc_feature (453)..(453): n is a, c, g, or t
  misc_feature (456)..(457): n is a, c, g, or t
  misc_feature (462)..(462): n is a, c, g, or t
  misc_feature (469)..(469): n is a, c, g, or t
  misc_feature (471)..(471): n is a, c, g, or t
  misc_feature (474)..(474): n is a, c, g, or t
  misc_feature (479)..(479): n is a, c, g, or t
  misc_feature (481)..(481): n is a, c, g, or t
  misc_feature (492)..(492): n is a, c, g, or t
  misc_feature (503)..(503): n is a, c, g, or t
  misc_feature (506)..(506): n is a, c, g, or t
  misc_feature (511)..(511): n is a, c, g, or t
  misc_feature (529)..(529): n is a, c, g, or t
  misc_feature (545)..(545): n is a, c, g, or t
  misc_feature (555)..(555): n is a, c, g, or t
  misc_feature (579)..(579): n is a, c, g, or t
  misc_feature (594)..(594): n is a, c, g, or t
  misc_feature (601)..(601): n is a, c, g, or t
  misc_feature (610)..(610): n is a, c, g, or t
  misc_feature (614)..(614): n is a, c, g, or t
  misc_feature (621)..(621): n is a, c, g, or t
  misc_feature (649)..(649): n is a, c, g, or t
  misc_feature (788)..(788): n is a, c, g, or t
  misc_feature (842)..(842): n is a, c, g, or t
natttaaataaagcaactttctaccttattaaaagattcttcacctcctaaatagaaactgaaggngaagcaatgctattaaggatcatacataagctaatagaggcagcagaattatctattaacattttcctaacactattctagtgaccttaacattttaatcacagagctgcagctgtttgcatgtgttctaaagctagcataatctttaagacagtcaggaaaaaaaaccttcaaaacaaattacataatattctatctagaaaaatttccaggaaagcacattcttgggtgaaagaaaaccacccctttgtcattgtgatgcactaaaaaaaannatnnnagcctganagtntggctccgggctctcccacttgtntggntcgggctcggntcnctgtgaacngnnattntcctcccttttcgcaggnttntnttggnnntttgntnggnnttggnggggggngnctngcagntngttaaacctgntttagatatcnctnatttntttttttcctagatgccnactgatacatcatatntttttttttnttggttgtgcttttgtgttttttntcaaaggcaatttanatttttncttcgggtnagcnatgcacntttttattaatcatatttattctacttncattgcttggttgttgtttattaatacttaaatcacagtagacacacaaaaagagatgtttctcaacttatcatagggttacatcccaataaacctactatcagttgaaaatattgtaaattgaaaatgctagcctgtnttaaatatgctcagaacacttacagtagcctactgtttagcaaaattatctaanacgaagcccgttttataataaagtgttgaatttctgatgtaatttattgatgttctactgaatatgtatggcattggcactatggaaaagtcctaattgg

SEQ ID NO: 642240 - DNA, 464 bp, Homo sapiens
gtcctttgcaaccaatagttgacgtgatcatgatgagcctgcgcttggaggtataattaagctgtggataagagtataacgtattcggcctaccacgtgcgtgtgaggcctgctatgggtataactgggtaattcagtggggcggggcctattgattataaaaatatcggtaggcggagcgtagggcagattggatggcatgataccggcgattgctaaactgctagtgcttattgccgtgattatgcatacgatacggcaagctgtcaacgttgcggtaaatactttcaactacgctgctgtaattggccgtctaattatacaccccgttactacacatattacaacactttcgtctgccgggtacaacgggcatatctactatttggctggacccataacttcggtgctaactgacagtaatataggtactatatattatacaatagttatgctgccgcatg

SEQ ID NO: 642241 - DNA, 207 bp, Homo sapiens
atgtgtgacgtgattagaggatcccggtgtgtcatgcaggtgagcaccaattcattccggtgtcgttccagagaatctgttaacaaatagaatggttgtggtgttgcatgtgtctgtgtcaatatgtgccgggtgtgttcatgtgtgtagtgtgcaggtatgtgtagtgtgcgtgtgtgggtgtctgcatatgtgtgtatgcatgtg

SEQ ID NO: 642242 - DNA, 119 bp, Homo sapiens
tttctaatgaggaagaagaaaagaaggatggtgacaagaagaagaagaagaagattaaggatacgtacatcgatcaagacgagctcaacaaaacaaagcccatctggaccagaaatccc

SEQ ID NO: 642243 - DNA, 82 bp, Homo sapiens
ctgcccccattgcgtctgcacacccctgcgtgtaactgcattccaaccactaataaagtgcctattgtacaggtcaaaaata

SEQ ID NO: 642244 - DNA, 391 bp, Homo sapiens
tgtggtggctcatgcctgtaatcctagcactttgagacgccgaggtgggcagatcacgaggtcagaagatcaagaccatcctggctaaagtggtgaaaccccatctccactaaaaatacaaaaaaattagctgggcgtggtggcgggcacctatagtcccagctactcgagaggctgaggcaggagaattgcttgaacccgggaggcagacgttgcagtgagccaagatcgcaccattgcactccagcctgggcgagacagtgagactccgtctcaaaaaaaaaaaaatacatctaccaacagatgaatggagaaaacgcactgctatatctatacgacagaatattaactacaggtgcagacagcaacatggataagtcttactgccgcg

SEQ ID NO: 642245 - DNA, 421 bp, Homo sapiens
aagtgatcgagctcggtaccgcatcgaagcatcttgcaaatttcttaatgtgtagctgaatgtttaatatttgaaatacaaaaaaaaaaaaaaagggaaaaatttgtcagggggcccaatgattttttcccctggaacaattttggtagggtcgccgggattaatcagaaggtggcccaggggacttggattcgattgatggattcagctgagtgcccctcagttgggagtaacccttgccatagcagatggacttttggcgcagggatttgccatttattgttattgggtgctaagtacattttttatgggatgataaatatctctctgagaagttttgggctgggttccatggctagtgccatagctcttaactatgctacagtgatatattttggagtggtgtgaggtactttaagct

SEQ ID NO: 642246 - DNA, 1641 bp, Homo sapiens
  misc_feature (288)..(288): n is a, c, g, or t
  misc_feature (716)..(716): n is a, c, g, or t
  misc_feature (837)..(837): n is a, c, g, or t
  misc_feature (1428)..(1428): n is a, c, g, or t
ctaattatgtggttgtcttgtcactcgtgtgcctcccgcaatcttgttgacactcggttggtgtctatcacacaaccacgacgcgggatatggggggggcatacaaccagtgtggaggccccagccagttcataccacacgttgttatcaccccggggtaagtgttaataattctacggtgctctagaatagtgtcccccccattggaagtcactttttttggagagtgaaaaggcgtttcttcttccctctgggggggacccaaatatgttggtgggccttctacanacattgagttacaacacggacaaattgttggttcccttggttctcaaaagcgagaaattgttcttctctcgtatcctgtgagtggcgcacagagacacacgatgaggtctcgtcgggggtggaacccaagcgccccacaaaaagaaggtggagcacccctccccgcccccgcagtggggtgataggaacaaagacgcttgggcgctattagacaaaccactgggctctaaccaaagagggtggagtataaaaatgtccccgtggagacgccgcatatgctccacgggcccccaagaattataacggtcgcccccggcgccttaaataggcccccccccccgtctgatttttggggaatttttggcccgaaaaacaaccgggggctttcaaaccacatgtggggcaacaagagccacaagatgtttttngctcgttcggaagaccttgtgtataaggcggagaaaaaaggagattgttggtattttcccccccgcctgttgtcgcgggggtgtaaaaaaaaaagagcttgggggaaaagaagatgtgggnggcccgcctctagaaaattagtgtctcgttggagaaattttctctggcgtgaagtattaacgcctgcgggccgcactactacgtggtgggataatataggggttgtttcccctccggggcaaaaagcggcacactaacggtgggtgtgtttcggaggaaagccttttcttctcacagagactttattatcccacacctcctctgtggggtgccgcctcttttgggactctgtgttccgtgagaaatataggtagaggacacacagagcacacgctttgccgcggtgggggtgtcgtgtcaatctcacaaaaagcgcacagtgggggacacacacagagaggggcctgcgctgcgggagagctcgcgcgcaaaagggtgtcacacacacacgtgtctcggcccacgagaaagggtctcacaagaagggctatatatgagatatttaatcctctaaataaccctcgccacaccccacacttcttaaatccacgtgtggtggggagaagaaccgcgttctctcacgagaactcgtttggtgtttcacacttgggccactcttaaagtgttatagtgaagtaaaaagagactggnttaaatgagtaaccacaatgcactcgtgtaaaccctctcacgaaggagaaaggaggaaatgttttgtggagccacactcttggttttcttttttgcgctgtggcacgttttaaggttaattagctttttaaaatcagtactttttaatgggaacaacttgacccaaaatttgtcacagaattttgagacccccttataaaaagttaaatgaga

SEQ ID NO: 642247 - DNA, 952 bp, Homo sapiens
gtcctcattgtaaccattctaatcgcaatgtacttgcctaatgcttatccgaactgaagataattctaggctatatacaactacgcaaaggccccaacgttgtaggcccctaccgggctactacaacccttcggctgatcgccaataaaatctccttcatcaaagagcccctaaaagccgccacatctaccatcaccctctagatcaccggcccgagtcgttagctcttgcgacctatccgctcgttctcctcatagatacccccctcgtccccaatctcggcatacccccccttggtggatgtcttcagatgttatgtgtctcccttacttctcatgctcatcgtagttcgtaggctgatccgtttaacgtgcgtgtcctctgcactctatgggcttgcatgctatctcttgcaagctagatccgtgttgtggtgctattgtggtctatttgcctttgtcttccatcctttgtgtacatgtcaactcataggctaatgcaaatcattacatagtacatactgtctcagctaattaaatatcggacatccttataaacctacgtgcgcgagcgcgcttgatccacaaaacataatgaaacagccgtgcgtgacttacgtcctggccatcactgaacccttggtccgatacataatggagtttactcctcccagcagctagcagatgaccaaagcgaagcccctccgtcgaccttgccgaaagggggagtccgaagcttaatcttcgggcttcaggcaatacgaatacgcacgggaagcccccatttcgccgctaattcgttccattagccgggataaaacaaaacctttattattaattaaaagcctcaaggaataaaatataatccttaggaaggaattaatgggggacacctcccctggaatttgaggcagatataaagttcggagaccgattttacttcccgtttttga

SEQ ID NO: 642248 - DNA, 154 bp, Homo sapiens
cagcggtctgtaggacaggaaggcaaacagattttctcttgaatgtgaagtccaatcacttggtggtgtctgcaaggattgctgttttgatagaagtgtttgatggaaaattcaggatgggcaggaatgagtattgtgatggtttaatcatgtc

SEQ ID NO: 642249 - DNA, 3318 bp, Homo sapiens
  misc_feature (1398)..(1398): n is a, c, g, or t
  misc_feature (1536)..(1536): n is a, c, g, or t
gcggccgcctactactactactactgctcgaattcaagcttctaacgatgtacggggacatggccctggtgacatggcccacatccgctgagggcacctttattgtctgggacaggccctcagcccctcctgccccatccacccagacaagcaataaaagtggtctcctcccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 642250 - DNA, 805 bp, Homo sapiens
  misc_feature (2)..(2): n is a, c, g, or t
  misc_feature (62)..(62): n is a, c, g, or t
  misc_feature (129)..(129): n is a, c, g, or t
  misc_feature (166)..(166): n is a, c, g, or t
  misc_feature (284)..(284): n is a, c, g, or t
  misc_feature (319)..(319): n is a, c, g, or t
  misc_feature (324)..(324): n is a, c, g, or t
  misc_feature (336)..(336): n is a, c, g, or t
  misc_feature (417)..(417): n is a, c, g, or t
  misc_feature (419)..(419): n is a, c, g, or t
  misc_feature (443)..(443): n is a, c, g, or t
  misc_feature (534)..(534): n is a, c, g, or t
  misc_feature (556)..(556): n is a, c, g, or t
  misc_feature (726)..(726): n is a, c, g, or t
  misc_feature (743)..(743): n is a, c, g, or t
  misc_feature (804)..(804): n is a, c, g, or t
gntgtttttgtctgtaaagtgcagttgcttatttcgtctttgtctcttttcctctttgtaantatatgtcttcataccttaattatagctgtttacaaaccttttttttgttttttttctaattctatnagcgaggactgggaggtgaaagaagcgtagggatttncatgttaatagtaaaaaaaaattattttgtaacaaaaaaaatggttttgtttgttgttctcacatcttattgcttaaaaaaaccacattttttcataaaattaataataacttatttnagaagacttggaagaagcatataggcacaaaagtnaaaanaaaatgccattntaatcccaacaaccagaatagttgatgttagtacggtggaggaggcttttccagtctttttcttttttcaacatatatatntngaaatatggggtgcaaagaaaaanacctacatttacacacgtgtgctgtgagcactgaaggtccttctgccttttaaggatacgatcatctcaaggaagactttttttttttctnagacattcctaacaggctcatnaagttgaataatgatcactaatcacccctataccaggacatgctaggaagaagagagcctcaaaatatcctaattcatcttcacagagcaagtcggatattgagaatttgctggctgctcaagggattgtgtgtggggctcggaagatggctcagtggctaagagcacanactgctctccctgaggntctcaattcccagcacctacaccagacagctgataatggccagtaaccccggctccaaaang

SEQ ID NO: 642251 - DNA, 940 bp, Homo sapiens
gagtgcgaagggacgcggtgcgcatgcgcgtgagggctgccgggccaggcccagacatgtccgtccttgtaagtcaaaagcttccatgggagccttccttcctaatcaagatgcaaataatagtggcatccgaaacgagacattaaaaacaggttctcatcttcaaagaccccagtgctgtggtttcacagttatgagaccatcagattgcttggggggaacaccggtaaatgcaatggaaacgcctttccagccagccaagtgattctcttgtggaccccataaccctggatattctccatcagattgggatcacctcccacctttggagggctccccaaagatttggaacacggttctccgggggactcctttaccaggaaaaggaacacccttctccaaaaacaacggcaggcattttatattattaccaggtccactggggctctcatagggaaaccaccaggaattactccggtgaacgcactattcttaaacggtgggttcacgggagatacggaaaaagccataattccaatggctggagagttaaaactcctaagaaccagtccctgtttctggtacacaaggattgttcctttagacgccagtggggacaccacagccacaactacacattcattgcgggcaacttcgtggaggtcttgaaaagaagcacctgaagatgcctctgggtggtggattacatgtttgatcttaccaagacagtgggatttgttttgggaaggcttgaagatgggggggatatcagttgcaggcttgacggatataaacgagccataaggaagggaggctcagaaatttggtgcatacttggaaataatattcaaaacgtgctacatgcctaataaagtgtgcattggtgcggggggagtaaggcacgaagggccacatttaggggataaagggttcccctgag

SEQ ID NO: 642252 - DNA, 3257 bp, Homo sapiens
  misc_feature (1337)..(1337): n is a, c, g, or t
  misc_feature (1475)..(1475): n is a, c, g, or t
gcggccgcctactactactactactgctcgaattcaagcttctaacgatgtacggggacatggccctggctgccagatgcccacagcaccctggcatgaagacccccttccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 642253 - DNA, 1616 bp, Homo sapiens
gcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctg

SEQ ID NO: 642254 - DNA, 1488 bp, Homo sapiens
gcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttcccccatccacccagacaagcaataaaagtggtctcctccctg

SEQ ID NO: 642255 - DNA, 528 bp, Homo sapiens
tcgatctagagatcccgatcacgtgcattgtgctcagcctgagtgagaagtgagacccaacaaaaaaataacaaaaaacatttgtgattcatgggaggaggtcaaatatccacattaaataacaggagtatggtgaaggcattgaatcccgacctcataggatgagtttgaagggttcaagactttagtgggggaagtacttgccgatgcgatgggaacaggcagataactagaattagaaatggagcctgaagatgtgactgaacttgtgtcactcatgaggagtttgctttatagacaagcaaagaaagcagtttcttgagatggaatctactcctggtgaagatgctgtgaacattgttgaaatgccagcaaaggatatggaatattacttaaagcttagttgataaagcagcagctgggtttgagagaactgacttcagttatcttattttaagaaattagcatagccatcacaaccttcagcaggcaacaccctgatcagtcagcaggcatcagcatccagga

SEQ ID NO: 642256 - DNA, 3143 bp, Homo sapiens
  misc_feature (1223)..(1223): n is a, c, g, or t
  misc_feature (1361)..(1361): n is a, c, g, or t
ctgtcttgctcgatataaattgatggcgcttttgttgggtaggactagacccaagtgtctaatttcccgtccacccctaccatcaatgaaatgaccctacttcctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 642257 - DNA, 1370 bp, Homo sapiens
  misc_feature (125)..(125): n is a, c, g, or t
  misc_feature (159)..(160): n is a, c, g, or t
  misc_feature (208)..(208): n is a, c, g, or t
  misc_feature (210)..(210): n is a, c, g, or t
  misc_feature (327)..(327): n is a, c, g, or t
  misc_feature (826)..(826): n is a, c, g, or t
  misc_feature (833)..(833): n is a, c, g, or t
gggggagagcccatgcgcctgggaagccgggctgtttctgggcggggctgcagactcctcgtgctcgtgtcaccgtgtccttcccagtgagacatgatgaatggatggagagcccggaaccaggncctggagcggcgggcggagccgagctgctggggnngccgctccgtggtgcccccacccccgctgcgcctcagtgtgtgcctgncngaggtgcagtgtgctctgctggttgctgggggctctgctgcctgcttgtcatgtgctggcgtgggcgctgcgagcggctgccagctcggggcagcggaacccagagaagctgagtgngtggcggtagcggctggcgacggcgacgacgacgactcccgcgcgtgtgcccagcctcttccctgccgcaggccggccttttcctccctcccttacgtccccgagtgcggcagtaccgcctccttcccagccgcgcggctttcctccagacctctcggcgcgggtgagccctattcccagaggcaggtggtgctgaccctgtaacccaaaggaggaaacagctggctaagctcatcattgttactggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggcttgttctgtgcacaagggctatgcctttgttcagtactccaatgagcgccatgcccgggcagctgtgctgggagacgaatgggcgggtgctggncgggcangaccctggacatcaacatggtctggagagcctagacatgacagacccaaggggctaaagagagcagatctgccatatacagtggctacatctttgactatgatactaccgggacgacttctacgagaggctcttcgactaccgggggcgtcgtgtcgcccgtggcagatggccacgtcggtccctgtgaagcgacccgggtcacagtcccttggatcggggtgtccaaagtaacgtaactgtcaagctctttgaccgtccacaggtgtcatcaccaggtcaggcgagagcagttcaacgcaacgggagctgcagcaccagaggggtgaccagatcggtccaatatgatgcgtgtgaacggtgggcagatcgctgggccgaagggcatcagaatgcagaagaagggagggggggggccccgggagggcgtgtgtggacgcgggaaggtgtccgtggggggccgggcccccccgaaaattgggggggggcggaacgccaagaagggcgccaggaggcgagagggacgccaagaggcccg

SEQ ID NO: 642258 - DNA, 154 bp, Homo sapiens
gactgcatcaacgccgctgacttgcacacgccgctccggattcttaggatctgaacccgactccggagtggcgggttggatgcagtcgactgcatccaacgccgccgcgaggacgtaggagtgccgctgcgtccgcggcggcgttggatgcagt

SEQ ID NO: 642259 - DNA, 238 bp, Homo sapiens
cactgcactccagcctgggcgactgagcaagactccgtctcaaaaaaaaaaaaaacaaaacttgaatttgggtgaggggagggaacttagaggatgggccaataggtgcagcaagccattgtggcacacatgtgcctaggaaacaaacctgcacattctgcagatgtatccccccctttttttttttagaagaaataaagaatattttttaaaaaaagaaaaatacatttgtagctat

SEQ ID NO: 642260 - DNA, 248 bp, Homo sapiens
cccaatagttgctatgtgattatggtactggctatagtattcatcgcacggaacacttttggcatgcttaactacctggtaacaccttcacctgcactggtttactttttcttttttctttctttattatttatttttatggagtggtggttggttttaaaatccacagaccataaaaatcttttttggccaagcttgtgaaacgttgccactgtctcatttccccccctctatccaagggatctgtt

SEQ ID NO: 642261 - DNA, 510 bp, Homo sapiens
ctctatactgtcctcattggtatatggctgtatgaacaattcaagtatgactcctgtagtgattctgaacatgtactaacaaattatagctaactgtagtcaaccggttgtactatcaagttccaggtctttctcattctatctaactataattttgtacccattaaccatccccatttcacaccacttcctactacccttcccaacctctggtaatcatcattctattctctatctacctgagttcaattgttttaatttttatttcccacaaataagtaaaaacatgcaaagtttgtctttttgtgcctggcttttttcaattaacatagcttcctccaggttaacccatgttgttgcaaatgacaagatctctttcgtttttatggctgattgctctattgtatatatgtaccacatgttctttatcctttcatctgttgatggtcacttaagttgcttccaaatcatagctattgtgaatagtgctgcaataaacatggaagcaca

SEQ ID NO: 642262 - DNA, 508 bp, Homo sapiens
cccgtttgggctgtcgtgacgcgcacagtatcattggtgccgtgctgtgctgcaaccagtgtgaatggtacttctgtgcccgcgaagtgctgggacagcccaggatcccgagtcagcaccttgctggcatctgaggagaacttggggatggagctgtagctggagccccggcttgaggagtgacttggtcacagtctccaccacgaagccgtggatgtttcgtgaaggtgcttgtgtgccctccggacatgcctcggaccaggtgaccttgtgccttgaattggtctgcccacgatgtgcttgggggccaccgtacttgattggctatgaggtattttgccagtgggccatggaagtataattgagcatatggtcctcagtgacattcccgaaagtccagttgcaccttggaggggccatcaatggtgaaaaacaatgaccccgatgccggcattcagaggtgtcacgatgaactctgatgacacaccggtagtgcctccctcgagcc

SEQ ID NO: 642263 - DNA, 113 bp, Homo sapiens
tcatgctcttcctctcttctcctcctctgtctcctcacgctctgcaactcaagcccatacagtacctcgaagtcctcgagcggtgggaccccaagacggacagtgagacagag

SEQ ID NO: 642264 - DNA, 210 bp, Homo sapiens
ggtcggtaccgtctatcaggactcttattaggcagttctgggtgctaagatcccaacagcatttgcttatctgaaaaggatcttatttctccttcacttatgaagcttcgtttggctgggtatgaattcttgattggaattttttttttctttaagaatgctgaatataggcccccaaattcatctagcttgtaaggtttccgcttttag

SEQ ID NO: 642265 - DNA, 128 bp, Homo sapiens
cgtttaaatcacgttccaactcaaagcaagtaacagcgccacggtgtctggccaaagacatcagctaagaaaggaaactgggtcctacggcttggactttccaaccctgacagacctgagcaagccag

SEQ ID NO: 642266 - DNA, 738 bp, Homo sapiens
ctaaacgaagtcgtggaggtggcgaaacgaggaggagataagcgcggcttgtggctctgtgtgtctcccagatctgctaaagccctaaggacatcaccatggacttccagccatcgccccggcgggcaagaccggtgagcgggggacgtgttggcctcctcctccgagagcaagcgtgaccgctagggagcgcctcgcggcagctggccctggagaccgatcgacttcaacaaggacccggtactttcatgaggaaccaccgtgggctcctatgaagtgcaagactctgcgctgacaccttcacgaacaatgaggggagctacctggcacatacgcagggggaagaagcgccagaccgaagctggcccggcgagtcgagcgaaggaggccgaaggaggcccctgccccaagcccgcgccgtgagaaggtcaccggtgcgaggtcgaacgaagtttgtgaaggatcggccgcccgggctacgaagtgaccaagcagagagactcggagatgggccagcagaggctcctcttccagattgagtaccctgagggatcgccgagggcctcaggccactgtcgagcgcttcatgtctgcgtacgagcaagaggatcgagcctccggaccggcgctggcagtaccttgcctcatggccgcgagccctagagaacattgccttcaaggtgccgagcagagagatcgacagggggagggcaagtctgcaccactggaaccgggagc

SEQ ID NO: 642267 - DNA, 851 bp, Homo sapiens
  misc_feature (299)..(299): n is a, c, g, or t
  misc_feature (304)..(304): n is a, c, g, or t
  misc_feature (313)..(313): n is a, c, g, or t
  misc_feature (315)..(315): n is a, c, g, or t
  misc_feature (323)..(323): n is a, c, g, or t
  misc_feature (347)..(347): n is a, c, g, or t
  misc_feature (355)..(355): n is a, c, g, or t
  misc_feature (596)..(596): n is a, c, g, or t
tgtagggaaagggtctccctgtgttgcccagactggtatgggtactcctggactcaagcaattctcctgccttggtctcccaaagtgctgggattacaggcatgagccaccgaacctgaccaagcacatcttaatatcactgttgtattaagttttcaagttccagttatttcataaatgatttttttgtttgaatcagtatccgtatagggctcatagattttattgatgtcgcttataactgtgtctatagttcttcttccgttatttccccatgtcgccccaccctttccttattnagttnatgaggaantnggatcatnggtcctgtaggattttcctctagntggatttngctgattttcacctccctggtggtatttaacattatttgttaaattgatggttacatttagaggctccatcagattcagatgtttaagattttaaattaaaacattttttatttttggcaagtatactttatatttagtactgtgtatctccattaggaggcacctaatttttggtggtctccctgctgtgttttgagggctcaggtgacaaattgaagcgattccagatggatcagtgtngaggtatagtttcattcccctcctgaagtagcttcatatttccaaagcgcctggagaaatactatttaacttcttatatatagcacacggagattaaattgtactttatcactagttttagtggaatcagtactctggattcgttgaaactgtcgtatgaagactgggtattcttctggtaggaatctagggtcaacctattaagaatagttccaggaatctgaagaacgacaaagtatttgaacaactagggaa

SEQ ID NO: 642268 - DNA, 108 bp, Homo sapiens
aatttcaattgtttaccctgatgctgacaggctcacttcatcatgttttgatgaagaccggtatctgcctctcaactgaaacaactgaaccagtctagcattaaccac

SEQ ID NO: 642269 - DNA, 760 bp, Homo sapiens
  misc_feature (490)..(490): n is a, c, g, or t
cccttctccactgggggtttcttgccccttctttagggccccgcctcaattgttccgagcctcgtcctgtcctgcgactgtgcgctggccccgcgacgcagcccctcccacaactccttggtcccccccatgcggcgccaggattctcccttcgtaggcccctcgcttgccaccccgcgtcgcgcccctgtgtcagctggcaaacccaggtgggcctctatctgtccccccccggtgtctcaccacggagtccggcgggtcttgtctattatgtcgccccgctgtttctcgtctctctcacgcctcttatgggacggtcctctccgggggtcctcccctctcgctcagagtgcgagtggggtaaccctgccgctggctcttcccacccgacacgattggggggagcaccccccctcgcccgccactcctcgccgcccgtggcgcgtggggtgtttgcgcctccgcggagatatggcatcttggcgcgacnattatctttctgctgatagagctctgcttctccccgaacgccacggcatgatgggcccgcacgtctatgatcgctcccccgggattgttctgcaagccgcgcacgccacggccatactgtgatgtagcgcgttcttgtacgcgctaggctcacgtatgcacgtcccccagcgcatcataatggcgcagtgcgctttctactgttagctcgcaccagagccttgggccccaaaggagcaaacaaaactttctctacaaacaaacaaaacac

SEQ ID NO: 642270 - DNA, 1417 bp, Homo sapiens
gatccgcgcccgttggcggggtcattgagcgctacgatccggtcctcgtgatcccgagctgcggggaggcagatcgactgtgagctgcttgtccccatcctgcggtcgtcctggggacatcatgagccttccgtggtgcccggggcattgggttggacgctcgggacgctcaacttcctcctcgtgcctcctgacgcgcgtgcctcgcgtcgccagacgggcctggacgcacagtgccatggagtaccggacccaatgggtcgtgggcctcgtggcgtggctgattggcgtccagagtggcggtccccttcatttggccctgcggctccgcatgtgtgtcctgctggcatcctggcgggacaggtatcgttgctgcatagagaccgccggttcttgaccccggaaactgactcggaggacaacatacggttgaaagcgtgctgaaaaagggacgcacctacgttgcagagctaggggaggggaagaaagtgaagagttcgcatgggtcctcacaaggaacccaaggcgctagaggcggtggtgttggaacgcattgggccgcattgggaactggggcaccttcgaatagtcctgcgggggcttccaaggcccaggagagggctcggttgccgtcattgcgagacgcgaccgttgaggtaggggccttcagaagtagagggaaccgctggaatgtcccgggagggcagggcaggcactggacagcaagggcatgcatgggggcatggcgtttgaatccccacggcgggtgggacaggttggactacaacgatagatgccttggtgccaagaatctaagcctggccaataccgggaggacttggcacggccgcctataggagatggcaccagggggaggaaagcaacgggaagccgactgggatgaatcccggagtggagagccccattggagacgagagggaggccaaagggccatacctgacgcggccacagagacagagaacccccaatgaaccccggcgacacgcgggagtcaaccggctgaatcctcaggggggccacggaggcaacatcacgggggctggggagcatcaacataagtggggcgacagccaatgggagcagctagaaatagggggacgatcgggggcacgcggtgtacgcgcgcaacgagacctggcgcggcggtgaagcaaacccgcagtgaaaaaccctaccacaagaatgcacaccaggaagcgacatacaatctagcggagatgccacactgttggaacacaagaaccctgtacacaggtaccaccgagctggggaagaccaagtgggcagagaagccgagaccgctgccacctgtgcgacactacctagagcgaggagagcgcgagaagaggaaaaggagcacacttaagtgagcacaatctaccacctcacaacctgc

SEQ ID NO: 642271 - DNA, 608 bp, Homo sapiens
aaaattaaaaaaaaaaaaaaaaaaaaaaaaaaaaaaaaaaaaaaaaaaaaaaaaaaaaaaaaaaaaaaaaattaccctaaactgccctttgttttccaccttccgaactgggaacaccctgtcttaacccaattaattggaaaagcactacatcccccttttttaaggtgctgtaaaaacaaacagctccgccccgatggcctttcccaaaagtggcccaccctgattgccttttgcaaaattgtaaccgctaatatgtggataaaaatcgggtaaaatttttgttaaatcaaatatttttttaaccatttggccaaaaccggcaatttcctttctaattgacaaaaatggcccaagaccgttttgagtgtaggtccagtccggaacaagagtccacttttaaacaacttggactcaaacgtcaattgtcaaccggctctcaagcggatggcccactacaccaacctttaccctaattaggccttttggggaccagtcccctaataactttttcggaaccctagtgccgccccccttatatagcttccctgaggaagccccccatcttgccctaacggaaggaaccgcggggccggacgctaggcctt

SEQ ID NO: 642272 - DNA, 299 bp, Homo sapiens
cacgggaccctcgtgttgaggacgggtgcctgagacccctgagcccctcgagcctctgggcacggttggctgcctgtgtgctgttgtctcgtatgtcccaccccgagaagggagttgaacaatgtgagtcgtctgtggcattggaaagtgcagtgctaacatggttttgtgcaaagtgtttagctttgccttcaggcggtgcgtctagcagggctgatgggggccaggactgctcctggctaactgtgggcagggcttgccttccaggaaccccaaagtgtttgacccagctcggtaat

SEQ ID NO: 642273 - DNA, 458 bp, Homo sapiens
  misc_feature (54)..(54): n is a, c, g, or t
  misc_feature (75)..(75): n is a, c, g, or t
  misc_feature (154)..(154): n is a, c, g, or t
  misc_feature (156)..(156): n is a, c, g, or t
  misc_feature (262)..(262): n is a, c, g, or t
  misc_feature (360)..(360): n is a, c, g, or t
  misc_feature (363)..(363): n is a, c, g, or t
ggaggagcccaggtataaaaaggacaaagcaagctcaaatgagaaaatccttcnctgtccgcagcgacatcaccnaagctggaggtggacgccatcgtcaacgccgccaacagctccctgctcggaggcggtggcgtggacggcttgcaattcnantcgcgccggccccctgcttaccgacgagtgccggaccctgcagagctgtaagactggcaaggccaagatcaccggcggctatcggctcccggccaagtacgtcatncacacagtggggcccatcgcctacggggagcccagcgccagtcaggctgccgactccgcagctgctacctgagcagtctggacctgctgctggtatgncgntccgctcggtggcgttcccctgcatctccaccggcgtgtttggctacccctgtgagcggccgccgagatcgtgctggccacgctgcgagagtggc

SEQ ID NO: 642274 - DNA, 313 bp, Homo sapiens
tctgaatgcccggtaacgcttaaggatgtgagcgacctatgaaaacatgttggcaaatcctcgaaattgaaagcacgacgcaaatagacattatccgccaggcttatcttgctcgcttaccgttgtgtcatcccgaaaccgatccgcaagggtttaaagcattacgccaggcctatgaagaggccctgcgactggcggtaaatcctgtcgaggaagcagatgatgaagaaaaagatactgcggtgacgccaagctggtcaggcgtagctttaccatcaataatccctgtgcgttgttgattcccccagcgcgg

SEQ ID NO: 642275 - DNA, 414 bp, Homo sapiens
tccgagtacataaaaaggcttgatttactaccagtcttgccggggggcgtattgagagcctaggaggtacatggaacgtatgatccaggagaaggcagtagaagtataaatgtggtgctgagaagcatcgcgacatggatgtcaccaggtaatcactggagtcctatgccttcaacatgaaagcgagtgtagaagatatcgatacttcaaggcaagataaaagatgaggacaaacagaagattctggacaagtgtaaatgacattatcaactggcttgataagaatcagactgctgagaaggaagaatatgaacatcaacagaaaggagctggagaaagtaagcaaacccatcatcaccaagctgtaccaaagtgcaggaggcatgccaggaggaatgcccgggggtaggcggt

SEQ ID NO: 642276 - DNA, 162 bp, Homo sapiens
  misc_feature (44)..(44): n is a, c, g, or t
  misc_feature (60)..(60): n is a, c, g, or t
  misc_feature (66)..(66): n is a, c, g, or t
caccttactaccagacaaccttagccaaaccatttaccaaatanagtataggcgataganattganacctcgcgcaatagatatagtaccgcaggaaaagatgaaaaattattacccaggcataatttagcaaggactaacccttataccttctgcataatg

SEQ ID NO: 642277 - DNA, 454 bp, Homo sapiens
catgtacgtatatctgggggaagatcttagaccagggggaggacttcccagcatcagagatgacacggatcgccgggctgattgagagacaagatgagtgaggggaagaaggaggagctccagaagagcttaaacatcctgacttccttccaaaagaggggggccgagaaagaggagctgtaaaaaggctgtctgtgatttccagggttgggtgggggtagggaggggagagttaaccgtgctgctgtgagtcccttgtggaatataagggggtagggggaaaggtggtactaacccacgattctgagccctgagtatgccttggacattgatgctaacatgaccatgctggggatgtctctagcgggtcgggggatagcgggagcacttactcaggtggctggtgaattgacacctcagagggaatgagtgcaatagagaggagagaggagtg

SEQ ID NO: 642278 - DNA, 991 bp, Homo sapiens
agcgggcgagcgccaccagggcagcagccgccgcagccgccgcgctgggcagaggagccggagacgcgagcgggcgaggtggcggctggcggcgagagcgggagcagggtaccgggcgcgggcagagctgcggcggcggctggtagagacgggggttttgccatgttgaacctgggtgggtctcagaaactccctgaaccgcaagtgatccggcttgcctcaagcctcccaagggtgcctggggattaccagggcaacagtagccacttgttgccttggccttctaacgtggtttgactttctttattaaaaggtgtggtgtgtccaagaagaaaagcatatggcccttcagaggaacactttttggcgttaataattatggaccggcatggaaggcgttggtacaagggggagaactacaagggcatattaagttgaaggaagaggtaatttggttatcagcaaaagaacaaagtggtcttaagatggacaggactggaacaaagggacatagggacggtggggcaacatgggactccggggcacacagcaggaatagccttaaaagataccctaattaaggatatagaacccatcttgatggaatcactaaggtgtacggaactcagtttgtagggcctgatcgttggaacatgatattcggccaatgttgttatatggggtagaagaagagatttgctagaacgaaacttccttacattcccaaattcttcccggtgaaagagaaaacgtgtttggaaatgtgccatgtattgccaagaaaccataatggcggtcaggttcttaaccatggggtttatgaaaaagtggttgccaaccatttaaacaaacaattggtcgtcaagcgaattggggagtaaggggacagtgaaaaaaacaagaaatcaagagaacgtgtcgggcagagaaaaacgcggaatagtgtgtatgaaggacgcacggaacaggtagaaacgagacaatgatttga

SEQ ID NO: 642279 - DNA, 319 bp, Homo sapiens
caacattggcaggacagtaaccagatgtacctaacccaacacatcttactggcagaggtcagtgggctggagtttgtgctcctcccccacacaagtttaataatacaaatgcacaagaaaaagacttcggtactgtttcctcagcagaggagaaaaactcaaactagttatgagaccaaacacacaaaacaatgaaaagctgcactaactagtccagaatgtaagttaagatgatgctggggtgaataactcgttttttctagagcccttataaatacaatcccccagttaggtgtttgcatttcctgcaaagtgttgg

SEQ ID NO: 642280 - DNA, 1419 bp, Homo sapiens
ctctgctgtggatgaactggccatcaaaccatcagatacagtcctacctgatctctcccttttccataggcagaggagcctcatctcatggccaccacttctataggcccatgggagtactgacaggctaccattgatgttcacttaggcccagtggctctttatcagcttgtggtgaattctgccatgtctggaacgtacccttcagggcagtggctccacctctggcccaggcaggccccaaaatgccatccaagtgccaagacctggaactagggacccaaagagcatgcttggtactctaccccactgtggctgagctggtacctaaggtgcaagtgaaagtccccttttccctttgctttcctcaagcataaggagtctcttaccataactcccacagttggcaatgttctgggtgtcacctgaagccagtatgtctcagagtctcatgtaaggcccatggcatactacctgggaatcactgctggttattcagagtcaaagggatctttggttagcagctgatagattctgcctgaactggatacttcccttcaaggcagcagattcccttctggcacaggttgtgcctagaaatatcatccaggacctagggcctagaaggggccactattgaacaatgacaagccaggaaataacaagtattggcagggatgtagagatactggaacttttgtgttgttggaatgtaaaatgatataactgttgtgaaaaacaatatgtgatttcttacaaaatataaaatagaattaccatatgagtcagcaatttcacttctgagtatatacccaggattactgaaagaacactctgaaggagatatttgtatatccatatttatggcagccatattcacaatagctaaaatgtggatgcaacccatgtgtccattgattaaaaaatgaatttaaaaatgtgatatatatgtatgtatatgcacaattctcaaactgcagggtatatatatgtatacacacacacacacacggtgatattatttagccttaaaagggtaggtaactgtggcatagaatacaacacgcatgacccttgaggacattaggctaaatgaaaaaagtcagtcacaaaaaagtactgtatgattccacttacatgaggtacttagagtggtcaaattcataaggacagaaagtagaaaggtagttgccagaggttgtgggtaagagggaatggggaagtaatacttaacaggtaagagtgtttcagttttgccggaggaaaacagttcctgagatgaatggtggtgattatgaatgtacttattaccactgaactgtatacttaaaattgttaggaggataaattttgtgtgtattttaccacaataaaaatgttttattagaaaaataaaataaaaaaattcattgtaacaaa

SEQ ID NO: 642281 - DNA, 565 bp, Homo sapiens
  misc_feature (55)..(55): n is a, c, g, or t
  misc_feature (161)..(161): n is a, c, g, or t
  misc_feature (163)..(163): n is a, c, g, or t
  misc_feature (175)..(175): n is a, c, g, or t
  misc_feature (177)..(177): n is a, c, g, or t
  misc_feature (187)..(187): n is a, c, g, or t
  misc_feature (197)..(197): n is a, c, g, or t
  misc_feature (213)..(213): n is a, c, g, or t
  misc_feature (215)..(215): n is a, c, g, or t
  misc_feature (222)..(222): n is a, c, g, or t
  misc_feature (235)..(235): n is a, c, g, or t
  misc_feature (265)..(265): n is a, c, g, or t
  misc_feature (291)..(291): n is a, c, g, or t
  misc_feature (314)..(315): n is a, c, g, or t
  misc_feature (317)..(317): n is a, c, g, or t
  misc_feature (319)..(319): n is a, c, g, or t
  misc_feature (326)..(326): n is a, c, g, or t
  misc_feature (338)..(339): n is a, c, g, or t
  misc_feature (344)..(344): n is a, c, g, or t
  misc_feature (369)..(369): n is a, c, g, or t
  misc_feature (379)..(379): n is a, c, g, or t
  misc_feature (383)..(383): n is a, c, g, or t
  misc_feature (404)..(404): n is a, c, g, or t
  misc_feature (474)..(474): n is a, c, g, or t
  misc_feature (486)..(486): n is a, c, g, or t
  misc_feature (500)..(500): n is a, c, g, or t
  misc_feature (554)..(554): n is a, c, g, or t
tgctcgcccaccacccaatcctcgcctcccttctgctccaccttctctctctgcnctcacctctcccccgaaaaccccctatttagccaaaggaaggaggtcaggggaacgctctcccctccccttccaaaaaaaaaaaaacagaaaaacccttttccagncnggggaaagcatnanggagatgggncgccgggctngccatggagctgctgntncacgagntggatcctggttncgcaggccgttcgggaccgcaacctgctcngagacgaccgcgtcctgcagaacctnctcaccatctaggagcgctaccnncngnagttgcnccgacggcaagnngcgtncagaaggacatccaatcctacatgngcagaatggnggcnatctggatgctggaggtgctntgtaggaacagaattgcgaataaatatggtgcttgccctgctgtgccatggaatgaacctggtaccgtgngctgggggctgngggtgccctgactnccgtaagtgccccatgctggctaactgcctgggcgtgtctgtgctggcatggtntcctggttcct

SEQ ID NO: 642282 - DNA, 253 bp, Homo sapiens
ggttttaaggtggggaaaaataagggctctttcgggccattctacccggtatgactgggtaatgaggacagactgtggaccccccatttacctgagtttgattttttaacaacaaaaacttaggggtgcaaagtgttaactgggaaaggtttgtggctccttgcagcctccagggactggcctgtccccgataaaatttaaacagtccccggggaggggatgatacaaggagtaaaccttttttttccctcca

SEQ ID NO: 642283 - DNA, 423 bp, Homo sapiens
  misc_feature (31)..(31): n is a, c, g, or t
  misc_feature (55)..(55): n is a, c, g, or t
  misc_feature (167)..(167): n is a, c, g, or t
  misc_feature (188)..(188): n is a, c, g, or t
  misc_feature (231)..(231): n is a, c, g, or t
  misc_feature (268)..(268): n is a, c, g, or t
  misc_feature (289)..(289): n is a, c, g, or t
  misc_feature (345)..(345): n is a, c, g, or t
  misc_feature (353)..(353): n is a, c, g, or t
  misc_feature (386)..(387): n is a, c, g, or t
  misc_feature (401)..(401): n is a, c, g, or t
  misc_feature (406)..(406): n is a, c, g, or t
gcacgcgagatgtggtgacactatgtgaganagacacttagctctttaaagagtngggtgaatagatgaatagccatcttgacattccttggaaagaaatcccctttgatgagaagtttctttgtgattccaatatagaaagatctcaggttttcattaccatttgnccagtgcaaatgcactatttncaggcattcaacaaattcaacagcactgatggctttcctaagngctgggacacattagatttcaacttgtgtcaaattgnccatttatggtatatgcccgntttttgggggtttcggtttaatctaaaggcagcaagtgagggccaagtacacaggnttgctgtntttgcgctaccttgagagcattgtgacttaacnngtgaatgagttgtntactngtgggctcttttgtgtc

SEQ ID NO: 642284 - DNA, 370 bp, Homo sapiens
  misc_feature (31)..(31): n is a, c, g, or t
  misc_feature (55)..(55): n is a, c, g, or t
  misc_feature (114)..(114): n is a, c, g, or t
  misc_feature (135)..(135): n is a, c, g, or t
  misc_feature (178)..(178): n is a, c, g, or t
  misc_feature (215)..(215): n is a, c, g, or t
  misc_feature (236)..(236): n is a, c, g, or t
  misc_feature (292)..(292): n is a, c, g, or t
  misc_feature (300)..(300): n is a, c, g, or t
  misc_feature (333)..(334): n is a, c, g, or t
  misc_feature (348)..(348): n is a, c, g, or t
  misc_feature (353)..(353): n is a, c, g, or t
gcacgcgagatgtggtgacactatgtgaganagacacttagctctttaaagagtngggtgaatagatgaatagccatcttgacattccttgctcaggttttcattaccatttgnccagtgcaaatgcactatttncaggcattcaacaaattcaacagcactgatggctttcctaagngctgggacacattagatttcaacttgtgtcaaattgnccatttatggtatatgcccgntttttgggggtttcggtttaatctaaaggcagcaagtgagggccaagtacacaggnttgctgtntttgcgctaccttgagagcattgtgacttaacnngtgaatgagttgtntactngtgggctcttttgtgtc

SEQ ID NO: 642285 - DNA, 168 bp, Homo sapiens
ttggcttcctccctccattttatcctcctaaaatgctgggataataggagtgtattagtctattctcatgctgctaataaagatacctaaaactgggtaatacacaaagaaaagaggcttaactgacgcacatatccatgtggccagggaggcctcacaatcatgttg

SEQ ID NO: 642286 - DNA, 506 bp, Homo sapiens
gggccatcatgcccgtacatccagaccctgcgagtgcttagtggagatctgggccagcttcccactggcattcgagatttggtaagagcacagtgcccgcctgtgccaaaccagagggcgatccacatctgtgatggaattgaggctgacaatactgccacactgaccctgctggagcagtcagggtcctcatccgaaagctccctcaagtacaataacgtgcgtggactggacccagtgagcagcaccccaaggagtgtggcacgagctatagagcaagacggtgagttgtaagctccttctcagcggggacacgggtaccactcccgcctggtggggcccgtgggcagctgggcaactggatgtccccagctgatttccagtcgagctgtggatgagaggtttccaggctgcatgcagggtgcgcaaccatgtatgtgcttccattcagcatgggtcctgtgggtctccccgctgtcccgcatacggggtgcagctaccactga

SEQ ID NO: 642287 - DNA, 121 bp, Homo sapiens
atgccccacctactctatgatcagtcgtggcgatgagtggaccctgaaggagtgtgaccccgagctcagcgttgtggagtgcacgggggcggacacgaaagaggtaagatgtgccaacaga

SEQ ID NO: 642288 - DNA, 926 bp, Homo sapiens
tgcgtagcgggctcaggcggaaccggaacggccgtcctcttaccccgcctccgtcgcgcctcctcctcctcctcctcctcctcctcctcctcttcctcctcgtcggttcctcctgagccgcgggcgtgagcggggtgtcggcgggccggtcgggggggcatggctctctggggggggcttggcctgtcgtgtcgggaaggtatgagccgcagagccccggggtctcggctgagcagcggcggcaccaactattcgcggagcttggaatgactggcaacccagaactgatagtgcatcagctgacccaggtaattaaaaatattcttcatccagagatagaggtgccccttcctcttacggactgcaaccttaaaattcagctgtggtgactcggcaaaggcacgatgataccagagtacacgctgacatacagaatgacgaaaagggtggctacagtgtcaaggaggatctggggaaaatacttatggtcggaagtagagagacaagagatgagggtaaaaatgtgaccagcctgagttcaacagtgttcagcatggagtcgtgtttaaacaccaaagaatgaagaaatcaaggagagatcgaagtctatgtgatgagtctcgaagacaaaatctacctaccgaggcatcacccggggacagagaacgcaactggaagatggacaagcaaaaccagtgacagaatgtaatcagacaacagaaaaaaagggaccaaaacaacacggaacaacagccgcgcacctgaggctaacgaacaagacagccaagacgacaaacaaagaagcgcaggaacacaggacacgaacaacagcaaacacacgaatcaatgaccacgagaagaacaaacaaattgccaacccaggacaacacacgtcagcacacagacactacggcaacaccacaaaa

SEQ ID NO: 642289 - DNA, 360 bp, Homo sapiens
ccccgattagtggtgggcagccaggcagaggggctccttacgctcccagacgatgggcagccaggcagagacactcctcacttcccagacggggtggcggccgggcagaggctgcactcttggcactttgggaggccaaggcaggcggctgggaggcggaggttgtagcaagccgagatcacgccactgcactccagactggacaccattgagcactgagtgaaccagactccgtctgcaatcccggcacctcgggaggccgaggctggcggatcactcgcggttaggagctggagaccagcccggccaacaccccgttagcctattcctgagtagaacatggcagccttccgttttcct

SEQ ID NO: 642290 - DNA, 979 bp, Homo sapiens
  misc_feature (463)..(463): n is a, c, g, or t
agcgggctgtttggacgcgggtcgatcgggcgctgtgcgatggcggaggcgggcaccggccgggctgtagaccagtgatcatagtcgctgtgtgccggggagtggagcagccgggggatggatggacgaagctgaggcagcgtatcgtgaagcgattatgcgttgcaaggagaatggccgagcgtgacgcgcccagtcaggagggctaagaagccctggagcagtgcaggcgcccgaaagtccgcggagaccgacggacctcagtgggcaccaggacgctcgtactgactggactgacgctggatggttcaagagaccccccccgtcgacggtccctcagtatccgtgctgaacaaggcagtcaggtagcattcatggtggcccgcagccgccatctcgagcccagtctggccaggcgcccgtaggccgcaatgggcggcaagactggcagtccgcgtagtgnagtgtcccgtcgtgagcggatgacgtagggaggctatggctggggccatgtctgccagatacgtttgcactaagtgaagtgccgacgcaggataagttccggtgcaacggaaaggccttggcagtttaagcactcacattggtggccaggcagagtgcatggccctggagcaaaatagacgagacgttgtcagataggccgtcttgcgctccacgtgatcttgttactgggacctggaaaagcttgcttgtgtgctgaaggaagaggatgcgagtgcggacagctgtgtgaagatcacttaaaaggcattgccaggtgggacccataagaaaggaagaaagaggattgtagaaagggcgtggtggggatccacgcgatttgttgggacgaccacgcaaggttttaggggggatgcaggatcgacaaacacgaggaggtgattggaaaggcttgtggcaagaaattcagttgaattaagcaggtatggagcaagtattttggagcacagagaggtgg

SEQ ID NO: 642291 - DNA, 162 bp, Homo sapiens
tgtagcgcgtgtgaggacaggcagtaatgtgtcagtgtgatgggagctgtgcaattgactgtgcaaaagaggtgattgaatgtgcatggaaggtgtgtgtccactataacaggcatgtagtgtgtcaatgtgatgcagtcgcatgtcatgatgatggagaag

SEQ ID NO: 642292 - DNA, 274 bp, Homo sapiens
tgaaggagtggagccccatcccaatggctttatttatatttactgggacctgccctaatgtttaaccaagaaaatactgggtttaaaggggtttgttgagttattttcttaagcatcattaacccacatccccgtttttcctgttttcattgatctgttatagtcttcagtaaagcatcatatgagtttaacaaccctggaaaaaatcttaaaaactgtgtatagatcagctaacactgacatatgctcagatgcccaggtaatcaaattgtaa

SEQ ID NO: 642293 - DNA, 128 bp, Homo sapiens
gcaggcaaaaccacaggccagtaacgccagtacggtggttagcggcgagttccagcccatcgccagcgtattgctgatcatctcgatatgcgtggaacctgctatcagcgccaataccagcagtgaga

SEQ ID NO: 642294 - DNA, 345 bp, Homo sapiens
  misc_feature (269)..(269): n is a, c, g, or t
  misc_feature (282)..(282): n is a, c, g, or t
tgctggagattacaggcttgagtcaccacgcctggcctgttgtttatttttttgagatggagttttgcactccagcctgggcgacagagtgagactcggtctcatatatatatgagactgacaaattgatacagtttggatatatgtccctgccccagtctcatgttgaactgtaatctgcaatgttgggaggtgggggcctgggtggggaggtggttgggatcatggggggcagatttcccatggaatgggtttaacaccatcttccnggggtttgtcccncatggacagtgagtgagttctttgaggaggaactccattcattttaaaaatgtgttggccact

SEQ ID NO: 642295 - DNA, 195 bp, Homo sapiens
aggatatgtactagcaagaggcttgaaagattgttgatgcatttaaacagacagtgtacacatagttctccattgagacttagcactgggagatgcatggaaatatgattgtagagcaggagatccagagatacattggaaggaactttcatcctttgtgcagacacatttattaaggtatttcctgacgtttgg

SEQ ID NO: 642296 - DNA, 149 bp, Homo sapiens
  misc_feature (98)..(98): n is a, c, g, or t
caggatctctttcagagccttcagtggcaagggtcagaaactgggcagcactgccccccaggtgttgatgttccagctctccagcccaacaggcatgnaaaagtgacgcctaagcctgctcttccatctttatcgattaatcacactgt

SEQ ID NO: 642297 - DNA, 279 bp, Homo sapiens
  misc_feature (62)..(62): n is a, c, g, or t
cactggggccccccccgggggaaagggggtgttttttccccccccgtttcccccccgggggncttccttttttggagagggggcccccaacccgtggtgttggttttaaaaattaattttccccccggaagggggggttttttttttttgggggggggccccccccccccgtttttgccccccccccctttggggggcccttttttcccccgggggcgtttttttcccccccccccggggggggggggttttatggggtttttttgtttttttccctta

SEQ ID NO: 642298 - DNA, 370 bp, Homo sapiens
agcggggaacaatcactttggtaacagtgggcactgctcgggtgatgggtgtacccaaatctgagaatcaccactagagaacttatctggctggacacggtggctcacgcctgtaatcctagtacttggggaggccaaggcgggcggatcacctgaggtcgggagtttgagaccagcctgaccagcatggagaaaccctgtctctactaaaaatacaaaattagctgggcgtggtggcacatgcctgtaatcccagctactagggaggctgaagcaggggaatcgcttgaacgtgggaggcggaggttgcggtgagctgagattgcaccattgcgctccagtctgggcaacaagaatgaaactccatctc

SEQ ID NO: 642299 - DNA, 307 bp, Homo sapiens
  misc_feature (27)..(27): n is a, c, g, or t
tccccccccccccccccggggaaaacnacggttctcatttttttaaatcaaagggtaaatttccctgttttaaccttcatatgaggggaattaacccaaagggaaggcttctttcccctagcaaaagggttttgagatttattcagggtggggcagggggcagggattcctttctttttattgcgggggattctttgggaagaaaaaatcccaggttggttttttatctttctggtgaggggcccggggccctttctgcttgttttttactggtatgaaaaaagcggctatgaacctttttagccca

SEQ ID NO: 642300 - DNA, 938 bp, Homo sapiens
tacagtattgtagtagataaaaatagatgaggctctggacacgttgggtatgatgcaggatctgaatatgttatggtgagttaaaccacgatcattggtaatatttatgatcaaactgtcatgaagtaataggggcttaatacgttggcctgctctcttcaaattagactctaagtgaaatattgcatgattagtttgtaggcctttgaacaataggtcggaggatgaagtctcagggatacctaatatcctggttagggacaacatcagggtcgcctggtacttgcgtgtattaccgtaggagaggccagcatatataaagagtgggctagaataaaactactagagctcgccttcgtcagtgacgccatgtggtggaggctgagagtatgctgaaacttaagatcaggaaggctgaaaggagatctgggagtcgttcctgctgcagattcgaatgtcgtgtctgatattgtagcagtgcatttccttactgtgtagattggagtgatgtcttgctgtgtgtgtagggcgagaaatgccctgaactggtctcctgtaagtggatgacagcaaatattttatagaactgtcatttatcatattctagggctacgttaaattttgaaaggctgtggttatctgtgccgacccctaaggtggggggactagttcattacaccacatgggctaacgagtggactcatgtgtatgcatggattaggaatatctgggtgtagatatttggttaaatgggtattttccggttagagggtggaagatggattggttaagatcatgcgtttatgggttcgggggaaaaattgcaatgaagtagtcaaggtgggcggtgaaaaaatggttagaagcgtatatgagggaaattggaaaaaagtttgtaaaaaaggatggaaaaaaagataaggggtgcaaaatagagg

SEQ ID NO: 642301 - DNA, 474 bp, Homo sapiens
ccggacccccaaatggatctatctatagttaccttaaaaactacatatttaatacttaagaagcagagagtttctagttgaaaaatgtctctagataaatctctcaaacacattacagactgttaacatgtttagaaagagtaactactattaaattctgaaatcagatataagtagtcaccctcatttcccaaaggctcaaagcagaatgaggaggatgacatgagaaacttagttgggacctgcagtactgaacgactagcaatggatgtcttatcccaatactgcccatggatatgaaatggagttagatttgaagatgtttcattctttacagtaacagttttaaaatttctggcactataagtacagtgggttgaagtgtgtgtcccacaaaaagatatgtccaagtcccaacctctggtccttgtaaatatgaccttacttggaaatagggcctttgcaaatgtaatt

SEQ ID NO: 642302 - DNA, 681 bp, Homo sapiens
gcggcgagcctggaaacctggccggcgtaggcacatcatcctggtcctctcaggaaaggggggcgttgggaaaatgcaccatctccacggatgctggccctggcactgcagccaatgcaggcaaagaaggtgggaatcctggatgtggacctgtgtggccccagtattcccccgcatgcttcggggctgcagggcagggctgtgcaccaggtgcgatccgcggctgggcacccgtcttcctggaccgggagcagagcatctcgctcatgtctgtgggcttcctgtctggagaagcccggacgaggccgtggtgtaggagaggccccaagaaaaacgtgctgataaagcagtttgtgtccgactgtgagctggggggagctggactacctggtggtggtacacgtcgccccgggtgacctccgatgagctacatggtcaccatagaaggccctgcgtccctaccagcccctgggggccctcgtggtcaccatgccccaggcggtgtccagagggggacgtgaggctgcgagctgacgcattctgtatggaagacgggcttgcagggtgatgggaatcgtgggagaatatgagcggcttcacctgcacccacactgcactggtagtgtcgaccagcgtcttctccaggggcggcggagaggagctggccagctcgccggggtg

SEQ ID NO: 642303 - DNA, 210 bp, Homo sapiens
gcgttaacagggcaagacggtgaagttcgctcacgctctcgcagcagcttcacgagcttgatgaagttgccgacgaccgcgtcgcaaagtcgtcagtcacaagtcccgccacacgaccgcggcgggtaaagaactgaccccgtcgcaactgctcgagaagctcgggtttgcggccgcgaccctgcagactccggtcaaggatctttccgg

SEQ ID NO: 642304 - DNA, 866 bp, Homo sapiens
gaaccgcttcaattcgcgcacctactccaagttcagcaagctctctggtggtttccttcctcagactactgcgagtactaccggccccggttcttcctcctggagaatgtcaggaacgtttgtctccttacaagcgactccgatggtcctgaagctcacacctccgctgacctggtccgcatgggctatcagtgcaccttcggcgtgctagcaggccggtcagtacggcgtggccagactaggaggcgggccatcatcctgtgaccggtgccctggagagaagctccctctgtttcccggagccactgcagccgtgtttgctccccgggcctgcccagctgagcgtggtggtggatgacgaagaagtttgtgagccagataagcaggttgacgctcttccgtcttctccaggaccaatcagcgcgatgcagagacaacgattgtccgaccgtgaccgcgagagtgcggaagtaggagcctctgcgactggtacgatctcctacgagcggggagcctcagtacctggttgccagaggacacgactcgcggggcgcacagttaccagcccatccatcagggagcacatctgtaaggacatgatgtgcatcggtggcggccggcatgcggcacatccccttggcccccaggctcagactggccgcgatctgccaagatacgaggtgcggctctcagacggcaccatggcaggaagctgaggaatacccaccatgacaggaagaacggcgagacagctctggggccctccgtggggtccgctcctgccgtggaagccggcaaagctgcgacccgcagccagcagtcagaccctcatccctggtgctggcccacacgggacggcaaccacg

SEQ ID NO: 642305 - DNA, 363 bp, Homo sapiens
cagaatatagataaagactagtcaggatcctgcctattccttgaaggtccagaagtatgagcatcaccaattcctgcaagagctccaatttcaaatgtggggatttccaccatcccaccaccagctgttcattttttgcaaccccctacctcagtcccttactaccttagtcccttttttcacacacacacaaagtttttgttttgtttcagccagcaggtcctggaagtccagtgagactgtggaaagatccccaagcccaacagctataatcatgaagctataaccatttcatttgtcccaccctctcccaagctcaataaaatatcctctcaaaggcctgcagagggatttcaaggtcta

SEQ ID NO: 642306 - DNA, 153 bp, Homo sapiens
tggcgaatcctcctcctcctgaggatatagtgaaaaaacagcacagttacaggtatttacatgttccccggtctctccacgcttccaaaaggacacgtcccttacctccttgtgtcctcagcagtgatgagtggttagacagtgcagccacac

SEQ ID NO: 642307 - DNA, 750 bp, Homo sapiens
tgacgagcacgtcaaaggacagtaggtccccgcccggatctggcccacagcacccgagggaccctgcagcactacagaagtcccatggggcagacgggagccacaggcccagactccacagcccctcagtccacatgtcctggagcctgtggtggaagtccctgctcttccatcactgccgcctctcccccaggacctccgaagaaacaggccagggctgtcccaggcctgggcacactgggccaagatgtccagcaccaaccccgtctgacccctccaggccccgcccttcacccgaaagcagctcactccagcagggacaagctcactgatgaggatcggtgatggcgttgagtaaaggcttcctggagggctgctagtccggacagtgctctgcactcggatgatgaatcttgtgactccaaggaggtgggggacattagatagcccagcaaaatagacacatatgcgggatcatatttagagagtagtctgaggtcccaggcacagacagtgttgagggtctagcctcatgccacaagctgggtagcagccagctcagagccaaaagaaccagacttctagccgaaaatcccccccaactttgtttcccaggaaaggtctcacggaaagtacacttttaggacgatccctcatgtggggaccactatcccggcagaacaacgatctgcatcctgaggtgaaggaccggagtgaagagatcagaactttccccggccccgatgtgcc

SEQ ID NO: 642308 - DNA, 928 bp, Homo sapiens
tgcacacaccaacaccaggatccccaggttatgagtcagcacatgtcacccagaggcagggcaccatggtcttcatcggagcctgaggtcagagggcctcttctctgtggggaaccttgacaaccttcttcaggttccatatagtcttgaaaatctttcacaaacttccgttccagctccctcattttttctggtggaattttcattttatcaatgtgctcacgtaaaacactagcccatttctgcagagattccatcacagtccaaggtctagacatgtctgcaacaaaaatgacgagggtctctggcaaggattcagcagaaactgcaaatttcagcaggcctttgtggtacaagtctccatccagaatccacacgttgcagcgcgtgtgatcatctcggtcctcatcatggacactgaggtagagatattctaggcctcttccttttttgccatgctcagctccttgtagtttagtcatgagggttgttttaccagaaccatcttcaccgaagaccaggatgttcttgccggacggcagcttggacctggcgcgggtggacacttcgctcagaatggaggaccataggctctggccttcctcctcctcactggtcaggtcgccggcggccgccaccgcgggcccgttgggacctagcagcagcttcttctccacccccaccggcgccatcttgccaactgcagccacaaagagggccctcccccgggcccgccgaggacccgcgaggacccgggccggccagccccccgctcgccgtccctcgcgccgcgccgcccgccgaccttgccgcggcgactgcgccgcccaacgtgtcctctaggtctgcgatggccacgggctcccacgggttgcgaggccgccgaggtggcggcggcggtcaggcagccgccggggcagccatgcgc

SEQ ID NO: 642309 - DNA, 727 bp, Homo sapiens
tgcacacaccaacaccaggatccccaggttatgagtcagcacatgtcacccagaggcagggcaccatggtcttcatcggagcctgaggtcagagggcctcttctctgtggggaaccttgacaaccttcttcaggttccatatagtcttgaaaatctttcacaaacttccgttccagctccctcattttttctggtggaattttcattttatcaatgtgctcacgtaaaacactagcccatttctgcagagattccatcacagtccaaggtctagacatgtctgcaacaaaaatgacgagggtctctggcaaggattcagcagaaactgcaaatttcagcaggcctttgtggtacaagtctccatccagaatccacacgttgcagcgcgtgtgatcatctcggtcctcatcatggacactgaggtagagatattctaggcctcttccttttttgccatgctcagctccttgtagtttagtcatgagggttgttttaccagaaccatcttcaccgaagaccaggatgttcttgccggacggcagcttggacctggcgcgggtggacacttcgctcagaatggaggaccataggctctggccttcctcctcctcactggtcaggtcgccggcggccgccaccgcgggcccgttgggatgcatcgatactagttgttgtggaacggcgcgcgatcttgttccaagccatcgcaaggtatcttccgttagcg

SEQ ID NO: 642310 - DNA, 1168 bp, Homo sapiens
acatcttcaggccacaaatagaacgagcaattcatgtagttcctggcgggcccagaataacatatgcgagctgtgccaggcagccgcccttccagaggcccgaagtgccaggaccctcccagcgtccaatcctcagggacagcattccctaagaatagcgccagtacatccttctgtgaaagcttaatcttgtgggttgaaggaaatggagtgtcggttacgatagggagtgcatagcgttgcagtactgacagataaggccacaaggttgcgtgcatcatgactctcagatgactttgcaatcctgtgactcatagggctaagtgagcgcagacttgaagagggggaggcaacggttcgggcagctggggagaagttgaccggtgtctgaccccgctgtccatgtgtgcatgctcgatgttggcccagtggctgcgtcccaagaggcaatgtacactcaagctagactacatacaaggagaagcagaaacgacgtacagtcgaacccaggggtgtcgtcactggatagacaggagcttcttagtactgtgagatcgatgggagatctggcatcagtggagcgttaagggtctatgtagctgttggtgcaataacacggatagctagcagtgaagaacatcagccagtgcccagagaggagcaaattgtcccacgagcaataccagtgagcaggtaacagattagctgggagtaggtcgttgaacaggtggctgaatttcggatacgtggtctctccagagttgtgcaaaaaccaggattggttaccaaaggtcagtttgaagcgtcagactaagcttgtagaaggttgtcgagcctttcttggttagcattgcaagtcttcctaagccaaggtcttccttttcccgttgtggttaaccgaagagacattgaagatcccctagaaatgggttgaagaaaagcttccagaaaccttagggcgctctaggggaaaactccgtttggcaaggctcatctggtcacaggggctggggtgtcctggttccctgggagggggccagtgaagtcttaaagggaatggtcaacttggtaagttccctcccccctttggggggtctctctcaccgcaacaacgctggcatggtcccaccacactggggttactctgtcaacacacaaacaccaagcg

SEQ ID NO: 642311 - DNA, 953 bp, Homo sapiens
  misc_feature (306)..(306): n is a, c, g, or t
ttgagagagacaaatgggtcacagctggcaccctgggaatagcacataatccagggtgtgtctgtggtggtggacgtgcaggggaacaccatctgtcctgtgtcatgatgggaaaacaatcatgaaccactggtctaaattaggcctggccatgctttctcagcccctccctcatttaaatttgtcttcccaaagctgagctaaaactaaaccatttctcctctgctggaatgatggattggtcattcagaggaacaataccaggggtgggaggtttgcaggctgagttccccaggcatgggggtngcagggtgtccctgaggtttacccaaagcacagctcgctggcctgtgacctctgcccttcctcccacagtgtaagaccccccaggaagcagctggggcctgaacctctcacctaggaggtaggtttattttattttttgttagcatcaggctctgaaggagttggtatacattttgttttgaaaacatcttctggacttacaccagagcttagtgtcgtctttactatggaaagagaggagaatggacagaaatggtttaactgtgtggagttttgtttgttttgttttaaatggaagaaagaccaaaactttcctggtggatcagctagggcctttgaccctgcattaccacggcattttatccaggtgaagtccagggaaagaactcagccaaatggactaaggaacacacgagtttggaatgcgagactctgacatttttgtgttcttggaaatccaattaccttcccatgcccagatttccttcctgcctcttggaccaggctctggcactgaggttctcactgttcccaacacagacaaagcttcctgagggctggaggggcagcaaggggagaggagaatggggaagaagcgcttgatgtagttgtgtggaataaacagtattttttcttttgtaaaaaaa

SEQ ID NO: 642312 - DNA, 360 bp, Homo sapiens
cttgttctctgggaactacaaccagtttagggagacaaggttaaatgatcacacttaagaggggcataattcagccaggtgcagtggctcatgcctgtaatcccagcactttgggaggccgaggcgggtggatcacctgatgtcaggagttcgagaccagtctggccaacatgatgaaaccccatttctactaaaaatacaaaaaattagctgggcatggtggcatgtgcctgtaatcccagctactcaggaggctgaggcaggagaatcgcttgaacccaggaggtggagaggttgcagggagccgagatcacacacaccactgcactccagcctgggcaacaagagcaaaactccgag

SEQ ID NO: 642313 - DNA, 287 bp, Homo sapiens
gtctaagttgagatacagtttggcagttgtgagtatatagatgtaattaaaaccatgcaacttgtaaatcaccaaggagagtgagtgcaggaaggaggaaggcacccggccctctactcgtttgtagtctttatgcattgtacatttgagttgtgtgcaccgcaaaactgatgtaccaccgggcgtggtcgcacgcctgtaatcccagcatcctgcgaggccgaggtgggcagatcacttgaggtcaggagttcaagaccagcctggccaacatggtgaaaccccat

SEQ ID NO: 642314 - DNA, 112 bp, Homo sapiens
  misc_feature (76)..(77): n is a, c, g, or t
gctccagaggaacggacaatagaatagctagaagagttgcaattacttttgccaaaagaataagttattaggaggnntttttccaaggaaggcaaggggattgggtggaaaa

SEQ ID NO: 642315 - DNA, 423 bp, Homo sapiens
  misc_feature (423)..(423): n is a, c, g, or t
gacagagctgcactcgagggacgaggcctacccataatccagagaggcttgcccagaggaggactatgagcatgacgtgctaccggagccctacttaggggcgggatgacactccgaggtcagagctgtgtaccctgctgattgtcggaccctactccctatccttcgctctggtactgtttattgacacgtctgtgtcacatattgtggcctgaatttgaattaatgataataacttatgaaatcacatatttatcatggtgctgtatgccttttatccctaccatgcctttactgatcatgtgcagtggtgagaggctatgacactgcgtaccaccgggttagtcatgtgatctacatttcattatctaccctgctgctgctcgaatcctagcgcattctagatgtagatacgctagacgn

SEQ ID NO: 642316 - DNA, 257 bp, Homo sapiens
tgcttccccgaccgccggggcaggggccccacggggaacgccagggaacgtgaggaatccggagtcaacactgggccactgtgtgctgccagccgggcgggccgtgatttataaagacagcggaggcttggctggtgtcggggcggtgaggtcacggcggccgggggctctggaatttcttcagaagaattttgcttaccaagccacatacttttctagccatcagtttgatcagaggcaagatgaaaaatatgcta

SEQ ID NO: 642317 - DNA, 302 bp, Homo sapiens
tagctcgctcaaacccgtggaccatgagctgcatgcaatctaggacggctttgaatgtagcccaatgcgaatttgtatcactttcttataacactctgagattagttttgcaatattaatttttttttttctttaccttcatcacctttctctcttgttatttgtttttaacttttggccccagaactattcttcttctaatgtggcccaggtaaaccacaaaattggatacccctgcttgtgttcctaatcacttgaaacccggccatattcatgctatctccactttctgtctatttcta

SEQ ID NO: 642318 - DNA, 898 bp, Homo sapiens
aatcatgtgtgactgagagaactgctaatatctttatggtatcttcctctgtattagtagaatgcagcagaaatctcatctcttttgagaagttaagattatagtgttactcgagaatttcgtgttaatctagaatgtaaactatagaagtggacccgctcaacctatcagtagatgtacatacggaaataggtgacttgagttgataaagtaggatctggagttcatcttcgatttaattgtatttgagtaacaaacgtaccaatacaagttctcgacttaagacacgaattaagtatgtatttgcctgtgaattgggggttagaattgctagagttggtgaaagtatttgcagcacctgtgacagtacccagactgagtgaatgagctcctaagccttcatattaaaaagagcggtccccaatcgacgtgacactacggtactaatggaagtgattttcttccctcaggcgttgagagatcctgatgcacgtatggtgcggatgtgccagggtggttattacattgataatgtcagagttatatgctactattgaggtcatcttctttgcggaaatggtacgacatattgtgagactggcccttctaaagtagagattagagttaaactctgtctgaggattaacatatatactgattagaggtgtacgatgctatgcgatcggaaaactggtccgaacaattcagttaggttttgagggagagatatcccgactggtctaggggtaaaaaaggtttactcgtgttttggggcccgggttttatgggggagggaacgagagagagaagaaaaaaagggggtagagaaaaataaaaaaaagggggttatggggggtgttatttgttaacatgttagtatttatttactttttaagga

SEQ ID NO: 642319 - DNA, 251 bp, Homo sapiens
aagaatgaaaagatgattcgctacttcagttcattaaaatgggattctatctttgaagttcagaaaaagctgcatttcgatgacagctatggttaaaaaaaaaaagcacactaggtgtctaatcagagagcagaggaaatcattgggaaaataaagaacaaaagctataataatgggtaaaggattcccagttagtaggttaaaatctcaggagaggaatggatagcactacaaccaaggtgttcacattc

SEQ ID NO: 642320 - DNA, 351 bp, Homo sapiens
  misc_feature (10)..(10): n is a, c, g, or t
  misc_feature (23)..(23): n is a, c, g, or t
  misc_feature (51)..(51): n is a, c, g, or t
  misc_feature (73)..(73): n is a, c, g, or t
  misc_feature (124)..(124): n is a, c, g, or t
  misc_feature (215)..(215): n is a, c, g, or t
ctcaagttcnacccttcctcggncaccaatgacttcccagggaggcttttnaaaccaaaggattttttttccnagccccattgttttgaaaaaaatagtgtttaaaaggttccttaggagtctnacacacagagtcataaagctacaaccagtacccttcatttcacagacaacaacaggtggggaccttgagtatagcggtcacctgtccaaanacacacaccctcatcctgccacagtccctgccaagcctagattggctgattccaagttcttcgttcttcatggctaaggctacctttgaagtggttttgtcacatgtttcccctgttgctgtttcagatcccgtgg

SEQ ID NO: 642321 - DNA, 413 bp, Homo sapiens
aaaaccgcaatctacaaccatctgatctttgacaaatctgacaaaaacaagaaatggggaaaggattccctatttaataaatggtgctgggaaaactagctagcattatgtaggaagctgaaaccggattccttccttacaccttatacaaaaattaattcaagatggattacagacttaaatgttagacctaaaagcctagaagaaaacctaggcaatgggccaatattcaacattcttaaagaaaagaattttcatgagccactgcgcctggcctgttgtcatctgttttatgtctgttcatatccttcgcccactttttgatggggttgtttttttcttgtaaatttgtttaagttcattgtagattctgaatattagccctttgtcacttgagtagattgcggtgtttg

SEQ ID NO: 642322 - DNA, 1463 bp, Homo sapiens
gaccttgtccagtgaaacaccctcgcgctgggaacgtcagttcgcttctcatccatcatcctctctctcttgctttgaacatggctgcggcactaaagcagacagctgttccgggcacttacagcaaacagctggtggcctgctcgaagccccccagaaaggtgctgtggttcattccaccatctgaccaactaactacgacagtcagctcacaatcgcagcgacacggcctgacacacatacaccctcctgcagcgagggcaaccccgcacaacgcgctgccgccccaacacccgcacagctgcgcacaaccccagcgaacgtgggccgcaacctccctcccccgccgctcgctcacccataccacgcacctcccctgcaccacccacgacgcaactcacgcatccccctgacccgcagggcccgggcacagccacgccggccctccagccgcaacaccgccaaacggagcacaccacgccactgcttccctttcggacacaacccatgaactcaacaaccacagatgtgcaactgacacgacagcacattagaaacccttttccttcaactttcaactcatccacgggaacttacaccgttgcctcccttgggcttgcgaacgcccttgggcatactttacctacgcaaacgtggctaccacctccgtaccccccttcaacgcctggctggctccggatgcccccaaacctctaggacctctcggctcgacacccacgcgccacctcccacactcttcaccaccacactcttacgcggcctcctcccacacctctcacagacattgcttccccacaccaccacgactcaggctccggctcgacacacaccctctctcggaagcaccaacgttccttggctacacgtcaacccttcacacgctctcagttgcctgctacaccccatcctacagcccctatctaacgctctactccctccaccgctaccttcaaccttggccacgctcttagtgcctccctaggcggggctatatcacctttatctaaccccaacccacttctcaccgcctgtgctccctacaggcttttccaattgggctcgcttacacaacttcacaccgcgtccgcactgtcggccccagctgcgcctggccctcccatacaccgttcaacacaaccgcgcctcactgcacagagcaacactcccgcaagccaacctccgcgccccccccacacagggcctgagacacccggcctggccccatacgcacacatcgagccggcatccggcgacccacctggccacacgccgcggcaccgactcccggccccccccccccaccaacaagtgccacaaaaaccgacgccgccctacgcaactcccgcgccccctctccgcccgtcgccgcgcaatccatcacccacgcccccacgccatcgcaaaaacacacacatggcaccccccgtccgccgccctgcaca

SEQ ID NO: 642323 - DNA, 383 bp, Homo sapiens
gtcgacaatggaacgtaattgaatggtgttggggaagatgaatcgaaggatggatggaatggcagcgaagggactggaatggaagggaatgatggaatgtagtagaatgaatgaatggacccgcatggaatcaatggaatggaatggactcgaatggaatggaatggaatggactcgaatggaatgcaatggaatggaatggaatggaaaagaaaagaatggaatggaatggaatggaatgagtttggaatggactgcaatggaatggaatggaatgggcccaacaggaatggaatggaatggaatggaaaagaaagaaatggaatagaatcgactggaatgtaatgagtttggaatggaatgcaatggaatggaatggagtg

SEQ ID NO: 642324 - DNA, 298 bp, Homo sapiens
aattggcaagatgctgagaaactggctcactgatacagtgtcggtgggagtgtaacgtggcatagtcactaagcggaaaagggggttgacagttcttcgaaaaaaaataaaaagaaactaaacatacaactaccagatgacccatcaattacacttctgggcatttatcccagagacatgaaaacctgtatacctatgttcacacaagaaccagtacacaaatgcttatagcaacttgagttcataatagtcccaaagtgaaaacatcccagatgctattgaaacttctaaaactagg

SEQ ID NO: 642325 - DNA, 329 bp, Homo sapiens
cttgtatctttgttttgttttctttttttctgagatggagtctcgctctgtcgcccaggctgggtcaccaggcatggagtgcagtggcatgatcttggctcacggcaacctccacctcccaggttcaagcgattctcctgcctcagcttcccagcagctgggactacaggcacgcgcaccacagccggctaattttttatttaattttttgtagagacgaggtttcgccatgttgcccaggctggtcttgaactccggggctcaagcgatcctcccgcttcagctccccggaattcagctgagcgccggtcgtaccataacagtaggtc

SEQ ID NO: 642326 - DNA, 374 bp, Homo sapiens
  misc_feature (7)..(7): n is a, c, g, or t
gcattantatttgtgattgcaagctgagtacattttgctggtgtattttcaggtaacatgatttccgttcatttctggtggtgggaggggactgaagcggtttagtacttttccagaatgcaacctataaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattcca

SEQ ID NO: 642327 - DNA, 370 bp, Homo sapiens
agtactgcaagctggcaggcatgcgagctggcaggcatgaggaaaacaagaaacttctggacagactgtatctcccagcctttcagggccaatgagacaaagatttaaggaagactgtcacctcacaaagagctctaccaggctctcagatggcacccctaaggggttacactgtagaaaaagggaaggatcaacaatagacgaagtctcatcaaaatgcaactcggctctgaccagctacttgccacctggatggagatggacagctcaccaccgaccacatttcccatggaggaaaggaaagccctctctggaagaaaacaccctgctggagtctctggcttgtgatacacaatgagcagcacaccac

SEQ ID NO: 642328 - DNA, 256 bp, Homo sapiens
actttaaaaagtacaaaatacagacacaaaacaatagtattcctgtaaggacttattatgagccaaacagctaagctacatacttgatccattacctcatttaaatctcacagcactaggaagcaggtactgttattggccccactttaaagattaagacactgaggctcagagacactgaggcacttcacgatgatctccagcatctgaatgtaaacccagacattctaattcaacgtccaactgattaaccatg

SEQ ID NO: 642329 - DNA, 478 bp, Homo sapiens
gggaaggatagatggcaaggaaagagggaaaggatgagtcatgtggtaaaagagatgcataagaggaggataatgtggtagaagagtataggggaatgcaaagtagaggggtagatgataagaggaggagatgaggcaacaggaggagaagtgagttggattgcggggatcaggagtatgaagagggaagaatggggaggaagtggatgtaagatggcaggcaaagagagtagaagaatgtgaactatgggttgataagtagagaggaaagatgcaaggagacaggtagttggacaagaactagagaagggttcatataagatgcagaagttgtcagtggtaacaagatatgggacacatggagaagagagaaataaaagagcatagaagtagagctatacagcacacgagatatatatatatatctatatatatatatatatatatatatatatatatagtgccgaattcctgcagc

SEQ ID NO: 642330 - DNA, 112 bp, Homo sapiens
gggttgatatatatgagtagtaatggaatggctgagagcttggggggtagcagtcagactgtggcccaggctgctatgcctcgactctttgtagtatggaatatattacctt

SEQ ID NO: 642331 - DNA, 674 bp, Homo sapiens
gtggatcgtgttcgcactccattttagctgtctggacacttcttataatagacctgatgccacatgatttggctagagcagccgcttacgggttggtgcatcggaccagtgtccctaaggaagtcgttgatcatatcatctttggtacagtctattcaagagaaagtgaataacaagcatatgtggctagagaggctcgccctttgagatgctaggcattctctgacatagactcctgcctcacatctgtcaccatggctctgtatctctgccaaccaagccatgaccacaggtgttggcattgagttgcttctgcccagtgtgatgtgactcgtggcaggattggtgtagagttagatgtccgatgtccctatcggcgtcagcctcaaggtaaccacctgagaataatctgatgcttgagtctcaattaatggccaacatctatgtgtcccagcgatctgtctttaatctctaaattccgactttaatttgcctagcacctgagctccctgccggtttgctgagttctccaccagtgagaccatggggccactctgaatgaccgaactggccgtgccttatgcactgttctcgggtggaacagggatgaatatgcactgggctctccacagtctagccatgaaggcacaggatgaaagggcctcctttctgat

SEQ ID NO: 642332 - DNA, 185 bp, Homo sapiens
ctggctgggcagaaacgctgagattaacagtgccttgagcatcacagccggcaagggtctccgagctcgcatccccggcctggggcagctggaggtgcctcagaaggtgcattctgcttcctgcaggcgtttgaaacaccaaggcactccaggtatcctgaagtcaaagtagcagccccggttgt

SEQ ID NO: 642333 - DNA, 1707 bp, Homo sapiens
  misc_feature (797)..(797): n is a, c, g, or t
  misc_feature (836)..(836): n is a, c, g, or t
  misc_feature (843)..(843): n is a, c, g, or t
gcttcctggtgctgcccctgtggcaagactggacgtgtggacaacgaatgcgcccacgtgtctgtggccacacagcccctgtgctaaacatcgcctggtgcccgcacaatgacaacggtcattgccagatggctccgaaggactgacacatatcatggttgtggtgagatcccgcgtatggggtgcctcgatgcgtgtgcccgtgtctgggtagtccctgtcgtcaccctgagagtggcactacaccaatgcgtgtgtggcatttgtgtgcctggcactaccacagcccataacgtgtctgctcagtgcacggttgtgacaacggtgatcatgggtgtggtgacgtgggcactggggcggtcatgtctgacactgggtcccagaagtgtgcgacctcagacactgatctacagtgtaggatctggagccgtagatgggaggcctcatttgttaccgtacctgcccggtgacatatgcgctgttgctgcatcatcggagccccggcatagaggcgatcgtgatcgtgacctgagaatggacccgatcgcgccgacgcatggggatcccgtgcaccgctgttgtgctaggtgctactgtgtcgtgaggggcacagatcctgaccacgggcttcagccgcatgagtgacgcggcaggtggcgctgtggtgacacaaagcacctggaggagccgctgtccctgcaggagctggacaccagcagcggtgtcctgctgcccttctttgaccctgacaccaacatcgtctacctctgtggcaagggtgacagctcaatccggtnactttgagatcacttccgaggcccctttcctgcactatnctctccnatgttcagttccaaggagtcccagcgggggcatgggctacatgcccaaacgtggcctggaggtgaacaagtgtgagatcgccaggttctacaagctgcattggagcggaggtgtgagcccattgccattgacagtgcctcgaatagtcggacctgttcccggaggacctgtatcccacccaccgctggggtcccgatcctggcctcacggtctgaggagttggctggtggggtcgggtatgctgggccccttcctcatctccctcaaggatggctacgttacccccaatggagccgtggagtctgagggtcacacccggggcctggtacccgggccgcaggtgggcacgcagcctagtaggcctagtggcagctcccagctcgcgatgccgtgtctcgtgctgagaggaggccgatgcggaagctccagggccacgtgtgctggagcctcacagaagccgcttgtacacggctggcgtgagactgttccaggccatcgtagagccccgcatgggcctccagtcgtggtctagccaattcgcatcctatccaagatcagcctccgcatgtccagtcactatcggcagaggaaggagccctccttataaagatggcgtgaacttttcttgcttgaaggcttcccgctgtggctggccccccttcttgggggctctcctactcgggtcgggcgaaccgggcgtctggagcggccccgggcctcagggttttttcagcgcggttttttaccagggtgaggcccgcgggcccccagtggcgcgccgttttcgaagccggggtcgttcctccctccacgaggcgcccaccgacccggccctgcccgcgcccgcgcgcccccccccccccc

SEQ ID NO: 642334 - DNA, 164 bp, Homo sapiens
tttgaaacccccaaaatttggggcctttttttccggaaataaaacatgttttttttcagaaagggaaaatatgggggcccccccaccttttctgttaaaggggggtatctttaaatgtccacccggttgaaccccgttatgagaattttctgcccagggtttta

SEQ ID NO: 642335 - DNA, 413 bp, Homo sapiens
  misc_feature (146)..(146): n is a, c, g, or t
  misc_feature (375)..(375): n is a, c, g, or t
caagtgtctgacctggagcgagtgaccttaaccttcctgaaccccaggggcctctttttaattatttattttttattttatttatctattttttgagatggagtttcactcttgtcgcccaggcgagagtgcaatggtgccatctnggctcactgcaacctcctcctcccaggctcaagcaattctcctgcctcagcctcctgagtagctgggactacaggcacccaccaccatgcctggctaattttttgatttttagtagagacggggtttcaccatgttggccagggaggtctcaaactcctgaccccaggtgatctgcctgccttgggcttcccaaagtgctgggattacaggaatgaaccaccatgcccnggcctttaatttcattttttgcgggctggctcttttgc

SEQ ID NO: 642336 - DNA, 207 bp, Homo sapiens
gccaggtctcagaatgtgtaacagtgcctgttcaattccccttaccccaacagaaatagactttaagagtccacagaaaaagacatacaaggatcttaaaatatacaaaaatatcttttagcgactcataagaagggaaatcaaaacaaaaactacactgttgtataatttttcacatattatcaatttccaaccatgacctgtccc

SEQ ID NO: 642337 - DNA, 369 bp, Homo sapiens
  misc_feature (35)..(35): n is a, c, g, or t
atttttggttggttggtttggtttggttggggggnggggggtggttttttgccccccatttttgggttccttttggcctggttgaataaaagcggagggtccttttggttggttttttaaggctccctccaaaattccccttgggggttggcggggggggtgggttgccttggggtaaattttttccgggggttggttttgcccggtttatttaacccaaaatccccccatgaagggggctttttttggttggcccttggccaggatttgggccttaaaagatttttttggttttttattggaaccaaaggttttccccctttttccagggggggcttttttttggggcccttttgttccttattaaaa

SEQ ID NO: 642338 - DNA, 150 bp, Homo sapiens
gagtacttgcggcacctggctcgcgtgcgccgcgcgacctcctctgcttcgtgtaccgctggattcgccagaccctcctggcagcgacgtggaaagtcaggcacaggcgggcttccgcggctgggggactcctgggaaggataccaagtc

SEQ ID NO: 642339 - DNA, 1724 bp, Homo sapiens
  misc_feature (371)..(371): n is a, c, g, or t
  misc_feature (803)..(803): n is a, c, g, or t
  misc_feature (1555)..(1555): n is a, c, g, or t
cacgaggcccgtcaacgtgatgattcggtcttcgtgtttgactcttttagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgacgacgtcgtgcaggccatcaaagaccacgcctttgttacntcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgctgatgccaagctgtccttcagtgatgacattgaacagactatggaggaggaagtgccccaggatataccccctacagaactacatttggggagaaatggttccacaagaaggtggagaagaggncgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgncgtggtgccctcatccacaatgtctccaaggagcccgggggctggtggacgggaccttttggaccggatcccgcgtacttcgcctcactacgctgcgggctctccacgcgccctccgcggcctcaacgccgctttgtacgccccttgggctttggcgggattggccctc

SEQ ID NO: 642340 - DNA, 167 bp, Homo sapiens
agactgagaaagatattcagtccaaccattgtatggaacaccatcaacagtatttgtggtaaaataccaaaagcagctttttcttctttttaagagacagggtcttgctccgttgcccaggctgcactgcagtggtacaaccacagctcactgcagccttgacctcc

SEQ ID NO: 642341 - DNA, 2722 bp, Homo sapiens
  misc_feature (38)..(38): n is a, c, g, or t
  misc_feature (50)..(50): n is a, c, g, or t
  misc_feature (1369)..(1369): n is a, c, g, or t
  misc_feature (1801)..(1801): n is a, c, g, or t
  misc_feature (2553)..(2553): n is a, c, g, or t
aagcatagtagagcccggggttaatcggacgaggcggngctgagtgaccngagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgccgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgacgacgtcgtgcaggccatcaaagaccacgcctttgttacntcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgctgatgccaagctgtccttcagtgatgacattgaacagactatggaggaggaagtgccccaggatataccccctacagaactacatttggggagaaatggttccacaagaaggtggagaagaggncgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgncgtggtgccctcatccacaatgtctccaaggagcccgggggctggtggacgggaccttttggaccggatcccgcgtacttcgcctcactacgctgcgggctctccacgcgccctccgcggcctcaacgccgctttgtacgccccttgggctttggcgggattggccctc

SEQ ID NO: 642342 - DNA, 367 bp, Homo sapiens
cgcctactactactaaattcgcggccggtcgacactcatccttgttccaggacttagatagcctggaaagctgtttgccttcggaagtcgttattatttctgagtcaccgaacaacagctcggctgcacctttaatctcgctgacccaggcgcggcccgggcctggcctgcgcacgaaagatagtgcgacgttcatatcacgtgcacgggtcaggcccacatatagaagacgcttgttctccgccaatgcctctgcctgcatggcttggccagttacgctggcttcggcattgagtgcggcttggggctgggaccgcttgccccagctctttaaccagcagtggacgaagcggttggcgagtcgacg

SEQ ID NO: 642343 - DNA, 809 bp, Homo sapiens
ctgaatataatcaccaccccccctctctggaagaaaaaattcttttttctcgcgacaggaatatacttatatttcttaaataataagagtgagatgcgcttctcattataaaaaacaaatactacttctatatattagaacatcacacccctcaatctaatctcactccactgtttttgttttgttgcttccctccctcccccccccccccgcgctgttttctttctccctcgtgtgtggcgtgataattctgtggacctctccctcccccgcttgtttgttttctcgcccctgcgcctgttttgtttttttttctctatactcacccctctctctcggtgtgtgcgcgctcctctcttttatcttttgttgatataacaccccctcctcctctccctctcacacatatacatacaccccccttgtggtgtgggcggccccccccccctcccctctatgttgtgcgacatgcgccgctcccgggtgtatgtccgccctcgattttgttttttattggtggtgcctcaccaaaggagcagttatagatgtgcgccccacccctccccccccctccgccctctcctcctcctcctggcgggcggcggcctcttctttttttatataataagaagatagatttgtattaagaataaattttatttatataaatatattttttttttttttttttttttgttgttttcccccccccccttttgtttttttctctctctctcttgcttcggccacacacaaaatcctcctctctatatatatatataaatatattttctctctctcccccccca

SEQ ID NO: 642344 - DNA, 2862 bp, Homo sapiens
  misc_feature (1509)..(1509): n is a, c, g, or t
  misc_feature (1941)..(1941): n is a, c, g, or t
  misc_feature (2693)..(2693): n is a, c, g, or t
gaggcctgggcttggagaaggagcgtcgacaggggtgaaggtgaagttctggaaatagaaacagtgatgataccacatcacagcctgggggccactccactgtcacagggctgttgggaagaagctgtaaggtgctgctttcatctatacaagttgtgctggtggccagggtaggcgtgagtttgggaggtgaagtatctgtgtgtgtgaaggattctgtttgagaaagaaggaaatgggaacttactaattgtagaatggaaactagcaaaattaggcaaggcatggtgagagcatgtgcagcaggaagaggagaccccgcagagctcagaagaggtggaggaggggctggcctccccggcctcaggacttcagggatcccactgcgtcttctctgctcctgcttcggctggatttcaccggccaggtgtctctctccccagcactaccagccactccaggatgtccctggcctgccaccagcctccaccagtgggaaaagcccctacaccagtggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgacgacgtcgtgcaggccatcaaagaccacgcctttgttacntcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgctgatgccaagctgtccttcagtgatgacattgaacagactatggaggaggaagtgccccaggatataccccctacagaactacatttggggagaaatggttccacaagaaggtggagaagaggncgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgncgtggtgccctcatccacaatgtctccaaggagcccgggggctggtggacgggaccttttggaccggatcccgcgtacttcgcctcactacgctgcgggctctccacgcgccctccgcggcctcaacgccgctttgtacgccccttgggctttggcgggattggccctc

SEQ ID NO: 642345 - DNA, 200 bp, Homo sapiens
agtgaggcagatcctcatggcttggtgcggtgccatgatagtgagtgagttctcacttggtggtttatgcaagagctggtgtttaaaagagcctggaacttcctcctctctcgctgctctctctcaccatgtgacacactggctccccttcaccttctgccatgattgtaagcttcgtgaggccctcaccagaagcagat

SEQ ID NO: 642346 - DNA, 858 bp, Homo sapiens
tttttctgccaaggaggagaagagaggagaggagagagaccaagataacaagatcagagagtccgaaattggggtatgctctatatgagtcgcccgcagttctgctggcccaatgagatcacttgctctgtgaacccgggtctcttcacagggccttcaacatggatgtgacgttttagacgaagatcgcctgtggccactctacaacaattggggtccccctctgaattaacgccttcccaatgggaacccatttttgggagaccccggaagtttctatgaacccctccggagcttcccctgttacaacaccgctccccagtccccggccccccttttttggccccccccggccggaaataccactggcaattatctaccaaaacagtccttcctgcaaaaagacccaatgtcccgtcgcccggttctgcaatataatgttaccccgggcaacttctgttaaaaatgcttgcccccccccccttctgacagattcttctgcttttcagaaccaaaaactgggaacaggtacttcctctcagaacgttcccattagtacgttattcgcgtatcagatggtaagcgttactacgataaaatgactgcctcttccaagaaaacccccaccaccttgggcgaacattgcatcatggacgacccggtggaatctctccgcacccttggaagctgtttcgtccactgcacactgcttcacacagacgcgaattgtgaaccaaattatccaaagcctcctaacactgtatttcaaaacagattaactgagaatcatcaaaaaaaagtacacaccatctgcatttatgctttctttccccctcccccgctagaaaaccccctgtt

SEQ ID NO: 642347 - DNA, 335 bp, Homo sapiens
cggcatatgacaaacttctctgtctccgatggggtgggcaccaatcgggttgtatgcccacggctcatcatccgtcctgtggttgatcaagcatcgcacagtcattttaatctcaattgttccttgctcccggcaacatgcaatttacagagacacagaatccagtgatatccctacaccgtattgttacattccgtgctgttgtcatgctcgtgggggtctaaacgcagcaaccccgtgagttaagacacaagaatttcatctgaactcatttcagccacatcatttttttgcctccacaaaaaaaaaaaaggaaaagaagacccaaaaaaaca

SEQ ID NO: 642348 - DNA, 410 bp, Homo sapiens
  misc_feature (30)..(30): n is a, c, g, or t
ctccctagctcatgttgctatgaaaagctngaggggtggccaggcacagtggctcatgcctgtaatccttagcactttgggaggctgagtggggcggatcacttgaggtcaggagttcaaggccagcctgaccaacatgatgaaactccgtctctacctaaaatacacaaattagccagacgtggggcgtggtggtgtgcacctgtaatcccagctactcgggaggttgaggcacgagaattgcttgaaccccggaagcagaggttgcagtgagccaagattgcgccactgcactccagcctgggtgacagagcaaaactccatctcaaaaagaaaaagaaaaaaagaaaagctagagggtccaggtcagtcgctcatgattacccagcacttcgggagccaaggcggcc

SEQ ID NO: 642349 - DNA, 368 bp, Homo sapiens
  misc_feature (48)..(48): n is a, c, g, or t
  misc_feature (70)..(70): n is a, c, g, or t
  misc_feature (72)..(73): n is a, c, g, or t
  misc_feature (110)..(110): n is a, c, g, or t
  misc_feature (113)..(113): n is a, c, g, or t
  misc_feature (121)..(121): n is a, c, g, or t
  misc_feature (124)..(124): n is a, c, g, or t
  misc_feature (136)..(136): n is a, c, g, or t
  misc_feature (144)..(144): n is a, c, g, or t
  misc_feature (146)..(146): n is a, c, g, or t
  misc_feature (157)..(158): n is a, c, g, or t
  misc_feature (195)..(195): n is a, c, g, or t
  misc_feature (197)..(197): n is a, c, g, or t
  misc_feature (200)..(200): n is a, c, g, or t
  misc_feature (209)..(209): n is a, c, g, or t
  misc_feature (216)..(217): n is a, c, g, or t
  misc_feature (259)..(259): n is a, c, g, or t
  misc_feature (269)..(269): n is a, c, g, or t
  misc_feature (271)..(271): n is a, c, g, or t
  misc_feature (281)..(281): n is a, c, g, or t
  misc_feature (292)..(292): n is a, c, g, or t
  misc_feature (302)..(302): n is a, c, g, or t
  misc_feature (304)..(304): n is a, c, g, or t
  misc_feature (307)..(307): n is a, c, g, or t
  misc_feature (310)..(312): n is a, c, g, or t
  misc_feature (316)..(316): n is a, c, g, or t
  misc_feature (327)..(327): n is a, c, g, or t
  misc_feature (329)..(329): n is a, c, g, or t
  misc_feature (335)..(335): n is a, c, g, or t
  misc_feature (337)..(338): n is a, c, g, or t
  misc_feature (341)..(341): n is a, c, g, or t
  misc_feature (344)..(345): n is a, c, g, or t
  misc_feature (362)..(362): n is a, c, g, or t
  misc_feature (366)..(367): n is a, c, g, or t
ggccagcctccagtagagaatgcgattcaggaagatggctcctcaganggcagggaggttagctacggcngnngctcacgtggaaatgtccagtgaaccaatgccaaggnagnagataaanttntctggggctgtncacaacantnggggtggatanngtcaaaccacttgcctgtacttctcctcttctctttntnccnttccctgcnggccggnnccctcttttcccctcctcttctttcccccccgccactttccntcttctcccncnccctcctccnccccccccttncccctggtcncnccnccnnngccncccccccctcntngcctcncnnccnccnncccctgggcccccctcncctnnc

SEQ ID NO: 642350 - DNA, 453 bp, Homo sapiens
  misc_feature (21)..(21): n is a, c, g, or t
  misc_feature (371)..(371): n is a, c, g, or t
  misc_feature (390)..(390): n is a, c, g, or t
cgaaccgacccccacccacgnacacccggacccccgacgaaaagcaaccgcccggccaagagacagcgttagggggggcaaacccaccaaaaagcagggaccccaccgccaaggcccacaccacacccaaacccaagccgaacgaccaccacggcgcgcggaaggccacaagcaaccccaaacccccgaccaacgacaacagggggcacgccagggaggcccaaacgcaaggccaaagccgaactaaaggggccgggacgaaagggggccaccagaatcaccaaggacccgaagcccaaacgaaaaagcccacgcagcaggcaacaaacaaccacaaacagggaaaccaaacaccccccccaaaggaaacncgggagggcaaacaaacgncaagacagcgccaacccccaccccaggggggcgccggcccaaagggaacagccaagcaaaggg

SEQ ID NO: 642351 - DNA, 115 bp, Homo sapiens
cttgtacagcatctctgtatatctttagcagtatcaatcaagaaaagtcatgctgctcttttaagtgagtcactactgctcagcaatcctttcactgacactagacagcatatca

SEQ ID NO: 642352 - DNA, 245 bp, Homo sapiens
aggatcttccttgcgaccactgattgattgattgattttttgtttctgttgtttttctgagatggagtctcgctctatcacccaggctggagggcagtggcgcaatctcggctcaccgcaacctccgcctggtgggttcaggcgattctcctgcctcagcctcccaagtagctgggaccacaggcgcccgtcaccacacccagccaattcttgtcttttctaatagagatggggccgggagcggt

SEQ ID NO: 642353 - DNA, 391 bp, Homo sapiens
cagcacaccttcaccgggaacccactctgcttggcacaagcacccagcgttctccaggggcagggcagaggggacagatgaccccagggcccctatgtactctgtaaaaggaggggcatgactcctttcccccattacagggagtcaagggactaagaggggcacagattctcgaggggacagcatcagcgctcaggattccatgcctcaggcatgtgccatgtaccatacaccaaagacaggtaggctgcaaagacccccagtctaaagcgggttgggaggtattgctccatccctcatggagacagaatctactgtgggcacagagtagcgaatgattttgcatctctctcttctctaagaacctttagacagtcaaattacaacgcaa

SEQ ID NO: 642354 - DNA, 170 bp, Homo sapiens
aattaggggaagtattgacggggagaaagctcccccccagatattgtccacactgctccctgaggccgtctcacgaccatctccatctggctgactcgcgcaatgcccccggctctaggcctccgatccccacaggggatcgggcggcgcattccccaccatcctcatcc

SEQ ID NO: 642355 - DNA, 695 bp, Homo sapiens
gcttctccaaacttcagtgaccacacctgtgttcctgcagcttgagtgtctctcagaatgggtgtctcttagggacacactgctgtagctcaacacacggagcattgccgaacactttgagcctggagaataacacgaaccacagatgagcctcttggaatgaccactgtggggacctgaaggtgtgtactggaggctggacaagcgttgaggggctcccctggcgagcatctgtgacaggtttgatgaggcctgttcccagcagtggcagtgagactggcatgtctggatgacctctacccagaggcccagctttattgcaggctggctctgaatcctttcatctctggccgacagccggacaaagtgccagagctgagcagctgcctcagttctccagcccctgtgctctgagaggccacacaggggacagagatcagaggagccgacaccaaagtgatgcaactgccctcccaggaatgctgttctcaacagaggaaaaagagtggtgaaatgggagccatgggccctgtcggggcaggacaggcttctagacctcatcctcgtgtttaactcctttatttgacgtatggggaaactgaggcccaagaagggaagggagttgcctaaattcacaacagctggacacactttttcaaataactccacttatcttacagtagttttgcacttac

SEQ ID NO: 642356 - DNA, 305 bp, Homo sapiens
ccctctaaaggatcccccagagtccagacagcgcccattatgaatgcgtcctgtgactcacacacctaccaccatgtcccacctttaacattggggattacacttggacatctttttgggagaggacaaacatcaatgctatatcagccagactacaccacaaccacagccgtaactggttgagcacatgctatgtaccaggcaccatactaagtgctttccatgagctatcacgttcaaccctcacagtcctctgcaaggcaggtactcttattaccccttcctcaagcagtgtttggactctg

SEQ ID NO: 642357 - DNA, 834 bp, Homo sapiens
  misc_feature (42)..(42): n is a, c, g, or t
  misc_feature (76)..(76): n is a, c, g, or t
  misc_feature (106)..(106): n is a, c, g, or t
  misc_feature (109)..(110): n is a, c, g, or t
  misc_feature (117)..(117): n is a, c, g, or t
  misc_feature (122)..(122): n is a, c, g, or t
  misc_feature (158)..(158): n is a, c, g, or t
  misc_feature (214)..(214): n is a, c, g, or t
  misc_feature (217)..(217): n is a, c, g, or t
  misc_feature (220)..(220): n is a, c, g, or t
  misc_feature (229)..(229): n is a, c, g, or t
  misc_feature (308)..(308): n is a, c, g, or t
  misc_feature (383)..(383): n is a, c, g, or t
  misc_feature (439)..(439): n is a, c, g, or t
  misc_feature (473)..(473): n is a, c, g, or t
  misc_feature (477)..(477): n is a, c, g, or t
  misc_feature (503)..(503): n is a, c, g, or t
  misc_feature (668)..(668): n is a, c, g, or t
  misc_feature (765)..(765): n is a, c, g, or t
  misc_feature (794)..(794): n is a, c, g, or t
aggaaccaataattccttgggggttaatagctgttccccaanaaaagggttctgtggtcaaataagtttagaaaanatgggtaaaagaaggtttagcaagaagctnttnnatagggnttgtnagagccttaaaggcaataacggccttagtgaatgtncaacttggaggaacagaatgtgcagcactaccgaaagttattgaaccaaaaaaccnctntcncacaaaagnatctagaagggtggtgtaacatgggcacccagttggaaagtgctgccctaagatgtagatgaccgctaatggaaatggnacctgcatcaggcagtaggttgggggaattatggaaggagtagtgctgtggcgtgatgggcacagaaaagaaatnaaaagtaatgatgatgaaaggacaagacaagactcggcccctcccaccatcctganttttgctgttcccagagcagaagctaaatagggntgtncccatgggtgggtcctggctgcccanagaggagacttggagtccaagcaaaggggcaagaggcctggcactgccaaacacgcttgtctccgggaggggtggcctgggttcgccagcctccagccaggaggggaagatgaggtgggggtggccgctctgactcctggccgctctgttccacccacgcccgcnacctcgccaccccctgccccttctctagggccagccctgcccccagaggcttgtgtgggccggcgggcgcttcaccaggcagagatgagcatctggnaggtgctggagggcatccagaccagcccnccagacggaactggagggagccgatgacaaagcggagagg

SEQ ID NO: 642358 - DNA, 727 bp, Homo sapiens
  misc_feature (235)..(235): n is a, c, g, or t
  misc_feature (291)..(291): n is a, c, g, or t
  misc_feature (493)..(493): n is a, c, g, or t
  misc_feature (497)..(498): n is a, c, g, or t
  misc_feature (508)..(508): n is a, c, g, or t
gggtgctataggccgcatagattatccatgcagggaaatcagtcagcttggtttacagtcgtggcttccaacatcctccctgtgcatatcacctccttggacaggggacagatcgcatctggtagtcaggtaagcatgtgcatgtggtcagtaccgttagctgtccacgacttccaactgcgcgtctggaacacacgatgcgatagtggcacgtgactgttccttccatccttgntttgccttgaaagggaccaatgtacctggtctaaacaaagacgaacagtgggaccnttgggcgagtgcgaaattctgtcgacagtgtcgagagcttgtggctcctgaagcaaatattcacaagggtcttgtctcccattcgttgactatgaggctcttggggggaatgtctccaaaggataacaaacaagcgccgttaaaagtttgttttctacaagggggggaacgccaaagggaaacgcttgggcaattctgtccnccgnnaaggggtacnttaaagttagcggaacccgtttgtgcacaaaaggggggaaaaaacctcaaaggggttaataattgattgggaacccccgggttacgccgggtccccccatcatcgtttgcgcagtatactgtgtttcaagcgatcgaagaggtaccagtcgcatctaagaacaagttgtggccgtataaggagacctaaggaagccgttccttgccccttatgtacgaa

SEQ ID NO: 642359 - DNA, 740 bp, Homo sapiens
tggtgcgctgcgatccgtgcgagcgcgcgtgcactggcccatttgcgcgcctccgcccgccgtgtgcgcggatgcttggtgcgcgagccgggctgggctgctgcctgtatctgtgcgcactgagcgagggccagccgtgcggggatctacaccgagcgctgtggctccgggcttcgctgccagccgtcgcccgacgaggcgcgaccgtgcaggcgctgctggatggcgcgggctctgcgtcaacgctagtgccgtcagccgcctgcgcgcctacctgctgccagggccgccaggtccaggaaatgctaagtgagtcggaggaagagcgagcgccggcaagtgtggagagcccgtccgtctccagcacgcaccgggtgtgtgatcccaagtttccagcccctccattcaaagataatcatcatcaagaaagggcatgctaaaagacgagccaggtgctacaaagttgactacgagtctcagatgcacatgatacccagaaattctcctcccgagtccagcgggaagacagaagtatggtccctgccgtagagacatggcagaacccgtgattacctgaagttcctcaatgtgctgagtccagggttggtcccattccaagttggggcccgcagggttctcagaagaacagggtccctcaaggcgaacggctcgcggtgtggaacatggcgctccggaaccccatgaaggagagtcgcccttaaaatactccaggattgcac

SEQ ID NO: 642360 - DNA, 247 bp, Homo sapiens
  misc_feature (84)..(84): n is a, c, g, or t
  misc_feature (88)..(88): n is a, c, g, or t
cggaaggtaggaggatagtgacaaggatggctttttttccttgggtgcctgcccacatgtgccagaattacttatatttatagnaagnggcttgttctttttattaacattgatgtgacatcgctgttttcaattttaccttatgcaacactaaaatctttcatgaattactattgtgccaccacgaatagtgatttgtcgaatttagaactgcgcttctagttattaaagctttatgagctccacg

SEQ ID NO: 642361 - DNA, 115 bp, Homo sapiens
gggcgtacaactcacatatgacgcccacttgttcctaaacaccctttacgacagcacctctcccacttgagagccactgggtccgggaatgaatgtgtctgcactaacttggtct

SEQ ID NO: 642362 - DNA, 295 bp, Homo sapiens
tgtagggagaacatgtcaaaattactatatttcacatgacttcaccctttaagacattcggttcctatcaccctgcccttgtaaatatcatctctcgcacctagtgaagactacaaagataagaaatggtgcccaattccaatgtgattccactccctaaataagaaggacagctacactgtcagtatagaaaacatagaatgttatgtaccagagacgtacagagtgagtgaggaagacaatattagggtaccctctgccctggggtggaaagaggatcaaatgtaatgtgaga

SEQ ID NO: 642363 - DNA, 222 bp, Homo sapiens
  misc_feature (87)..(87): n is a, c, g, or t
gtacaggccggattgtagagaaggctccaaaagccaggtgcctgatctggacaagaggaagtacctagtgccctctgaccttactgnttggccatgttctacttctataatccggatagagaatccacctgtagacctgtaggacgccattattcttcatttgtcaacaacaccatcccatcccaccatgtgctaccacgggtgccttgtacgtgggtaccg

SEQ ID NO: 642364 - DNA, 810 bp, Homo sapiens
attctccttcttcagcctcccaagatgctaggactacaggtgcatgtcaacatgcccagctaatggttttttttttttggtaaaaacagatctccccaggttacctatgcgggtccaaacaccgggtttcaagaaatccttcggctgtgacctcccaaagtgctaggattaaaacatgacccaccagtgctcagagtccatttccatttatgattggagtaatttaatctttctctttttttcttagccaatctagtcaagggtggtcaatttggtgatttatttggaagaatcaactttgggtttcagtaatttcctctattcggttcccattctccattttatttatatccaccctaatacttattatttccctcattcacgggtgctggggttaagtcggccttcttcgatatccggaagtatacagtaggtggtgacctgagctcttcttcttttaatgtcagagtcacagtataaatttcttggccagactcaattctctgaacccctgattcctcacctgaaaatgcgctaaagagtactctcttcactacccatccctcaagaggttaaacggcgccatgaacaagagtgcgccccaaggaggacccatgtcggcggtatattatcacaagcatattaggctgggatcaaatgcctaaataaatcccaaatccccgggctagccttgaaccgaaagttttacccgcagcttcgtctcccgcaaggaagcccgcgggtgggggaacgaaggagtagcgcgctaaaggacccagcttccataaacggcaacacggtttgagacac

SEQ ID NO: 642365 - DNA, 731 bp, Homo sapiens
  misc_feature (22)..(22): n is a, c, g, or t
agtggaatcaaagataccatgnagacccaagtttatccaaagttacgtaacacattaggtagaatactgatctcatgagctatgagatgaacattaaacggaaggagactggaaggggcgtgggttaagacgagagctatgacttgaataactaactcaacagttttgaggaaaccggtttggcatctattcacacccagtgggcatcggtccggccattcagcgaagcgttagacgtagtcgtattaagtcattatcatgacagtcagcacagtttacaaagcaacaacgttgtccagtattagcgactaaagcaacacatgaagcggctttgggagacaattgaaacttgaaattgcactattcatgaggattagttcaacttgtgtattacttaacaagtttgcagataaatatatggcatggtagggtccgtgggtaagagtagtggtaaacaagtaatatggtcaaagatttaccggatcacacgacagacataatcactgaaaaatatataataggggcgcttggcgtgggtggagaggaataggtgacatttgtctaaatcatgttctaaaacaaatttgtcataaaagtctcaatattcgccggcggcacaagttttctgaaacattcgaagatgggcattccaacggaggaaaggagacaggctcagttggaaccccggaaccagaatagatgtttaggacagttaccttggatccatcgta

SEQ ID NO: 642366 - DNA, 162 bp, Homo sapiens
attaatttgtttccaatatccattcttcctttttccagcctccaccttcaagtaggccctggtgtctgttctgcccttcttttgtgtccgtgtgaacttagatattaagctcctaagtgagctaatagtgaaacatcagtatttggtttgctgtccgtgtat

SEQ ID NO: 642367 - DNA, 152 bp, Homo sapiens
gacatcagctcggtaccactcttaggggttgcaggcgcagtggggccctggagtgtgtacattgaagatgtctgcgggcaaagccgtggacacagagattggggttacaaatggtatggggttgtggtacacccagtgtgcatgtgacacga

SEQ ID NO: 642368 - DNA, 579 bp, Homo sapiens
  misc_feature (168)..(168): n is a, c, g, or t
gggcccattgaatggaaaccgcctctttaaaccttaaatataatgggaaccctttcttatattggttgcgttgtaaatgggttataattcggtcatcccagatagagtccagtgacccagaatagcgtggccttccagggctaaaggtatcctcccacatcaacttcngaaatagctgggccctctatgggttcatcccaccacacctggctaattatggtatcctctgtagagacagggttcggtagagcacagactgggtaaccttttgatttaaaatgtattttgaattccttgtggaaaaaagcatattttgacatttagatataatattgtaattgactattcataaatacagaacttctaagtataagaccaaaaggtccgttttaaaaagaaataagacaattggccgggcgtggtggttcccgcctgtaatcccagcactttgcgagtccgaggcaggcggatcacgaggtcaggagatcaagaccatcctggctaacacggtgaaaccccgtctctactaaaaatacaaaaaaattagctgggcatggtggcgggtgcctgtaatcccag

SEQ ID NO: 642369 - DNA, 626 bp, Homo sapiens
gcacgaggtaggtccactgtgttcggaagaaaaagttcaacatgcatttgatagagccatcttatatagcaacgtttatgaatttgtaagttgcaaccgcacgtgtgctgtagccatgtagagtcatatgtggattcttccaaacatatccagcatatgcatcttttttttatgagagataaaaaaaaatgaggtggggtcatataaaacttggactatttccttggaattttcttgtttgtaaaatcagagcagagctcttttatttacttttgtttttgacgatggggacgagcgatgtactcacatcttcgatatcacttgcctgaaaatatataaatgcgttaaacgatagaaaatcaaaaacatcgttcttttcactagaatattttaaagtcaaaacataacactttactatttacgtaatgaagtcttgtagttgtatatatttacagagtgtagtgctttagttgagaaaatatgacactcggctttcctctttcttttatttactggcttggttgttgcatatccatcatgacgtgctttcttaacaaaatttttttgatgttttttttcaaggtcaaaggatcctcaacaccatgatccttcaaaaattgatcaca

SEQ ID NO: 642370 - DNA, 424 bp, Homo sapiens
caacattggccctccctagtcagagcagtcaagtaggttatgataaagtgaaagccataagctcttggcttagcattttcccattcagatgccgcagcagcatgtgtccctctgtcactcagcaggctggtccccttctttcaggtaccctttcacattcttctcactccgggcacaggtggtcgctggaaggctcgaagccctggggtcttcagaccagcctggaacgtgaatctcctttctcacccccacgaaagcctcggcccgcattcgtaattctttttatttttactttcgagccatgtaaggcatgcagatggggtaggagcgttcccgcgacacgttgccagcagcgcagcgccggcccgctcgtgtggcccgagcccggggaggggacagggcacgcgtaacctgacccacctgc

SEQ ID NO: 642371 - DNA, 368 bp, Homo sapiens
  misc_feature (19)..(19): n is a, c, g, or t
  misc_feature (25)..(25): n is a, c, g, or t
  misc_feature (51)..(51): n is a, c, g, or t
  misc_feature (58)..(58): n is a, c, g, or t
  misc_feature (81)..(81): n is a, c, g, or t
  misc_feature (86)..(86): n is a, c, g, or t
  misc_feature (113)..(113): n is a, c, g, or t
  misc_feature (140)..(140): n is a, c, g, or t
  misc_feature (155)..(155): n is a, c, g, or t
  misc_feature (227)..(228): n is a, c, g, or t
gggggggcgggtggggggnggtttngggggggggtgggggggggggccgcnggtgggngtgtggggggggtgggggggggnggggngcgggcggggccctcgggtgtggcggngtggggagggctctgtgtggtgggggncggggtcggtgggcnggtgtggctgtccgacgtccggggttcggggtgtgggtcccaggccggaactccccctgcttttttccccgnncgcaatggggggcgggcgccccccgcattaacaacataaaaccctcattcccccgggggaccccccccagggtcaaacccccttcccccattttcctcctatccctcaaccccggcatcattaccgggttttcctcttta

SEQ ID NO: 642372 - DNA, 793 bp, Homo sapiens
atggcggcccagccgtgttccagagctccctgtcgggtgccctcgcccgctttatataaattcgtctgattcactttgcattagaaagtaacagtgtttgtttgtacaaaagagggagttccaggagattcaacaggaaatgcatggatctcaaaggaaacaaacacccgaatacactcggagtggaagaattgacaactgtgagacatgtggtgggtacgaaggcagaaatttcatgtgcaccctgtgttgtctacagctgtgggtaatgacaaaagacaatgccaaaggaatcttcaagaaggaggattgaagtatatcggtgggtgagacgcaaggaaccaaaaaaaagaccggtgctgtcagtgaccgtgatacactctacatgtgcttgctagtaaggcaccaagggctcccccaggccagggcctccagttgcttcctctgccctctaatagtcaatgactcgccgccgggccgaggggcaaattaaggacacacacggacttatgggaggcaaagaaacaaaagaagtcagaaaccaccacacaaccgtttgctcggccgcccttccgccactagaggaaagctctgtaaaaccacctctggtgtgcggcgcgcggcccaatactggttaagaggacacatctgcacaagcggtgtcccatagagaaaccgtgccataggacaaggggcgtagatctacaaccaaaaaaaagccgccgggggaccggggtctgacacacccagggggttggaggactcaggctaacacagggacaagcggcaaata

SEQ ID NO: 642373 - DNA, 952 bp, Homo sapiens
  misc_feature (13)..(13): n is a, c, g, or t
  misc_feature (892)..(892): n is a, c, g, or t
cggacgcgtgggncctgaggttccggcagaatacactcaaaagcaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctaaaaaaaaaaaaaaatcgggctttttcggtgggaacagtttgatggctgcctgcgtctgccattttgcaggactgcggccattgcgtatcgtacgtgtgcgggtcaaanattggcataaaagaagaaaactaccaaacatagattaaacagagagaaacgcaggcggtg

SEQ ID NO: 642374 - DNA, 104 bp, Homo sapiens
agcaattaattggagcagagaagttgttgagaaagagttcttagaaaaagttaaacatcttgagaatcaaatagcacaaagtcctgccattgacccttaccatg

SEQ ID NO: 642375 - DNA, 561 bp, Homo sapiens
  misc_feature (13)..(13): n is a, c, g, or t
cggacgcgtgggncctgaggttccggcagaatacactcaaaagcaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggaagcgctggtttgcaggttttgggaagctgcaagcatcgctctgactttggccatgagatcctgagtgattttgctctgcacgggagaaa

SEQ ID NO: 642376 - DNA, 287 bp, Homo sapiens
catgagacgcagcctcccggctctgcctccgctggccccgtctcaggaagcgctggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagcta

SEQ ID NO: 642377 - DNA, 391 bp, Homo sapiens
  misc_feature (26)..(26): n is a, c, g, or t
  misc_feature (49)..(49): n is a, c, g, or t
  misc_feature (51)..(51): n is a, c, g, or t
  misc_feature (133)..(134): n is a, c, g, or t
  misc_feature (140)..(141): n is a, c, g, or t
  misc_feature (144)..(144): n is a, c, g, or t
  misc_feature (153)..(153): n is a, c, g, or t
  misc_feature (157)..(157): n is a, c, g, or t
  misc_feature (159)..(159): n is a, c, g, or t
  misc_feature (161)..(161): n is a, c, g, or t
  misc_feature (167)..(167): n is a, c, g, or t
  misc_feature (169)..(169): n is a, c, g, or t
  misc_feature (238)..(238): n is a, c, g, or t
  misc_feature (298)..(298): n is a, c, g, or t
  misc_feature (300)..(300): n is a, c, g, or t
  misc_feature (302)..(302): n is a, c, g, or t
  misc_feature (318)..(318): n is a, c, g, or t
  misc_feature (339)..(339): n is a, c, g, or t
aagaaaaatttgaaaatttctattcnggctactggaattggttattaananaaaaaggaaaaagaagaatcttgctgctttcagtatttcctgatttttttgtaaatataaagaggaacttcaattatgaaanntttttnncanatatatatntctntntntctatntntctgttctgttttgtttcctgtcttgaagattttgagttatggttattggtttcagattgattaattcncatatgctgtgttttgaaatgagatccccttagctttttttttttttttttttttttccntntnaagtgttttctttaanagtccttttggttcgtggccncgtgccttggtttttccctttttttctttttaaatgccaacccttttccccc

SEQ ID NO: 642378 - DNA, 371 bp, Homo sapiens
ctaagtcgactctagagttatccccttcatacgtcaattaagtatagtgcgatagaaattgaaaactggcgcaataatatagtaccgtcaagggagagatgaaagaattataacctagcataatatatcatggactaacctcctataccttctgcattatgaattatctagaaattactttgcaaggagagccgttgctgggacccccgaaatccagaccagctacctaagaacagcttaaatagcacactcttctatatagcataatagtgagaagattcatagttataggcgactaaccttccgagcctggtccttgctggttgtccatcatttaatcctagttcaactttctatttgccttaattaat

SEQ ID NO: 642379 - DNA, 784 bp, Homo sapiens
  misc_feature (13)..(13): n is a, c, g, or t
cggacgcgtgggncctgaggttccggcagaatacactcaaaagcaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagcaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagcta

SEQ ID NO: 642380 - DNA, 643 bp, Homo sapiens
agcgctggtttgcaggtttttggcaagctgcaaggatcgctctgagctttggccatgagatcctgagtgattttgctctgcacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagcta

SEQ ID NO: 642381 - DNA, 338 bp, Homo sapiens
agccgccccgtggtgaattagtcttctacaatcccagaaattcaccctcccatctgtgactaggatacagttcactagatgaaattatgggaacctcctgcgtcttaccaagaagctgtagctggaacttagtcaatgaaaaatgatttgtaaactctttggagctggctttgaaagaacgtttaaaatgatagctgatactgccagacaacagaacaggccggccttagccatgaggctccagaagaaggagaactgcaaagtttgtgtccgctacctctgcccttgggatggagccattctgtctgcttggctgtacagccctggcattgggaaca

SEQ ID NO: 642382 - DNA, 236 bp, Homo sapiens
  misc_feature (38)..(39): n is a, c, g, or t
ctgagtagctaggattacaggtgcccgccatcatgccnngctaatttttgtatttttagtagagacagggtttcaccatgttggccagcttggtctcgaactcctgacctcaggtgatcctgctgcatcgacctcccaaagtactgggattacaggcgtgagccaccacgctcagcctctttcttgttctatatgtccatgctctgctccacttctgccccttctgtcgtcttctc

SEQ ID NO: 642383 - DNA, 164 bp, Homo sapiens
tttttttttccgattgaggcacagctgtggcaatatcacaatatttccctggtgttttctttggatctccttacctggtgccaacgtacacaacgaaagtagaagagagttgcttggttggaacaaaatcccagtcaaaatgctgagttttctcctggcccatt

SEQ ID NO: 642384 - DNA, 751 bp, Homo sapiens
  misc_feature (252)..(252): n is a, c, g, or t
  misc_feature (495)..(495): n is a, c, g, or t
ccgtggttctggcctactgtggccggcctggacacctcgtgcatcctcgtgtggctgaaggaaccaggctatgacgtcattgcctatctggcccaccattggccagaaggaagacttcgaggcacacggccaggcaagcaaggcactgtaagcctctgggcgcccacaacaggtgttcactctgaggtgatgtcgatgcaatgggggagcttgtgtcggccagtgcatgtgcactactcggtcgccgggccnactcacagggtgcacaagcagccaccttgtaactgagggattccgcctagcgctgctcctgtgggccaacccttacgttcgtgtgcctctacgcgccccctgggcaactcccgtcaccctagcgacacatcgacatggttgtgcatatacttccgctccgagctgagcggaggtgtgggcggccaaagttcactgttgttcctcacgcggctggccacgaggcagaagtcggtgaactcccgnagtccatgtgttgcccttggtctatggacgcgcatctaagccaattgtcgtcatcgttccaaccttggtgccaccctcgcgcccacgtaatcaagacggctacgaaattgggcgtcccccctctgccgaatgggcattctgcgccttgcacagtgtcctgagcgaaaaccccgggatttctagatgagtgccactgctagagtggaacccttgcaatggggacgtgaccgacgagaacggccaaaaccagttgggg

SEQ ID NO: 642385 - DNA, 577 bp, Homo sapiens
caacacacaacactaacacggagaacttagcaacgaaaacactttgttcaagtgacacatatgcactaactctggagggtaatccaacagaaccatagctgcccgaaaacagtagctagttctctagcaggagtagcacttaaagacccactgaagcaacagtcgcagctcatgcatatagctcaattcaaacttgtatcatcaggagaaccggcagctaaaaacgtcggtactggtgaccctaagacattgattacactgaagctacctctagcgttacgcacaggagtgctagacacgataacgcccacagggtgcaagtcgtgatcaaaggcatagtttggcactgcaaaaacctgcagcttcttctccccattggccatataggagttttggcagccacgacatatacaatctaagcaggctttgcggttagagtagcaagtgcagcgttggcctcggcatgtaagaacacttggattttgagtagcacgcccacatttacaccctttcttttcctggggttttttgtacacagtcttggtaggactttcttgcataaaatgatgactaggaa

SEQ ID NO: 642386 - DNA, 1038 bp, Homo sapiens
gccatttctcgatccccggacatcttagcggatgctgttggttgggggccgtcccgctcctacacggcacggaacgatggtggccgcaaacgacagacgaacacacacgtcgctggagtcgatcaactctaggctccaactcgatactgaaacagtgcggaacagatacgtcctggggtaaccaagcatgactctgacacgactgatcacgacaacggcaacacgcgacaattggtcattactcgctaaacaaatggcccagactttgacggacaatctgaaactcgagtactatgctcatgtgggctaaacactggatgtccatcactacagtggcacatcaatcattgacactgggcacagccatgcggcacaattcactaccagcagtggtgcacactggctatcatggatccaaggtgactctgaccatccatcagaagcatgccagaacagactggtgacaacagtaacccttaatcacctcacaaaatttcacctggcacaccttcaacctgcaaaacatggaccgtatcaggtaaacatgggcatagaaaacacaacacaacagaaaacaacaaaagacaacacaagaggaggaactcagagccacagacacacggacaacagacacaacggaagagacgagactgaacccagagaaacagaagacgcacacacaggacacaacgagaaccaaacgagaaacaacaaaagaaagcaacacaagtgacagcgaataacaacaacaataaaaaaacgcacggagtgcacaacaccagaatgaaacacaacccaccagaaagtccggaacacaaggggaaaaaaaaacaaggacccaaaagcagagagacaaaaaaaacaacaaagaggggacaaaagagacgagagaagagaaagagcaaagaacgacagaagcgaagaacaagcaaccaacaacaaagcgcaaaaacacaaacagcacagacaaccacgccaccaagaaaacaaccacaacagaaaacacaaccgagacgcaaaacaagaaacaagaaaaga

SEQ ID NO: 642387 - DNA, 109 bp, Homo sapiens
gtgctaatgataggagtatggtggggtggtgattgtggtatctttaatagtgtaggaagctgaataatttataaggataggggtcagggtttttcccccataatctatt

SEQ ID NO: 642388 - DNA, 209 bp, Homo sapiens
tgcggcccagatattctatgaactgatgaagcacataatctttctatgattaacgtcagagtaccgcttaagtgagtcttttaattatgtggcaagtgatagaagttatgtactattcaggtgggagaaatggcctgatatgctagcaatatcactaaaatatctagaaagggacaaatgtagtctacatgatacggtcaggaccttca

SEQ ID NO: 642389 - DNA, 426 bp, Homo sapiens
  misc_feature (192)..(192): n is a, c, g, or t
  misc_feature (201)..(201): n is a, c, g, or t
gttccacgggggtcccccagggtttttcccccaacaggagatttttttttggcacccaaaggcgccgaaaggtacccctgccgggctttctctcatgagggcccctccccctgtaaggggggattgcccctcccctttgggcccaaaaggaaccggtttttgccctttgtccccctgggaggggaggggaanccgggattnttccctggttgaaaaaaaaatggggcccccccccggggggcctttcccaagccctgggggtttttccccatgactttttttccagcccccctgggcccccttggggtttttttccccccccggggggggttttgcccgggccccctttttttgggaccccttgggggggtggcctttaccccgggggggttttttttttttaaaaaccccccccttggggtccca

SEQ ID NO: 642390 - DNA, 151 bp, Homo sapiens
gtagctagactatgcagggaaaagctgactagcagaaatagagttggttcaagggaagcccgcttggcaatacagaagaggtgagaaggatttgagttcaggcaaatgaccagggagtaaaattgattcctggggaggaaagttaagcccc

SEQ ID NO: 642391 - DNA, 808 bp, Homo sapiens
  misc_feature (35)..(35): n is a, c, g, or t
  misc_feature (69)..(69): n is a, c, g, or t
  misc_feature (71)..(71): n is a, c, g, or t
  misc_feature (83)..(83): n is a, c, g, or t
  misc_feature (85)..(87): n is a, c, g, or t
  misc_feature (101)..(101): n is a, c, g, or t
  misc_feature (119)..(120): n is a, c, g, or t
  misc_feature (123)..(123): n is a, c, g, or t
  misc_feature (145)..(145): n is a, c, g, or t
  misc_feature (147)..(147): n is a, c, g, or t
  misc_feature (151)..(151): n is a, c, g, or t
  misc_feature (178)..(180): n is a, c, g, or t
  misc_feature (195)..(195): n is a, c, g, or t
  misc_feature (199)..(200): n is a, c, g, or t
  misc_feature (231)..(231): n is a, c, g, or t
  misc_feature (248)..(248): n is a, c, g, or t
  misc_feature (265)..(265): n is a, c, g, or t
  misc_feature (272)..(273): n is a, c, g, or t
  misc_feature (329)..(329): n is a, c, g, or t
  misc_feature (801)..(801): n is a, c, g, or t
attatgttttctctccatcagaatgaaagctcctngagggcagggactttggtctattgtctgtatttncnggtgcctagaanannnaatgtatgaaaaangaactcaataaatatttnnaangtagaatggaaaggaatgaatnanattntttggggtttctgcagagattggtttnnntagtgggtgctaggnaaannttctgctccctgcaacctccccattttaatntttcagtattgaaaagnggagaggaaccggattnagtttgnnggggaaagaggcagtggggtgtggaggtgctcagagcagcctttgggaaggtgtgngggaagctggattcccaactgtcagcctccaggcctgggatggacctaggatgctgagaaagggcatacactgctgagggagtaacctgccagttaccagctcactgaggaaccagaagaatgtacagttcttggtttgaaggcacttggagaaggagaggaaggagggatgggagctgaatctcttcccgcccccatctctgccaggtcccaggccccctctgggcttctgttccacacagacctgcctggaagccttcaaaggccgaggagcccgcggtcggggtgggggtccctgttctggagccatgggtttggagtgccagctccagcagaggcatctgagcagcggcctgaggtgctgtgtctgacatggttgttggccatggaaggcctcgggccgaaatgagctcagatcttggctgccggctgctggggcggctgcttctgcagcagggccaggggtgtcccncttctca

SEQ ID NO: 642392 - DNA, 225 bp, Homo sapiens
tgggcagccgtagtttcaccgagtgcccatgctataaggaggaacagtatatcgctagataaaactctacatcccagataaaacacatggaatcgcgagcgactctgtaacccaggtaaagactgtgcagggcattcagccagcactgcacacccctcagaagttcactgactttcgttttgcacctccaggtctgatacgtggcgcctggtgaacccaccagca

SEQ ID NO: 642393 - DNA, 162 bp, Homo sapiens
ggctgccatctgtttatcaatatagcatctatagctgatcctttctaaaaatagtgtgtcagaacatgttactcagaggtgaaagtccctgtgatggtccttacctcacttgctgaaaacctctcttgtggccctatctagggcccgctgttctactccctc

SEQ ID NO: 642394 - DNA, 1903 bp, Homo sapiens
  misc_feature (571)..(571): n is a, c, g, or t
ctgcgcagcggatcacataagacatagaatggggtgtcctaggaggtctgatcgcaggatgctagtaggcagcaacggaagccatgtctgctggtcctagcgcgttgtctctacatgaggggttcccgaatagcatgggaacccagacggctcagtcactctcgactgtctcgactaggggacatcacacgcaggcgccaatcctcgggtcacgaggattaacagcgtctcccagtacatgtggctcaagataagtgcccagatgacatagggattcactggtaaattataattaggcgaattgcgtagttacgggccgctggataggggcgcgcagagactttcgccgaaagtctcgctcatagtggtgtgctaaattctagacgtgcacagggctctagatactcagtcacatcgctgggtgtttaaacccacaggctcatagatgggtatcccggactcccagagagtgacactaaacaagctaagtcagtgtcaagccaccgaacagcgagggaacagaagagccttgcgacttctggcctcaaggcttagcttggaggggagacantctatgtaggggaacgttgacccgtgaacacatttctctgatgactctggtgggtcatgaggtaggtaaaacgaatatacaaccaccgatttaaaccaagggaggtattacccctgcagccatgggggtattaagagcgccgtgccaactcctgtggagtaactacgactccgatacacaccctaaacttaaggggcttagtaaccccagagaacagaccaaagaagatacccctatagcgatcgccaaggcccccaaggtttgcgggggtcacttgacaaatacctctaaaagaaacacccaaaagttttacctatagggagcacacaagtcgaccccacagagtatgggaacggcaccaagggcagcattcgtgacggaccttgcacttggcgatgcaatgggacatagaggaccttcgaaagcacaggataggcccatgattatggtgggcgctttggaggacacacacacaaaggggcgccctcaaaaaacaatagtataggcgcaaacaccagcggcaaccggttaagatacaacgagggtacgccgccaattccctatcaagatcgccgatatgcgacataagtctagtatatggggccattgaacaacaatgccggcagaacccatagatagacgctaagtatcccgagcgtaatttcactaggcgcaggaacacagattctgagcatatatagggataactagacggagggataataccacgatgggctcataaggtctcaataggaaattaccccaagtgaccttaatatacattacaggatggcacacggttaacagtgaaccgcccgtttgagagtaggatcagttgctccatgaaccacgggaatagaacacacgagtgagaggaacacagtgcacggaaaagaaaatggttaagctatcatggcacagcgagagatgcataatacatatagaacaacacatgagcgggcacgaacaaagacacaataacgagcaaaaaaagataagaacaccaagatgacaacaccaaccagagatattagttaagacgaccaaccaagagacaaggagacagaaaacagcgaaaatagaccacacacaatggacgaatcatagcaacactgagacgacgagagataaagacaccaacagaagacacaaagagacagagtgagccaccacactcaacacgaagcagcaggaaagaataccacacacggagaaaggatagcacaaaaaccagataccacgagatgaacgccaaaaacgcaagagtgtacaaaaacacaacacacacacaagagacagaaacaagacacagtaacgaatgaaaccaccacg

SEQ ID NO: 642395 - DNA, 262 bp, Homo sapiens
  misc_feature (8)..(8): n is a, c, g, or t
  misc_feature (84)..(84): n is a, c, g, or t
atggcttnacacctgcaatcccaccactcaggggcaagcagtgaggctaaggcagatcacttgaggtcaggtgttcaagacgcngtcgccaacatgatgaaaccccatcgctactacaaatacaaaaattagctgggcgtggtgcaggcgcctacaatcccagctactcgggagactgaggcacgagaatcacctgacccaggaggcggaagtcgcagtgagcactacactccagcctgggctatagagcgacactcagcct

SEQ ID NO: 642396 - DNA, 450 bp, Homo sapiens
aacgggtgatgcggtttgagcctggtgcatgagcgcgaccggctcatcgccgaggtgaataagcagctggagtttggataacgcacgcaggcggtggtcttagaccaagaagatgcactggtgcgcctcctgcacgaaggacgccatcttttactgctgttggaatcaccagctactgtgactacccctgtccgccagcccactggcctgagcacataaagtcttgcacccagtcagctactgctcctcagcaggaagcggatgctgaggtgaacacagaaacactaaataagtcctcccaggggagctcctcgagcacacaatcagcaccttcagaaacggccagcgcctccaaagggaaggagacgtcagctgagaaaagcaaggagagtggctcgacccttgacctttctggctccagagagacgccctcctccattctcttaggct

SEQ ID NO: 642397 - DNA, 202 bp, Homo sapiens
ttactgctagcagaacagagtcaccctcctctggatattggggcagggacggcagtgccaggtgtggtggtggcgtgggccgctggcttctgctggccaggatggcttaaccctgactttgggctctgcccgcatcggtgttggccactgtccccatttacattttccccactctgtctgcctgcatctcctctgttgcggg

SEQ ID NO: 642398 - DNA, 352 bp, Homo sapiens
gtcgaccaaaagctgttttaatgctggtcgagtcggactacttgaccggtgagatactcctgtcagacggagggttgaatctgacctaggttttgcgtgctccggtggcgcattcagaattttcaagattgcaatttgaccacgccagaaacgacaaagccccggattcccggtttgaggtatctcgatatggcggagggcagagactcgaaaccttccaccacacatcaaaaaaaccctttaaaatcaattgcctagtcaccataaaaaacaaggtgtgacctcaattgtgcccacatctgtcgcgagaacgagcctagactacccttccatcaagcgaaccatcaagcgt

SEQ ID NO: 642399 - DNA, 401 bp, Homo sapiens
  misc_feature (2)..(2): n is a, c, g, or t
  misc_feature (14)..(14): n is a, c, g, or t
  misc_feature (218)..(218): n is a, c, g, or t
  misc_feature (220)..(221): n is a, c, g, or t
  misc_feature (262)..(262): n is a, c, g, or t
  misc_feature (305)..(305): n is a, c, g, or t
  misc_feature (331)..(331): n is a, c, g, or t
  misc_feature (351)..(351): n is a, c, g, or t
gnagaagacgacanaaggggaagagaaatcaatcctatgtataagaaatatgaagcatggtacatatacatacagtgttgcaacactgatcgtactcatgggcatgaacaagccctgggtgtcttggaaggctctgggcctggtgtcgcttcacacttggctattcttgaaacatttcctcagccgtcatctatggagtgcctgcttctgtagagaananngggaggaggaaaggtgctggtggcagtgtgctgcgtatggncccactcagccagggagccccatggttcattcttgaagatatntaactttctttagttgacagtttagncatgaggatgggccaggctnagtgggctcatgcctataatcccaggactttggggaggccggctggtggg

SEQ ID NO: 642400 - DNA, 180 bp, Homo sapiens
aaattttgggggtttttggccccgggggggggggccccccctttttttccccccccccccggggttttttttggggggcccgggggtttttgttcccccccggggccttttttgggaattgggggggttttgggcccaaaaagttttttttttttttttttacccccccccccttgggga

SEQ ID NO: 642401 - DNA, 301 bp, Homo sapiens
gcggattcatttcacccgcgtgatacgacacatgagggcgcagcacgtcttcaactggggtaagagggacgagtcggagtcatagtctacgtgtacacgtggtggtggagtaagcaggtcagtcactgacttgatggtttcttgatcttcagatgagtaccaccagtcaaggaactgcaagaagaatacacccacagaaaggccagtagacagggataaggcaggagcccccaacagctttcttcagagctgagtttatcttctcactaacactcctggctggttgtaagcagcgtgctgt

SEQ ID NO: 642402 - DNA, 727 bp, Homo sapiens
gaggggaacgaagcctgctccccaggctgcggatcccaggacaaccatacgggagtatgccaggcgattcagaccgagctccgcagtgccgttcgctcgagcaggaagacccatcagccgtatggctgacgcgtggaacatgggtccatactacaagcgcggatctcgccgaaggcagatcgggaccccaaagcctgagtgccgtcctgtctcatgagtacgtccagacgatctcatggtcccgatggaaggatgaactgtgggacccgctggattaatgcatcgtataccactccaaattctcgtagcgtcggcatttcgtatgtccccaccagcgggagccagcacgtgtgatgatgcagcatggcaaacccaagttccctcgtgagggcctggggtcggtgcaagtgcgctctgagggaccgcatggggtgcccacgaggggtggcgtccttacttcgttccctcctaaccacgcaatcccgtatgaaacatacgtacgcaacggcaactgtccctttgcgtgaccaaggggctgactgggaccacccaacgttgcaaccccacgaaacgaatcttggcgccaatcggaattagccccattggtgaatgatggccttcggatccggatttgcgcaaaaagagctggcaacgaaaccctatggggggcacatccctacaattcgcttggtgcgttcagaaggctttgggacaccaacggcagatt

SEQ ID NO: 642403 - DNA, 833 bp, Homo sapiens
cgagcctgagccgagccgctggccgagccgcgccgatcgccatccggcctcgtgcactcgctgcgcgatccccggccggctggcttgctggcctgggtgggccaggctggcttgccacagcccatggagctcgagaacatcgtagcggaacacggtgctactcaatggcccgggaaggtggcggtggaaatcgcaaaaggcaaaagcaatgaaatggcggcagatgctccagttccctcacatcagccagtgcgaagagctgcggctcagcctcgagcgtgactatcacagcctgtgcggagcggcagcccattgggcgcctgctgttccgagagttctgtgccacgaggccggagctgagccgtgcgtcgccttcctggatgggtgtggccgagtatgaagtgaccccggatgacaagctggaaggcatgtgggctggcagctaacgcagaattttctgagccacactgggtcctgacctcatccctgaggtcccccgtcaagctggtgacgaaactgcaccagcgggtggacggcagggtccctgcaaagacttttccaggaactcaccctggtgaccaatgagtactgagcggtggccctttttggcgaactacctcgacagcatctacttcaccgtctccttgcgctggaacgtggctggaaatgcagccaagtgaacaaaaacacgttcagggcaataccgagtcgggggcaaggtggcttggggagtgtgcgctgcaggtggggcccagttagatgtttctgcaggagcagagaaacggtcgaccggcaggagccagcactaagagagcacctggacctacactctg

SEQ ID NO: 642404 - DNA, 356 bp, Homo sapiens
agaggatccccttacttattcaagatacctgccaaaggtaaatggtcttactattctaaatgactttgaaatgcatgtataattgcaaacagagcagagaagactttaatcagaatttctgtgcccatttcaattcagtacctgcttcgacagcatcggtttggctgagctgagggatcataggactgctcttttatggtgttgaatttctcttgacaattcctttagaactcttgagccctggtgccgggctggagtctttgttctcccactttctcctgtctgctgtccttcagctagttactttatttctgggcctcaatttcctcctctgcctttttctgtgcccttttcta

SEQ ID NO: 642405 - DNA, 844 bp, Homo sapiens
tagatcaagatagactccgcttgtagagtccagacactcctgacgacgtgcacgatgatctccctaagtcccttgttgaagccccattcagttggttcaatagtacgttgcgcgctagtactctggataacttaggcggctattggtataatacgcctcacacgtcatgtctcgaccccctagacgagactacatagcctaccccattccgttgtactatccctgatgaggcatcaattatgaacaagctccatctgcgcggacgacaatacagaccttaagatcgctcatgtgcatactgctttcaagtcagccacatagccctcgtagtaagcagccattctcatccaataccccctgaagcttcaccggcgcagtcattctcataatcgcccactggacttacatcctcattactattctgcctagcaaactcaaacgtacgaacgcactcacagtcgcatcagtaatcctctcttcaaggacttcaaactctactcccacggaatagctttgtgatgacttctagcaagcctcgctaaccgtcggccttaccccccacgattaacctagctgggagaactctctgtgctagtaaccacggtctcctgatccaatatcactctcctacttacaggactcaacatactagtgcacagccctatactccctctacatattttacccacaatcacaattggggctcactcacccaccagcagttaacaacattgaaccctcagttcacacgagaaacacccttatgctcatacacctatcccccattgtcgtattacccctcacccagcatctcggtcttttgtcgttggcggttggggggtgt

SEQ ID NO: 642406 - DNA, 805 bp, Homo sapiens
cggaggggacacccgaggtgtcaccagagagaggggtgcaaaccgggcggggaagaccgagcgtgtgtcaccagaaaacaatggtggtgggggcccaacacgggcgataacagggtcacagagcgcgccgttgccacagaaagttgcgcgccgcgagacggtgttctaagagcgcccaaggcgagggcgcaaaagaaccccgcggcgccaaggggctggccggccaaaagcatttggagcgccgccgttctgccaccgataggttcaccgccagctgaaacgtttctgaatcgcggagcccccaaggtctgcccatagtaatcgcccagtgccgacaactgcaaacgagtagcataatcataaaggaaggaggcctgctattcaacaatgatgtactcatgggcacaagaagatcttgcagtcgtttatggatttaggggttttctgccgcgcgacttttttgagcacccaaatcgtgggagcactatttttgcaacctcatagacctcccccaccaactgcttttggtaaccttgtgaagacgcctccaatcttgggatgtgtttcagtggagcaccccgtgtgatcgcaacacttagggataaagaatgttggggggaccaaccgtgagtctaggcggatccttcatggtgctaccccccttgctcccccgcctattgtacggcagggataagggtagattctcccaagactcccctctgcgtccggttatatcagtcaccaaaaactggtcgccatgctttcacagcacccggactcttccatggctctttctcaacaggcc

SEQ ID NO: 642407 - DNA, 284 bp, Homo sapiens
  misc_feature (14)..(14): n is a, c, g, or t
gtggggtgtccaanttgagaagatttacacaaaacccagcgggagaagttttgctggtgcccttgacatggctgatgaaagactatgagttttagccagtctccaagaggccagagttctggtgaagaggacacagtgtggtttggcaaagatggatacactgagcctcacttgccctcggtgcatggtgggagagaggcagccaagagtcttaacaaacccaacatctttggcgaaaaggatcacctgggagatattatacagggcgcgctgggcccagttgt

SEQ ID NO: 642408 - DNA, 866 bp, Homo sapiens
  misc_feature (721)..(721): n is a, c, g, or t
tttcctaactcagaagtggtgcatgggcaagcatgagtcccactactgggcgtctacccagaagaaaagaagtcattatatgagaaaagatacctgcacacgcatgtttatagcagcacaattcacaattgcaaaaatgtggaaccagcccaactgcccatcaggtcaacaagtggataaagaaattgtggtgtatctatacgtaccatggaatactactcagccaggaacgaaataatggcattcacagcaacctggatggatttggagaccattattctaagtgaagtaactcaggaactggaaaaccaaacatcgtatgttctcaattataagagggagctaagctatgaggacgcaaaggcatgagaatgatacaatggactttggggactctggggaaaggacgggaggcgggtgagggataaaaaacgtacacactgggtcctgagcacggtggctcatgcctataatcccagcactttgggaggccaaggcaggtagattatgaggtcgggagttcgaaaccagcctggccaacaaggtgagacccctccccatcctctactaaaataattagccgggcctggtggcgcatccctgtaatcccagctactttacttgggaggctgaggcaggagaattgcttgaactcgggaggcggatgttgcagtgagccaatatcgcaccactggcactccagcctgggcaacagagcaangactcccgtctcgaaacaagaaactcaattttaaaaactacacattgggtacaatgttcactcctcgggtgaagggtgccacaaaatcttcaaaattccctactaagggacttatccatgtaaccaaaaacaacctgttccccaa

SEQ ID NO: 642409 - DNA, 307 bp, Homo sapiens
attcactagaaacattaaccaataggattttggtgagcttagcttctgtattcctactgccgcccagaaaaggggcagggctctgcagcccgccagacagacgagcaccccatgcctatacctccctccccgagctaagtcccagggcatctgggccttgctggagactgggctagctctgtaggctcggcgagggagcagggtgccacccacctctagtattagggagatagggaaagtaaaccacttcccttccaaaccccagggggcccccaccacaagctactactcagagaagaaactccca

SEQ ID NO: 642410 - DNA, 786 bp, Homo sapiens
agcggatgcgcgtgggcggggagcgaccgagtgtccgtcctcctactgcggctacctcacctggcacagcggctggccgccttcccagcctactgcagccccagtcgctccccgcagagcgtaacacttcaggagacggcgctgcagtcccccaggccagacaggcgcacgaacgaccccgcaagacatgggctattacaaccccattctacgttcactgagccaccggagggacgagggcgacctggacccgcggacagatcgcccaggcctcacgacgacccgctggcgcccaggtacaccgagggcgtagagagaccggccgggcactcctcacgtggcagagacagtcgagatccacgcggacacactctcaagtgaacgaaagagtaggactccgcacgacacctatccagcgaaagccccgacccggaccaaacgcggccgaccacggccggccacgcagacactgtgctcagtacccgacaccctcggccccccacgcgccactacactgccccagcaccaactgcgcaggcactacctctctctcgcacccccacccgccactacaaaagcccacccccactcgtcctcaacaccgcccccaacgccaccctacacggggcagcaacaaccagcgcacctcccccccccccccgccaactggccctcatactccctagcaccgccaactccccaccgacacaccaaacagtccacccacacccgcacccgacacccaacccgcgccgcccaccagcgcccccccaccacacccccccc

SEQ ID NO: 642411 - DNA, 898 bp, Homo sapiens
gttacccaacttcgggctggatcctgggctctcattcttagggtgcgtgctcccgatttaaccaatggcgcaaaaccgtttcgagtccacacgaggggaacactcttttgggtaaggaacatacctataaggtactcctgataatggcgtgttgaaaagtttcttcaaagacgccacggtgtttaccccctctgttgtctcaaaccaccacggggcgacaagaaattctttccggcccctttcccaaagccgcgcgtccgccctttgtggagggtcccttccccgtcggaagagggggtattttccttattttcgttgttatttaattcccccagatggggtccccaccacttcctccgtggggtataatcccccacaagtgttgttaaaattgttgtgaaaaaaaacatctatgcgcgtttaacttttccataaaggctcccaaggatttattttctccaacgagcgtttctctagagagcctttttcccagaggttcccacccacgatcccccccaacaaccacatatgccgcccctctcttgaaagaaaattttgagaccccaagataattggctggccaccgtgaataattatgtgacctgtgagaaaaggataaatccccttctcgatccagaacctccgtagatgtgctttctttagagacctcccatcttctgaataataattgtccgctgccctctcttcactattactcttccccacttcttcccaatccacgtggacctcatttctgccccacaaatatatttccgcggatattctttgacatccctctctgccgcgtccccgcattggaaaagggaaaaaaaaaatttccagaactttttcccccccccccgggaaaaatttaaaccccaccccttcggccaaaaaa

SEQ ID NO: 642412 - DNA, 370 bp, Homo sapiens
  misc_feature (5)..(5): n is a, c, g, or t
  misc_feature (261)..(261): n is a, c, g, or t
  misc_feature (306)..(307): n is a, c, g, or t
  misc_feature (309)..(309): n is a, c, g, or t
  misc_feature (345)..(345): n is a, c, g, or t
  misc_feature (347)..(347): n is a, c, g, or t
  misc_feature (349)..(349): n is a, c, g, or t
aaagnaaatattaattggaaaaataatacccaatttttttacccttccagccaattgaatggtgcctttgttgtggtgtcctgcctggaaagtcctacctgcccattatagggaacccttgccttgttagccttcctcctagatcctcctattcctaaacaatctgttagtgatgataaattcctgtaggagggtctattctgagccgttaacttcctgtaaggggaaaatgggtgggttaccagaaataccattgaagcngggtgggctgtggggtggaaggttggggtatttgtcttgagaatnnanaactacgaaacacttttgtacacaactgattttttnananataaacacatttttaaagatg

SEQ ID NO: 642413 - DNA, 342 bp, Homo sapiens
  misc_feature (5)..(5): n is a, c, g, or t
aaagnaaatattaattggaaaaataatacccaatttttttacccttccagccaattgaatggtgcctttgttgtggtgtcctgcctggaaagtcctacctgcccattatagggaacccttgccttgttagccttcctcctagatcctcctattcctaaacaatctgttagtgatgataaattcctgtaggagggtctattctgagccgttaacttcctgtaaggggaaaatgggtgggttaccagagcacgccacccgccatgggagtgtgctcaggagtcgcgagcagcgtagacatatgtccagaggggcagaatctccaatagaggactagagcaatgc

SEQ ID NO: 642414 - DNA, 417 bp, Homo sapiens
  misc_feature (1)..(1): n is a, c, g, or t
  misc_feature (414)..(414): n is a, c, g, or t
nttagattccacaactaacctttctttttcctggagacggagtttcgctcttgtcacccaggctggagtgcagtggtgcgatctcagctcactgcagcttccaccttctggattcaagctattctcatgcctcagactcccgagtagctgggattacaggcacctgccaccacacccagctaatttttgtatttttagtagacaaggggttttgccatgttggccaggctggtcttgaacttccgaccctaggttatctgcttgcctcggcctcccaaagtgctgggattacaggcatgagccactgcacccaacctcccacgactaaccttttaagaaattatttacctatgagttttgggcagagtattcaaaggaagactacctacaagggtcttttcaaaaggactattnaaa

SEQ ID NO: 642415 - DNA, 1065 bp, Homo sapiens
taaaaagggaaacaaagaaatctggagcaatttattattattttttatttattggagacagagtctcactgggtcacccaggcgtggagtgtgcaggtggcgtgtgggtgttcagcttcacagcaacctctccacctctcccaggtttcaagtgtgaatctcggtgcctcagcctagcggaacagtgtgggacaacaggctcccgccaccagtgccgtggctatactttattttttttttgtgtgggtgccagaggaatttcatttctgtgtggtcacacccgaggctgtggaagagtgcggaggggccaccaaatcaatagttccaagtgtggaagccttagaaagcggggttatatagcctctcccaagagtgatagcgtgggggacagtgtggagagggcgcgcctccacccactctgagtcgcccgacgccaaaaaaaggtggaagacacttagacggggggggcacagaggtgggggggaaataagccacacaagaggtgtgaagaaagagaaacacttataggcaaagagtgtggaagagggaacacaagtgtgtatacaaagtgtctccccagagggggcgccacagcacacagaggggccctgtggggaccagaggtgggagagagggagcgccagaaacccccagagagagagggagagggggacaaaaaaaaagaaagaggcacaaaagagaggggtactcggaagaatatcccgagaaggggagaggggccaaagagaggggaaagagaggcgtaaaacatttttccccaaaacaaagtggggggtaacacaagagggggggcccgcggggggaagctcaggggggacaccaaaagcgagagtagtgtccacaagaggtgccccgtggagaaaaccacgagaaaaactatcgtgagagaggggagaaaggacccctatgtgttcgcgggggccaagaagacctaccacccaagtaggggatggggcacaaacgggggcccaagaggaaaacaaccaataaaacgctcgggggcgaggcaaaaccacagtgttattggggaccaaaggcgcaaac

SEQ ID NO: 642416 - DNA, 903 bp, Homo sapiens
tatatcaacatatgagtgatcccagtcacgtgagattgttcctcgactggtcatatctgtttcctaaaaaacatctatggtactgtcgcattatgtgtcccgtctgcatcaccgattggacaacgcccggtgatgtgcgagaggatacatgtatatttgccagtaagtgctctgtgagagctctagtctcgtggctcttcattcagacagatgtgcagagttcagaaagcgaccattgtcaagattaagccccgaaagtggggttggaactaataagtgggctatgccagaggaaagtacccgagccgcccgggtagacaaatttgtaaataagccctgaaagagactccaaaaagattcctgtggccaatccaatacatcccagcctcttctaatcaggttctcctttcaaaaatggaacaataccgaagtgtgggagagcagctgtaaaaagtctccaaatcagttgaccccatttttggacaaccttgagatggatgctgcatctccaacatccagcgaagtcagagctggttcagcaaagattggcccacccatcatgagatagacacagttcatcccatggacacaatgcaagatgcctttcttgtcacctttatctaatacaggggatgacagtgccgtatttgcttcacaggcacagacttgatgaaagtagctcccatggtggtggggactggaccctgtgggttgaaacttctctacactcagtaactcaagcagaagtggcacattccatgggttggcgaaaggctcaaaaccaaggcgctttcgtatgcaacattatgagcggggcaacgcggacgaaggcggtaaagcccaacacatttgtaacaccacagcacgactgcacacaagccggcgggcagtgaacgaaaaccg

SEQ ID NO: 642417 - DNA, 1042 bp, Homo sapiens
  misc_feature (887)..(887): n is a, c, g, or t
  misc_feature (1041)..(1041): n is a, c, g, or t
acgagccacataggctagtggagcctgggtgaatcggacgaggcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagttagctaccaaaaccatgtcatgggcgcctccttccgcaacacggcgagatcaagcactggcggtgtgattctcacatttaccaagtcctggagagctgtgcggaacgcagctgtgcnggtccgccagggccagcgactgaaatcccggggaagttcgggtgccccggccggtggacccgcgcccattccgacaggcggcacattagagacccggacacccgcaacgcgttcgcgcacatatagcccgaaaaacgcctgtagttgtgttggnc

SEQ ID NO: 642418 - DNA, 424 bp, Homo sapiens
gagagcttggcttactgcaacctctgtctcccgggcttgagtgatcctcccaccttggcttcccaagtagctgtgactacaggtcaccatgcctggctgatttttgtattttttttaaagagtgagttccaccatgttgcccaagctggtcttgaactcctgggctgaaatgatccttctggctcagcctcccaaagtgctggacttacaggcgtgagctaccacgcccagccaattattttcttttttggggggtgggggatggagtcttgctctgtcacttaagctggagtacggtggcgcgttctcggctcactgcaacctctggcttccgggttcacgccattctcctggctcagacttctgagtagctgggactaccgatccagatgatggaggcagcaacacgacacatcgaggaggg

SEQ ID NO: 642419 - DNA, 929 bp, Homo sapiens
  misc_feature (775)..(775): n is a, c, g, or t
  misc_feature (781)..(781): n is a, c, g, or t
  misc_feature (802)..(802): n is a, c, g, or t
  misc_feature (804)..(804): n is a, c, g, or t
  misc_feature (806)..(806): n is a, c, g, or t
  misc_feature (809)..(811): n is a, c, g, or t
  misc_feature (816)..(816): n is a, c, g, or t
  misc_feature (822)..(822): n is a, c, g, or t
  misc_feature (826)..(826): n is a, c, g, or t
  misc_feature (839)..(839): n is a, c, g, or t
ggacgcgtgggtcgacccacgcgtccggcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggcggtgtgantctcancatttaccaagtctgggaacngngnggnnnggcantgggcngtgnccagcaggggcancagggctggaaaccccggggaacccctgttggaccagaacagtgggcaccccggcccaggccgaatacagccggaaaacaagacaacccc

SEQ ID NO: 642420 - DNA, 237 bp, Homo sapiens
gcttttctctttttgagacaatgcctcattctgtcacccaggctggaatgcagtggcacaaatacagctcacagcagtcccaacctgccaggttcaagcagtcctcccacctcagctgcctgagtagctgggactacacgtgtatgtcaccatgcctggctgactttttaatttttttatagcaatgaggtctccctgttacccacgctaacaaaaaaaaatttttttttttttgag

SEQ ID NO: 642421 - DNA, 876 bp, Homo sapiens
  misc_feature (6)..(7): n is a, c, g, or t
aaggcnnggtagcgaggctgggtgggctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagttcgctcccaaacccggtcgggggcccccttccggaagggggaaaccagctggcggggggttcccccacttcccaagtcgggaggcggcgcggccgcagggccgtgccccagggccgcggccgaaccggtgatccggggccggcagggggaacgggcctg

SEQ ID NO: 642422 - DNA, 1200 bp, Homo sapiens
tgcagtggctcttccctgctaatcccagcaactttgggaggctcaggtgggaagatcgtcggagctcaggagttcaagaccagactgggcaacatggcaaaaccccgctctgctgcaaacaacttacaaactacttagcctggcactggtgccactactgcctatactccagactactctgggaggctgacgcgagggaggactcccattcagcccccagcaggctcaacggctgcacgccatgccctgcacccctgcccacagacacctataaggaaggccaaaggacacggctacgactcacctgccacgcatcaggacgcttcgtgaccacgccttggccacatacggatgcaaaccctgctctctacctacaacaatacaaacaatccggtcctggattgtggctcgagccgggccacgtgctaaatcccaaactacttccaggcaggcctgcagcaccagcgacgcaaatcacctttgcacactccatgggcgacgcgctggcaccgggcatgccacgccggaacccacacgacttgaccaccccacctgcacgacaccaggcctaacggacaacggggcacgacgcgcacggacctcatgtccacacccaccgacacaacccacccacaaaccaaacacaaaaaaagccaaagcacgaaccgcagaaacgcaaaagacaccaaagacgaacagactaccagcgagcaccacgcgagagcacgcaacacctcaagtggccctgtgaagccaacaacaccgccagctgggcgaggcccaacgagcgcggcaccggcctcccccgtgtgccaccctgcggcgagataaagacagcccgagcccccagcaacacaccccagcgggagagaagcagacactcacatcacaaccaacgtcagaaagacaagccgacgcaccgtaccccccaaacacgcgcaaccccacggggcgacccccggggcgcccaacaaccataccccagcgcgcccgcacacgcggacaaacgaggaccgtaggacattaagaggcaacaacgagaaccaagagcgtcgatagtgcacccgcagtcccccgtctgcgagacaaacgtagtaaggacacaagcaagaaaagagagaagaactacaccacaacacccacgccaccacgcagaggacagctagtcacgccacggcccacgcgcacagcgcagagcgg

SEQ ID NO: 642423 - DNA, 689 bp, Homo sapiens
  misc_feature (578)..(578): n is a, c, g, or t
  misc_feature (614)..(615): n is a, c, g, or t
cttttggggtctttgctctccttgtggtggtacggcagtgggatgcacattttcctttgaccagcgttctcccagctgtcgcaccgctcactcccatgctgttacaggtcacctcttgcaggggcatatttgatcgctgggcacttagtgtttgttgttccatcattatgcaaacagccgcctcttgatgaaccttcagtgacccagaagaaggtgtgagaagtgtggctggaccccgctttcggaaatgctctggactcccctaacgtcctggggaattacagggttccttcacatgtttccagttggaagcaagtactccacttactttggcttttgaaaactatttccctacgccatcgacgagtacaagccccaggatgctaccaccaacccgtccctgatcctggccgcagcacagatgcccgcttaccaggagctggtggaggaggcgattgcctatggccggaagctgggcgggtgagtgcctggactcgggagggtcccagctaggccctcgtgctagtctagttggccttgcttccctccctaactgaattttagttctcaaacaccangaactcaaggggggaaaaaaaccctatctttttgcnnatttttgtttattgaagtgtaatctgcatgaagtaacctgcacctgtggtaaatgagcagttcagagagttttg

SEQ ID NO: 642424 - DNA, 309 bp, Homo sapiens
ctagtggaggaaagctggtaatagcggtggtatacatggttgtccggtgcaagattttagtggccagtgtgatgagctgcaacatctggtgtgacgcaaggggccggtcggcaagtgcccgcgggaacacccactccggcgaggcagaatataacactgggtgggtgggtgtcctgacgaatgggccggtaatatggggtgcctcgaagcgttcattacaaattggagcagggacagatcatagatttctgattttatgtaaaattttgcctaatacattaaagcagtcacttttcctgtgctgtttca

SEQ ID NO: 642425 - DNA, 143 bp, Homo sapiens
gatcatggggtgatacctcatgctgtctctgatagtgagtgagtctcatgagataaatggttttataaggggttctcctacttcatctcattctttacttgttgtcccatgtacatgtgttccttccccttctgtcgtcttct

SEQ ID NO: 642426 - DNA, 1284 bp, Homo sapiens
acgagccacataggctagtggagcctgggtgaatcggacgaggcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 642427 - DNA, 1380 bp, Homo sapiens
tgtgccccgcccccatgtggggggcggaagacgaatgaaaataactacacacccgccccgctctccgggggggggagcaggacaacatagatcaaaacagaaagatacagaatttgttgtggtgtgaaggaagatgaaaaagaaaagcacggggggggtaggatgacctcccctacccgtgggagaggaaggcgcccgtcctaaaccatatctatccgaaccaaagcgtggcgcccgaaccgaggcttgtgaaatgagaggcaaagcacagggaagggcagtagcgtagagaaaacgagggagggaaatgaatgtacgtaaacgtattcaatgaaaagaggctttcgtcctaaccagggaaacacaacggagggtagatagggagggaaggtaggcccccaagccggggaagagggaaccaaaccaggcgacccaaccagagccgcttcgtcccaccggctgtcggaaggaagcagacagcaaccaacaggaaggattaggaaggcgggagcaccgtctcaatgaaggaagtgagggtttgggatatacgagaacatactggggaagcagtttctccttccaggaagcaggaggtgggcggggggggttgtgcggaccacacgaagggagtgagtggaaggacgtcgtcttctggcgcttcaggagcaggaggtagtaagcaggggggggagaaaaagaggaccgccttgatagtccttgctgggaggaaagtaattgttagtgagtattaggagattagttgtaaaaggcttataatttatcgtagaaaggaggatttcggcggcgggcggagaagattggtagaccccacggcgccttcggggagagatttggaagatctccatcacaggggagattagagcttgtaggatatatagagagggggcttcgaagagggagaaagggagagagggggagatagacacacggaagacacacgccggcgcgcacactgggggcggagagagagatgagacctttcttataaggcacacacatatagctggggggctgttatagagaaattctctatttcccactctaatttctctcttaacactaagggcgccttgtttctaaagaatccaaaatttttcacaccacgagatcctctctcccctatagtaattcttcacagacaacacatggcttccctggttttccccacatccttgtcctttccacatgtttcacttaaattcacataattgccccgcgccctagtcccacattttcacacttcctttgaacggctcctagtaagttttgttaaattcttataccccgtaatttttgcttttaattttgataacctctttatgacttaaccaatataaaaggatgtatggtttttatcca

SEQ ID NO: 642428 - DNA, 1260 bp, Homo sapiens
ggacgcgtgggtcgacccacgcgtccggcgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 642429 - DNA, 470 bp, Homo sapiens
cgtgtaaggtgatgggtgagtgagccccatggtgtggtggtaaatactgtagagggagtatagggctgtgactagtatgttgagttcaaacaaatatttgatgacatacatggatgaggtaaactaacaatgtaatttggggtacgtgacagactccagagctgtaaccggaagcttgggtggggccggggggcggggagagtggttcagttaggtggtacaagaaaagcccctctaagaaaagaataggctgggcatggtggttccacctgtaatcccagcactatgggaggccgaggcaggaagatggcttgtggtcaggaattcaagatcagcctgggcaacaaggcaagatcctatctctacaaaaaactttgaaaattacccaggcgtgatgactcacagctggggtcccagatctggggaggctaagacaggaggatggcttgagcctgggaggttgaggctgc

SEQ ID NO: 642430 - DNA, 1260 bp, Homo sapiens
  misc_feature (3)..(5): n is a, c, g, or t
  misc_feature (18)..(19): n is a, c, g, or t
agnnngtgggccgtccgnncgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 642431 - DNA, 113 bp, Homo sapiens
gacgctctctgtggggatcttcatgagagtagtcagatcatgtcccggtcagaccaggtgcagacagcaggatggcatgggggagggctataccccgtcgtagatgtggcaca

SEQ ID NO: 642432 - DNA, 132 bp, Homo sapiens
tcgcagcgcacaggcagacagacagcacatagatagtcagacacgggtgacagaggaagacgcagggcgaatcgcattcagtccacggtgaaagatgacgaggagagtaaatgcacgcgagcaggagggacg

SEQ ID NO: 642433 - DNA, 322 bp, Homo sapiens
  misc_feature (22)..(22): n is a, c, g, or t
tcctcaaatatttgggacaatnttctactctgtgctcaagcattgttttaggtcttagagattcagtgaaaagacgagtcacggccgggcatggtggctcactcacgcctgtaattccagcactttgggaggctgaggcgggtggatcactaggtcaggagatcgagaccatcctggccaacgtggtgaaacccgtctctactgaaaacacaaaaaatttggctgggcgtggtggcgcatgctgtggtctcggctactcaggaggctgaggcaggagaagtgcttgaacccgggaggtggaggttgcggtgagcagatcgat

SEQ ID NO: 642434 - DNA, 218 bp, Homo sapiens
tgacgtatataaggactatctcattggctcctactgacatgctaaataacaaatggaaattgctgtgagtgtcatgcagcaatcttaggaatattttattatgtttctgccggaacataattggccgaggcttacgttgaattgaggccacgaaatttggtggtgttgatgggaggttacagggatagagcttatcaacttaatcaacttatctcatg

SEQ ID NO: 642435 - DNA, 1451 bp, Homo sapiens
acgagccacataggctagtggagcctgggtgaatcggacgaggcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttcaaaccacacacaccaccataaccaccaaaaacaggggcgggagaaaacccgggcccgtcgccccccttggaaagggcccagagaggaaaaagccgggaacacccgaaacccgtctggcaccttgtggcgggcccccatacgaatgggtcccatccgttccacagaccg

SEQ ID NO: 642436 - DNA, 433 bp, Homo sapiens
  misc_feature (2)..(2): n is a, c, g, or t
  misc_feature (16)..(16): n is a, c, g, or t
  misc_feature (184)..(184): n is a, c, g, or t
  misc_feature (425)..(425): n is a, c, g, or t
antttgaacccccacnttttgacccgtttaattatatttaaaatataaccccaataaaataaggttaggaaaatgattgccatattaacctcctgagaggaaagaatgttatcctgttggtagaattaataaagttacctcatttccttataagaagtaaagatatattggcccgggtgccggntgtcgcgcctgtgatccccagcactttggaaggctgaggcaggcggatcacaatgtcaagagattgagaccatccctggctaacacggtgaaaccctatcgctactaaaaatacaaaaaataagacgggcgtggtggcgggcacctgtagtcccagctattcaggaggctgaggtaggaggacagcgtgaacttgggaggcagagcttgcagtgagccgagatcatgtcactgcactccancctgggct

SEQ ID NO: 642437 - DNA, 1451 bp, Homo sapiens
gcccactccaccttactaccagacaagcttagccaaaccatttacccaaatcaaagtcatcaggcgcatagcacaatgcaaacctggcgccaatcagcatcatagtaccgcaagggcaaagcatgcacaacacattcataaccacagcatcaatcatcagccaaggcactaacccctcataccttctgcatcaactgcacattcacactagcacacatcaacatttgcacaggcagcagcccaacagctcaagcaccccacggaacaccagcacgcagctcacctcaagcaaccagcacacaacagcaagccacaccccgtcctcatggtcagccacacacatcagctaggcgcacagcattctcatcagcgtcagcagcgcgcacccacacaccctcaccggcagcacatgcgatgcatcagcctggctctgctccccaaagcatcagcacatcctctccacgtcaccacacctcataacaacaagtttcagtcacaccaaccaagacacacccgcaatcgattaacaacagtcacgcccgatctgggaaacagcatgcatcaaacgatgcgtatcaagaatacccgaacaagacaggggacacacacaggccattccataaaggcgaacaccaccatcaaagcgcacaacccacacacccagctctgaataccaaacggccaggacagggtaaacaagagcaacagtctataaaagcacaaccaccccaacctccgacactacagggccacaattacgagcaaagcacgaaggaccacacacagccacgacgttctaaagagacacacaacggaccggtttaccaacaagcccattccacaaacaccaccgaccccgaagcagtaacccccgttaaacacacacacacaatcacgcaaagaaacaacccaacactttagttagacccgtgggcacacacctcccccatccccaacaacagccccacacatacgggaaacccaaaagcacgtaattccaaccaccctaactcacgccaacgcaaacacctcacacaggctacacagctacactacaaaggctaccagcccgtgccacaacacccaaatctcccaccaccaatcaccgacaataaaaggaacactgaaccgctccaagcaagtttcacacacaccaaccgacgcaccaacctggagcccgaccactcaaacccaagccgcccaaaagtcaataataaaccaagctcaaaaaccacacaacaaagcatcaagttgacagaaacaggcgaatatcagatgggtcaagaaccccacagcaagcaccaaggcccacaatgtccagtacataacaagggcacacacgggcgtcacaaccaacaaacagcgcgaccaacagcgacacccatcccgacaacccacctccactacaccccccacaccctggtcacaacccccaccacacacacacctta

SEQ ID NO: 642438 - DNA, 1050 bp, Homo sapiens
  misc_feature (1010)..(1010): n is a, c, g, or t
acgagccacataggctagtggagcctgggtgaatcggacgaggcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaagggggccaagccagtgacctggaaaaatccacctggatgagaagtcttccgtgggtggacaacggaggaccagatggtgtggaaacccngacggaccagtggcatccaatggcggttgaaattttggag

SEQ ID NO: 642439 - DNA, 1416 bp, Homo sapiens
acaagctccgggtggataaggcagctgttgcagcaggacggtaactacgagagccatagatctagatagagaaaggcgtgcggttgcgaggtgcaatgaagcctgtggtatggtataggataaggagtagaacggctgctgttgagtagttaatggaatgctagacagacacgcctctgggtgggtgaaatcttggcaggcatgcatcacgcataagaatcctaggcaccctgaataccattgaacgcctcgcaggatgaaagaacacctactaccagatgggatgaatgaagtcctgctggcgatatacaagtctttttaaaattttttgagttgaatttgcccattgagaaaggggttctagagaatcaagtttatggagaccaaggggtatcattttttggaaactaagaagggatcccgttgaacttgactatcatgtgccagggtgtaagcatgaaagacatactttacgaaaaggaacaacatgaggggccaaaatttgacattcaaaggccaccaaaagaaagaaggatggacataggccatggtaattggggagagccattcacaaggggacaaacctggagcggaacaagcaacaacgtggattatcgagacacccggagagccagtggttggatacatcctattccaattcacccagggaaccttggggttaacgcctatattaatttaccgggtgaggttacattccatgggagacctttcagtggtaatacacatgagcacttaccccacgtaaaaaatacgttttgccactttaaggccgcggcgcaccacggggcgggccccacagcagtgaaacagtggggcgttgcacaggcggcgcgcatcagcctaggctatcaagtgggtatccaacattggggtgtcccaaccaggggtggcaaaaagcgcaatatgggccttacgccaagttgcgttaatgttgcgaagatttaggatttttccacgtatggtggctatcgcagaaaagacacacgttcccaggagagccattacccaaagttactcggggagcaattcccgcgataccaggtcacggggggcactttgggggaaatgaacgcgagctcgcagcgagactcatccagattgggggaaaaggtggagatgggtaatgcacagatggatgggtaatacatggtgttgggcaaataggtagctggtagctatatagcggtataacagtgagcacattgggagaaaagagttatggggcgcaatcacgaaaaagcagctaaagcgatagttcaggagaggcgagggggcacattatagtggtaagtgcgggcagcctaagtgtcgtaatgagtggtagtaagccgatgttttgcagacaaggggggagattaaaactttccaaactggggggaccatttaactggttta

SEQ ID NO: 642440 - DNA, 446 bp, Homo sapiens
  misc_feature (35)..(35): n is a, c, g, or t
  misc_feature (60)..(60): n is a, c, g, or t
actggatagcattcagcctcatcacaggaaattcnttctcctgctgcacagaacactggnaaaagcaagacgtgaatttgattccattcatcagaaaaggagcattcgtggcccacttgctacaaactgtggcatctccccagcctcttagcgggaagaagggcagggcaggggctcacagcccttgggtttttgatgacttctcatatttctctgggtgtcctgcacccccacttccagaactttcttcaaatatccttcaggggtccccggggtgggtcctatcccagaaccagccccagctgtcccgagaggagaggataaggcagatgaacagcctcctggcaggttcagttagcctcagcctgtttccttcctttttcagaacaaggacatgttgaccagtgacacggcaatgtgtgcgcaattaaatgtttttacctgtt

SEQ ID NO: 642441 - DNA, 302 bp, Homo sapiens
tttttctggctgagacggattttcgctcggtcacccacacggagtgcaatggcgcgatctcggcccactgcaacctccgactcccgggtccaagcgattctcccgcctcagcctcccgagcagccgggactagaggcacccgtcaccacgcccgctaccttgggcattcctagtagagacggagttccaccacgctggccaggctgatctcaaacccccggcctcaagtgactcacctgccttggcctcccaaagtgctggaatcacaggcccggcctatctttgcaatatgggtctgcaca

SEQ ID NO: 642442 - DNA, 106 bp, Homo sapiens
tatgctctggagacttggttatacaacatgtcagtgtacgtaacactactgaacttaaatgcaagacacttaaatgctaagacaaaatctcactctgcctgcccag

SEQ ID NO: 642443 - DNA, 784 bp, Homo sapiens
  misc_feature (7)..(7): n is a, c, g, or t
  misc_feature (141)..(141): n is a, c, g, or t
  misc_feature (145)..(145): n is a, c, g, or t
  misc_feature (149)..(149): n is a, c, g, or t
  misc_feature (157)..(158): n is a, c, g, or t
  misc_feature (169)..(169): n is a, c, g, or t
  misc_feature (179)..(179): n is a, c, g, or t
  misc_feature (182)..(182): n is a, c, g, or t
  misc_feature (193)..(194): n is a, c, g, or t
  misc_feature (211)..(211): n is a, c, g, or t
  misc_feature (220)..(220): n is a, c, g, or t
  misc_feature (223)..(224): n is a, c, g, or t
  misc_feature (226)..(227): n is a, c, g, or t
  misc_feature (229)..(231): n is a, c, g, or t
  misc_feature (233)..(233): n is a, c, g, or t
  misc_feature (235)..(236): n is a, c, g, or t
  misc_feature (238)..(239): n is a, c, g, or t
  misc_feature (241)..(241): n is a, c, g, or t
  misc_feature (243)..(244): n is a, c, g, or t
  misc_feature (251)..(252): n is a, c, g, or t
  misc_feature (260)..(261): n is a, c, g, or t
  misc_feature (265)..(265): n is a, c, g, or t
  misc_feature (268)..(268): n is a, c, g, or t
  misc_feature (272)..(275): n is a, c, g, or t
  misc_feature (281)..(281): n is a, c, g, or t
  misc_feature (286)..(286): n is a, c, g, or t
  misc_feature (291)..(291): n is a, c, g, or t
  misc_feature (293)..(293): n is a, c, g, or t
  misc_feature (295)..(296): n is a, c, g, or t
  misc_feature (299)..(300): n is a, c, g, or t
  misc_feature (308)..(308): n is a, c, g, or t
  misc_feature (311)..(312): n is a, c, g, or t
  misc_feature (319)..(319): n is a, c, g, or t
  misc_feature (323)..(323): n is a, c, g, or t
  misc_feature (330)..(330): n is a, c, g, or t
  misc_feature (333)..(333): n is a, c, g, or t
  misc_feature (339)..(341): n is a, c, g, or t
  misc_feature (353)..(353): n is a, c, g, or t
  misc_feature (356)..(357): n is a, c, g, or t
  misc_feature (365)..(365): n is a, c, g, or t
  misc_feature (367)..(367): n is a, c, g, or t
  misc_feature (372)..(372): n is a, c, g, or t
  misc_feature (376)..(376): n is a, c, g, or t
  misc_feature (382)..(382): n is a, c, g, or t
  misc_feature (403)..(403): n is a, c, g, or t
  misc_feature (405)..(405): n is a, c, g, or t
  misc_feature (411)..(412): n is a, c, g, or t
  misc_feature (423)..(423): n is a, c, g, or t
  misc_feature (434)..(434): n is a, c, g, or t
  misc_feature (436)..(436): n is a, c, g, or t
  misc_feature (450)..(450): n is a, c, g, or t
  misc_feature (452)..(452): n is a, c, g, or t
  misc_feature (460)..(460): n is a, c, g, or t
  misc_feature (465)..(465): n is a, c, g, or t
  misc_feature (473)..(473): n is a, c, g, or t
  misc_feature (501)..(501): n is a, c, g, or t
  misc_feature (556)..(556): n is a, c, g, or t
  misc_feature (566)..(566): n is a, c, g, or t
  misc_feature (574)..(574): n is a, c, g, or t
  misc_feature (576)..(576): n is a, c, g, or t
  misc_feature (586)..(586): n is a, c, g, or t
  misc_feature (606)..(606): n is a, c, g, or t
  misc_feature (610)..(610): n is a, c, g, or t
  misc_feature (632)..(632): n is a, c, g, or t
  misc_feature (664)..(664): n is a, c, g, or t
  misc_feature (674)..(674): n is a, c, g, or t
  misc_feature (688)..(688): n is a, c, g, or t
  misc_feature (702)..(702): n is a, c, g, or t
  misc_feature (704)..(704): n is a, c, g, or t
  misc_feature (759)..(759): n is a, c, g, or t
gacgagncgatggcggagagtccgactgaggaggcggcaacggcgggcgccggggcggcgggccccggggcgagcagcgttgctggtgttgttggcgttacggcagcgtcggcgggttcgggccgcctttcctgccggatntttnggcngcggcggnngcacgggcggngccgggtgcncgnggatctgcctnnctcctctgcccccggcncccaccctnaannannannnananngnngnannacttaannactagaannccanacncaannnnaaatgnaaaanaaaanananntcnnacaatatntannccaaatnaaanaaaaaanaanataaannnaaaaaaaaaatnatnnaaaaatananataanaccnaaaaanataaaaataaaaaaaaataananattaannaaaaaaacatntaaaactcctnanaaaaaaaatttatnantgttcgtntttcngtgtccgnccgactatcccatccacccacctcgggncaaactgatgacaacggggaataacacagttaggtttaaccccaacttctaccgnaatgggaaantctgcttnantattctaggnacattgactggacctgcctngagnccaccccacagcatctcctcanttctcatctctatccagtccctgatgacttanaacccctatnacaattaaccccgnttttaacaagagananatccatgaagacagcaaaaactataattaatttatcccgcacgagaccatcacantttcagtcttttacattattgaagg

SEQ ID NO: 642444 - DNA, 162 bp, Homo sapiens
acgcaggagggggtattgtgattgtgtgttgtgtgtgtctgtgtatgtaatggtgtgtctctgtggcgggaggggctgtgtgtgattgtgtgtctgtgtgtgtctgtgtatgtatggtgtgtctctgtggcagagagggtgtgtgtgtgattgtgtgtctgt

SEQ ID NO: 642445 - DNA, 462 bp, Homo sapiens
tataaaattattagtataaaaggggaaataggtaggagtaccgtggtaagggcgatgagtgtggggaggaatggggtgggttggtatgtccaacctggtcctattttatttttaactgttggtaagattatgggggagtagtggtgattggaggtgggagtaacattaggctgtaggtagaatgtagaggttaaggaggtgtgatggtgggactgggtccttaagagaaggtgtatagcctggggctagaagacaaggagcatctggcgaggatgtacggaagtgatgctgcagtgctgaccccaataaagtttctgcaagggcgaaaaaaagaggccttcctcagtgggggaccctgggagcaggcaaccatttatgcagaaatccaggttgtgggatgagattttcacatgagtatgctgctaaaaaaatggggcatcgaccataagggacaggtgtgtg

SEQ ID NO: 642446 - DNA, 686 bp, Homo sapiens
gagaaggccggtggtcgccactccgatcgtaggtctggcgtgtattccgagcgttggctgtctgctcgggctttccgaggcgtcggtgtctaggcggttttccgaccgttggtgtctggacgtgtttctcgaggcgttgtgtgtctgggctgcgcgccaacctctcttgcggttggttgcgccatgaccgagtgtatgagcacgaatgaaggcacacaggcaaaagacttgatttcctgagggcacgaagctctccagattcctgcggttgctggacatggaacgtagagtggcagcactaactgagccactgataaaaccaaacggccaagtgcggcatctatatcgcatagtggacactagggtcagcgacagtcgggagccacatccgtcggttagccctgtgcccactcatgcttccaggaggggcccagcgcaggacccccgagtgtgtgatgagtagtttcccacttggttctcgcctgtacagtgtccttgcgtcccatcattgggttgagactaattgactaggtgcaccccggagagaacagttccccgcgtatgtagacattgcacggctgcaacggcgcgcttcgtgtcacatcgagggtccctgcataccgtgcctaaaggccgtgagggaacccttgtactccgtatggccgcgctcctgggcagacactcta

SEQ ID NO: 642447 - DNA, 301 bp, Homo sapiens
tgttttttatttttaatacatttgaaaaaatgtctaaaaaccagatttaattttgtagtattgtatgtagattgatgttttatttaatctattttagaataaggctgtaaatgtaacaaaatgtggataaagtctaggggtctgaatactttcctaaggcactctacatgaaaatataaagagagcagtgctttgaaagatgccatttactgggctgcttttgataccatcgattaccacattcttttgaagagattggaaacccaaattggtttacacggacaagttctggcgtcgacgc

SEQ ID NO: 642448 - DNA, 245 bp, Homo sapiens
  misc_feature (225)..(225): n is a, c, g, or t
catctcacctcagccacctgagtagctgggactatatgtgcatgccactgtacccagcaaaagaaattattaagcagggacatagtggccttgaagtacaaaatatgtgaagaacaaaaatatttctgacatcttattagaggagtgatctttagcaactgactgcaaggaaagtgatacttaatgaggcaggctatttcagttatgctaaagcaactgagagantacttctgtccctgtggaaa

SEQ ID NO: 642449 - DNA, 390 bp, Homo sapiens
  misc_feature (165)..(165): n is a, c, g, or t
  misc_feature (390)..(390): n is a, c, g, or t
ctacaccgtgagtaaaattttactttgtcaatactgaagtctctgctgtaatccttatatatctttctccagagaacataatattgtcaaatagatacacatttttctaatcaggtatttagcaagcacttgaagatattctataatctcatgcagtgtgttacnaatctcagttatttgctgtatgtttgtatagctctaaatgtgacattacatattattttcagagatgtctaatgttgtaattttgtatttttggtggaacctattgtttgtctatgttgcggattctctgtcacttttgatatgtgtaaagcttatatccctgtaattctgtatacttatagagttttctatttctcagacatctctgtgtagacaattgaacgn

SEQ ID NO: 642450 - DNA, 839 bp, Homo sapiens
ggccattttaacagctaaaacttgtcggattgctttctattttcaagctcaaaagacgatagagaaagaatacttgaaggccacgaagcttgagagaagaacaatttcagaaacaattgtctcaatttgactagaatatcaatgaaccaggaaaactgaagcaccttccctaaagaaacacttgggtataccaattactccacagacagagctgagcgcgtatttacccaaatcagtcacttggatttgctgcctgatacgtgaatcttctctggaaatctcctcatgtggatctacggggcatgcttataatggctgctgttgtccaacagaacagacctagtattgaattggctagtacacgtcatggcaggcatgacaccgacaagcttggtgaatccagcctattttctccttgccgtaaattgtgggacccttgtccctggtgctgatattctcactacgttatgccggtctaccctgtgtggcacgagcccaagtgacatgctttcactgacgagttcactggatgtcgctgaagaacagaactccatcagacgatgactgactgaatgacatcacccctttacaagtgaaagctttcttgtcaatgcacggggacttgaacacattctgaaacttattgagggctgctgaggcactccctcaaatatggatgtcactggcattttttctgcatcaaacaccgaatcaataaactatattcagccactgcaacaatacactgttgcggcccagtccccctgtgtcggcacttcatgtgttctgacttgtaaactacggtgagaaatgcgatagggacatactaacaaacacac

SEQ ID NO: 642451 - DNA, 107 bp, Homo sapiens
cctagagcaacacgcttactggacattgaagctttatggccagctgccaaaaagataaatgcaccttaatttctaaattgaattataaagccaaaaatatcctattg

SEQ ID NO: 642452 - DNA, 168 bp, Homo sapiens
cgtatcgggggtcagaggattagagtctcagtcatagcctcttatgtctcagatcaatgattacttacttatataataagaattaatttattttagagacagggtctcactctgtgcccaggctggagtgcagtggtacgatctccactcactgcagcctcgaccttc

SEQ ID NO: 642453 - DNA, 864 bp, Homo sapiens
agcggggtctagcggggcctttgtcccgacagagctccacttcctgtccccgcgtgtctgtgtaccctgctagccgtaggccgtgtgaccctgagggcaaccgggagatccagaagtgaaacgccaggctctctggaggcaggagatggtgtgatttgtccagagaatctttcctaagaggaaatcccaggagaagcaggagcacaagagcacgacaatggctggtgctcacgactctgttgacgttcagcgcatgtggcccatagaaattctccctggaggacgttggccaatggcctggacctcgctcagccagaaatttgtacaggggatgtgactgtagcgcagaactaaccagcaaccttgtttctacacgagagtctcactggtctggtaaaagccaaggactggatacacttgcacttggaaggcaaatgaaaaaagaagagccttgggaacttgttgacggagaacagggaagggcatgtaagaacgtggacaatataccagtcattccggcgagaaacggttttataggctttgtactgagaagtaatacttgggagcacatatggtgaaattaatgggctcggacggtggcaacaattggaagggcgcagccacgcgacttaacttaccattaccacagcaatggccaagcgcatgtgatacataaaccccctattccaaaatataatagaaataataacaagcaagaaaacgctggaagaatcgtggtgattgtgcgcttcgcacacggcgaacacacaagagtgagtagccaaagaaacgcacaacatgacactggtcaagcctcgtacgggcaacatccttcgccatataccgaacaaaacgcttgaggag

SEQ ID NO: 642454 - DNA, 234 bp, Homo sapiens
cattatggcgtttgggcgacacggctcagcaacagtaccgggatgacgcgtcctccgtctggtgctcgtattcagcgaatccaggagcttcctgcttttgccgattccagatttcgtcgcgctcggcgtccacgacctcccgcgctctcaccgcgatcgtttcgacaccggtaggggtcccgatctcgatggacgcgtcgggctgagccttgaggttgaaataccaatccggat

SEQ ID NO: 642455 - DNA, 412 bp, Homo sapiens
  misc_feature (26)..(26): n is a, c, g, or t
  misc_feature (38)..(38): n is a, c, g, or t
  misc_feature (44)..(44): n is a, c, g, or t
  misc_feature (67)..(67): n is a, c, g, or t
agaacgacagatgaggagctaataantatcataccttnaaaggncaagcacccggctgagttgtccnatccactgtgttctaaactccttcccagcttgcgcttgacacagccttgtcttctctccctccgtgcctcgcagtggtagggttccatggaacacgcaggtgaacagtttgacctatggatgagccgatctggagagcctgcctggtgggagcaggttggtccctgcagtccagagtctgcacacagtccttccagtgagtgtctctggaggctgtatttcctgattacaactctatagttttgtctactagagctgacacctttgttttctgtcacttctcaggccaagaagtaactttttttaggaaaatatctttttccagtaaagatgtcctttcatctcg

SEQ ID NO: 642456 - DNA, 472 bp, Homo sapiens
agcactggcagagtttcctgagactcgtcaaaatcatgatgtgctgcacaggcatccctggccactatcctgtccatgagaccaccagctcccgaaaccctcacctatctggtacacacggcaggatgatattctatcctttgaggcagagaagcaagctgtataccatcaggtggaccggccagtctatttccagctgctgaatgtgcttctgcacaaggcccctttcccgatctgatgaggactatggctactggtcctcagacgagaacgagcagttccgaattgaagggtggaacatatcagacacgctcatgtatgtctatgagatgtcgggggccgagctgctcagcaacctctatggcaagctgggtcgtttgctcaccagctcagaggagccctactcctggcagcacacagaggccctcctctacggcttcaatccatcgcagagaccattgacgtcactatt

SEQ ID NO: 642457 - DNA, 420 bp, Homo sapiens
  misc_feature (41)..(41): n is a, c, g, or t
tcagtaatcattcagggtcacacgactggaaaaggctgacnccagatgtaaagccaggctcccagctccttgttcttccactgtgttctaaactccttcccagcttgcgcttgacacagccttgtcttctctccctccgtgcctcgcagtggtagggttccatggaacacgcaggtgaacagtttgacctatggatgagccgatctggagagcctgcctggtgggagcaggttggtccctgcagtccagagtctgcacacagtccttccagtgagtgtctctggaggctgtatttcctgattacaactctatagttttgtctactagagctgacacctttgttttctgtcacttctcaggccaagaagtaactttttttaggaaaatatctttttccagtaaagatgtcctttcatctcg

SEQ ID NO: 642458 - DNA, 429 bp, Homo sapiens
  misc_feature (214)..(214): n is a, c, g, or t
  misc_feature (261)..(261): n is a, c, g, or t
ggagctagtcatctaaggatccaagcgctgatagctccaacctaagggaggtgagtggatgtacctaaaggcagccctcggatctgtgtgatagaacagtctgtggctgtgtcacgtagatctggtgacctgtgatatagtgacacagctctacatggggaaaagaggcacgtgagactctgtattttacttccaaactacacgtgactacacnttatctcaaatgaaaaagtttaatttaaaaagaaaaaactcggctgngcgtggtggctcatgcctataatcctagcactttggaaggccgaggcaggtgggtcacgaggtcaggagatcgagaccatcctggccaacatggtgaaaccctgtctctattaaaaatacaaaagttagctgggtatggtggcgggcgcctataatcccagctactcg

SEQ ID NO: 642459 - DNA, 986 bp, Homo sapiens
tcgttcaatataacgtgttatctgttctccccgaggtattgatatcacagtgttcctttccagaagcgttccaacccgtggagaagtcttccagaagggcggatcggggatcattgccatatccagggttattcggcagtgatctcgatggcactcgtcggacaaacagcaggcccacagatcttggatctctttagctctgttatataagctccggaatcaggaagtaatccacctccagcttgggtcatctcgcagaactgtaggcacctggggttccctgagattcgagtaaatcttaggaatggatactttccagtttccacacacccaataatccgtcgggtattttcgaacgggggggggtacattgaatctgtagctcactctcatgatagtaactgtcatccttgaaccatattaggtcttctcaatccactgtgcgcaagatgtctttccactttttggcattcttaatttcttctgcagccaaattttgtagttttccatatacaagacttttgcctctttggttgtttattcctgagtattttctttatgatgctactgtacagtagaactgtgttcctgaatttcctctggagattgttccacaatggtgggttgttctatttttttaaagcttctatagaaatacatattaattcatattctataacatattagtcattcaaaatctaggccaccaatcttagggggatacaagaagtaaccatcccagttcttcttttcctagaaatgtcacaatgtaatagatctgacattgcatatatttctgatgtgatgaaatggtgatatatcatttctctatcgtgcaactacagctctaaaatttttccaagatagtacatgtattatgctttctataatacttacaccatcattattgcttttaccttttatatctcatattctattttaattatggaatggtattattacatatgccttcccacatattacat

SEQ ID NO: 642460 - DNA, 537 bp, Homo sapiens
  misc_feature (55)..(55): n is a, c, g, or t
  misc_feature (155)..(155): n is a, c, g, or t
  misc_feature (161)..(161): n is a, c, g, or t
  misc_feature (173)..(173): n is a, c, g, or t
  misc_feature (315)..(315): n is a, c, g, or t
  misc_feature (322)..(322): n is a, c, g, or t
  misc_feature (370)..(370): n is a, c, g, or t
  misc_feature (378)..(378): n is a, c, g, or t
  misc_feature (404)..(404): n is a, c, g, or t
  misc_feature (486)..(486): n is a, c, g, or t
ggaaaatcccgcatgaaaaatcagaacccgccaattccagcaggcataagacttnccaccgggaaaccgaaaaacctgagccaacaaaaccgccctcaacctttaaccaagggaaccaagcctgctgggctacatcagcatcgggaagacttccncccccnccaaatccgggnacacatccccaagcaaggaagaaaaaacaaactctgctcagacgcctatgaaacacctgaatgaactttgatgaagtacagtctgagttaccatcatgcacaagtagaactgctcttggacttgtttccctgttgtttgtgnaacctangcgtttgaatggcttgaacgttgcatcttttaaagttattttttaagntttcttgncatttatcctagttgtccgtgtttgncaatgtgctgttaaagtaatagacttttaatctttatgtattttttgttttctctggagtacttggacagatgttatagtgntttcttttaggaaaatctgtcattaaaaaagttatagccttgcaaataacc

SEQ ID NO: 642461 - DNA, 893 bp, Homo sapiens
  misc_feature (37)..(37): n is a, c, g, or t
  misc_feature (556)..(556): n is a, c, g, or t
  misc_feature (579)..(579): n is a, c, g, or t
cagggaggctgaggaatgagaatcgatggaacccagngagcgaggttgcagtgagacgagatcgccccactgcactccagcctgggtgacagagtgagactccctctcaaaaataaaataaataaaatgataaatgatttttggttgtagaattacatataattcaaaagcagttaaatacatcttatatgggacaattaatgggtgtaatttattaaaatattgctttattcaacacatttctaattccataaatatgtgtattcataccctattagatgcaaggatataatagtcaacaatgaatgagtaaattttcatttattataatgctagtaataataatacatatagcaaacctgtctgtctatgtgccaggcattctgagtgttttatgtttatttgtcactctatactttttttcccccagaatccgtattatctttggttcgctgtgttaaaattagactaaatagtctgtgtattttacttgtatccaggtgttctccgcgtcccatcttgcttaccattcacattcacttggatcctcttcatngtccaagtaaatactctgggaanctggtcttaaaaaaatgtcttccttgatgcagtagaggcccagggtgtttatatttatgctttctgaacgcaatgttagagcaaagaaagaagtgacaaccttgagtagagcagtattaacatttcacttggaaactgctatgtctagcctggatagacatttgaaagtctgtttgtagccctactgtttcatatgaagatgactggaactgaagtctgaaatagcaggttacttttcgtggatgtgtaatcatcttcatttagtttgactttttctttaccatgctcaaaatatcagactagttgcaggattt

SEQ ID NO: 642462 - DNA, 243 bp, Homo sapiens
cgaggcacgaaggtatgctggtagcctcaggtaatcaggaggctgaagtggcaggacggattcagatcgggagatggaggttgcagtcagctgagatctcaccaccgcactccagcctggatgacagagtgagaccctatctcaaaaaatagtaataataataataatgattattttggtagagacagtctcactgtgtcgtccagtctggtctcaaactcctggcctcaagcaatcctcctg

SEQ ID NO: 642463 - DNA, 383 bp, Homo sapiens
tgaaagttactaaggccgagtaaaatcctgggcatcaccacagcgatgtggtagggcacgggctccagctcttgtgtaacaagaacaggaatgagaacagctttatattgtagcgccaaggtctcactatgctcacacctgtactcccagctttgagaagaggatctggcaccagcaagggtctggtcacacgcaggtgggcaacggtgaaggacaggaatcttttcctttctgctacacactaaggacagaggcacatgcctccagcaaggggccaaagacggtagcagctacttgggtcttgtgtgggagatgccagacgactccacggcaggtccaactggctttgtccgggagtggactgctggacataagactggaga

SEQ ID NO: 642464 - DNA, 692 bp, Homo sapiens
  misc_feature (37)..(37): n is a, c, g, or t
cagggaggctgaggaatgagaatcgatggaacccagngagcgaggttgcagtgagacgagatcgccccactgcactccagcctgggtgacagagtgagactccctctcaaaaataaaataaataaaatgataaatgatttttggttgtagaattacatataattcaaaagcagttaaatacatcttatatgggacaattaatgggtgtaatttattaaaatattgctttattcaacacatttctaattccataaatatgtgtattcataccctattagatgcaaggatataatagtcaacaatgaatgagtaaattttcatttattataatgctagtaataataatacatatagcaaacctgtctgtctatgtgccaggcattctgagtgttttatgtttatttgtcactctatactttttttcccccagaatccgtattatctttggttcgctgtgttaaaattagactaaatagtctgtgtattttacttgtatccaggtgttctccgcgtcccatcttgcttaccattcacatattttagactggttgatattttcctacaggtttctaagactattcatttttcttcagtcttttttttttctttattctccagatgggatagtttgcgtaattgggcttcagggattttactgactcttctgtcacctctaatctgctataaaacct

SEQ ID NO: 642465 - DNA, 911 bp, Homo sapiens
cggacgcgtgggtccggacttagcacactcctgggcatcctatatgaagacaaagagaggcaggacttcatcttcaccatctatcactggtggcaggccgtggccatctttgtgtgtacctgggctccagcttgcccatgaaggccaagctggcagtgttgctggtgaccctggtagcagcagcagcctcatacctgtggatggaacagaagttgcagcaaggatggtcccgcggcagccgcgcattccgaagccacagcacaaagtccgcggctaccgctacctggaggaggacaactcggatgagagtgacatggagggcgagcagggtcagggggactgcgcagaggacgaagcaccacaggcagggcccctgggtacagagccagctggcccctgccgcaagccctgtccctatgaacaggctctgggtggcgatgggcctgaggagcagtgagagaaccaggtggccagcctggcccttagactcagctttctgccttccagcctcagtttactgtatctcaggttgagggtcccccccccccaaatatgctccacctgcttaaaagggcctttttcttttttccaagaagcctggggtcacctgaacttcctccaggagatagggtcactctcggaaaccccttataccgtgttacaggagtatgccttctgctaaattcaggagatccccttcacgcctgccttggtcaaggtcaacctctggcccctgtgttcaactagacgttgccattttctgcccacagttccttagctcagagggggggttaaatttattttaggggaatatcagtaagattggtttctgcaaaaaacagggggcgtctaagtacccaagggcaatagtcccgtttgcaaggcctagggttagacgacgcgaaggggga

SEQ ID NO: 642466 - DNA, 938 bp, Homo sapiens
gagggaggtgtatgtgaggtgctgcctcctagtactaggagaataagcccgatggtggtgaaaatgacgatctgactggataggtgtggtcagcgatttcggaccacgcggatagtgcattgtaacaatggttggctctatatgattgaaggagcagatggaaataattcgatagtgaaggtttcacgatgtaatatagagtaaagtatggtgatgttaatgtaataaacatcaaagggatgttggagaaatctgttgaatgagtgtctgttggagtagaaatgccaatcagaaaatgtgagttaacagcgtgatgatgtactgaatgtagatgctgattgttagtgggacgtacactgagttcccctgatctctcatgtacctgtggatggctgggagaaaactgcatagggatcaacaggaacaagtggtagacagcaaaatttgcagataggctgccgttgtgctccgatgatgtatgggcaatggctatataatagcttgcagaatgttccgcctctgtgaattggactcataccttgtcccaggaagttatcaagatgatagcaatgttgatgacttgatccatggcaacgtctcgcatattcgagtggaagatcgtggctaagataatggtaatgatagagatttgtgcaaactgaactagacttgggagagtgggaggaccttgttacagaatgttgtgaacttcttctttgtttcaaatatagtgtatccgtggccttctgatttgtttgtagctctatctgttaatagggttctccttatctgccaaattcatgatggtgtttagggaataagaattcattctcacatgtgttgccggaaaataattggttgtcagaaacgatttcagagaggtaagaaatttggcgggggaatctggaaagaaaggtttgattgtaaaaaggggggaa

SEQ ID NO: 642467 - DNA, 852 bp, Homo sapiens
gaacctgggcacacatagagctaccgatttggacaggtcacctgacagccagaggcaggcaaagtggatacattaaggtgcctataagacctcctgtactctgtactccttccctgggagcctggagcaatagcatggtgttcgggaagcgttgcatgtgaaagggaggagggaaaacaggtcggtctagtgcgtcgtggattggactcactgacctagtgaatcccccgtcgaacttatgggaggccaaggccaggtggaatcacgaggtcaggagatcacaggaccatcctggtcgtaatcagcaggtgcatataaacctcgattcgtgctaactatacatataacaaaaaaaattagccaggcgtggtggtagtcgcctgtggtcccagctacttgagaggctgaggcaggagaacggcaatgaacccgggaggtgggaggcttgcagtgagccgagatggcgccgctgtactccagccgtggtgtgacagagcgagacactgtctcaagaataaaataagaggaaatcctgggggaggacacaagggggttccaccaaatctttggctccgtaggggagcctcagcaattttagcgcagtagaaaggtgccgcacgggtaccctggttctcccaaggctcccttaggttgacgaagagcgatatgtcctgtcgattgacaaaacccggggggaccggtatttcgttaggctccaggtccacatagggtgggtgtggttgtgccaactttacccagcggggggtttggaagagcccggggtgctctagcgctcacgttcacgggtccagggccctcttggggctctcgtgatgaaggacccatccctcg

SEQ ID NO: 642468 - DNA, 565 bp, Homo sapiens
  misc_feature (66)..(66): n is a, c, g, or t
  misc_feature (72)..(72): n is a, c, g, or t
  misc_feature (119)..(119): n is a, c, g, or t
  misc_feature (239)..(239): n is a, c, g, or t
  misc_feature (282)..(282): n is a, c, g, or t
  misc_feature (287)..(287): n is a, c, g, or t
  misc_feature (299)..(299): n is a, c, g, or t
  misc_feature (310)..(310): n is a, c, g, or t
  misc_feature (540)..(540): n is a, c, g, or t
  misc_feature (561)..(561): n is a, c, g, or t
ataggagtatcggcgctcatatgactatgacagagatgatgtggagacgctgtgacactgtcctancaccanccagatcagcagacacagacacatggggaaggagacgctgtgctgcngacttggatggaagacggtatcctcaatgaacgggacaactgccagtacgtctacaatgtggaccagagagacactgatatggatggggttggagatcagtgtgacaattgccccttggnacacaatcccggatcagctggactctgactcagaccgcatggnagatnactgtgacaacnatcaggatatngatgaagatggcaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgccccatcccgaccagaaggactctgacggcgatggtcgaggtgatgcctgcaaagatgattttgaccatgacagtgtngcagacatcgatgacatctgntctg

SEQ ID NO: 642469 - DNA, 313 bp, Homo sapiens
  misc_feature (258)..(258): n is a, c, g, or t
ctagaggatccccctagggctcttataaaaaataattgtatttttactgccttactagtcttctgtttccttactattattctctcttgtttattacagaaagtggagtattgaaattccctactataattgtattgctctctttgtgttatattcagttttgttagtatatgctttatatagctaaaaccccaatatgggacacacacacacaaatatcacacatgtatatacaaatttttaataaggatcccctancctatgggatccttattaaaaatcccaaaatactgccctcctcctttttaatagg

SEQ ID NO: 642470 - DNA, 445 bp, Homo sapiens
gatatatatgttggaaggacactactgtgcctaaaagttactatacctacttaattctcttctctctgatatcttcctctcctagcccactcccttaacagctctcactgttaacagcttctccttctctctctctcttttttttttttttagatggagtctttctctgtcacccaggctggactgcagtggcgtgatcttggctcactgcaacttccacctcccgggttcaagcagttctcctgcctcagcctcccaagtaagctggcattacaaggtgcatgccaccacaatccaagctaatttttgtatttttaagtacaacatggtgaaacccagtctctactaaaactacaaaaaaaatttagcccgggtgtgggtggcgaacaacctgtaatcccaagctactggggcaagaggttgcagtgaaccgagaatcacgcct

SEQ ID NO: 642471 - DNA, 294 bp, Homo sapiens
accatgccgcgcgtatgcggacgactagaacgggtaacctgggggtacatctgaacggaccactgtctaagacaacacttggtctgtgggtctgacactaccacgtagaatttacaggcatgataataacagcaccaagactgatacaataatagcacaaactaacaataaggaaagaagaatacttaggccacggcacagtggctccatgccttgtaagttcccatgcactttgggcaggctgattgtgggacggactgcgttgagccaccaggagtttaaggaccacgcctg

SEQ ID NO: 642472 - DNA, 956 bp, Homo sapiens
  misc_feature (221)..(221): n is a, c, g, or t
  misc_feature (240)..(240): n is a, c, g, or t
  misc_feature (244)..(244): n is a, c, g, or t
  misc_feature (556)..(556): n is a, c, g, or t
  misc_feature (558)..(558): n is a, c, g, or t
  misc_feature (563)..(563): n is a, c, g, or t
  misc_feature (570)..(570): n is a, c, g, or t
  misc_feature (589)..(589): n is a, c, g, or t
  misc_feature (722)..(722): n is a, c, g, or t
gcgggtcgtggtctgtcgggcgctacgcggggcacaagtgctattgcgcgccgccgctcgcggcctgctgcggacgccagccttgcggagtacggcaaccttcgctcaggcgctccagttcgtgccggagacgcaggttagctgctggacaacggcctgcgtgtggctccgagcagtcctctcagcccacttgcacggtgggagtgtggattgatgttggnagccgtctttgagactgangaangaataatggggcaggctactttttggagcatctggctttcaagggaacaaagaatcggcctggcagtgccctggagaaggaggtggagagcatgggggcccatcttaatgcctacagcacccgggagcacacagccttactacatcaaggcgctgtccaaggatctgccgaaagctgtggagctcctgggtgacattgtgcagaactgtagtctggaagactcacagatctgagaaggaacgtgatgtgatcctgcgggagatgcaggagaagtgatgcatctatgcgagatgtggtctttaactacctgcnantgccncagtgangtttccagggcacacctcntagcccaggctgtggaggggcccagtgagaatgtcaggaagctgtctcgtgcagacttgaccgagtacctcagcacacattacaaggcccctcgaatggtgcttggcagcagctggaggagtggagcaccagnaactgttagacctcgcccagaagcacctcggtggcatcccatggacatatgcagaggagctgtgcccactcttactccatgccgcttcactggcagtgagatccgccaccgtgatgatgctctaccttttgcccacgtggcattgcagtagagggtcctggctgggcagccggacaaatgtggcttgcaagtggcaatgccatcatcggcacctatgactgcactttatggtgc

SEQ ID NO: 642473 - DNA, 531 bp, Homo sapiens
  misc_feature (10)..(10): n is a, c, g, or t
  misc_feature (14)..(14): n is a, c, g, or t
  misc_feature (36)..(36): n is a, c, g, or t
  misc_feature (45)..(45): n is a, c, g, or t
  misc_feature (54)..(54): n is a, c, g, or t
  misc_feature (62)..(62): n is a, c, g, or t
  misc_feature (72)..(72): n is a, c, g, or t
  misc_feature (91)..(91): n is a, c, g, or t
  misc_feature (96)..(96): n is a, c, g, or t
  misc_feature (124)..(124): n is a, c, g, or t
  misc_feature (143)..(143): n is a, c, g, or t
  misc_feature (146)..(146): n is a, c, g, or t
  misc_feature (167)..(167): n is a, c, g, or t
  misc_feature (173)..(173): n is a, c, g, or t
  misc_feature (188)..(188): n is a, c, g, or t
  misc_feature (195)..(195): n is a, c, g, or t
  misc_feature (203)..(203): n is a, c, g, or t
  misc_feature (210)..(210): n is a, c, g, or t
  misc_feature (224)..(224): n is a, c, g, or t
  misc_feature (243)..(243): n is a, c, g, or t
  misc_feature (248)..(248): n is a, c, g, or t
  misc_feature (268)..(268): n is a, c, g, or t
  misc_feature (275)..(275): n is a, c, g, or t
  misc_feature (283)..(283): n is a, c, g, or t
  misc_feature (290)..(290): n is a, c, g, or t
  misc_feature (318)..(318): n is a, c, g, or t
  misc_feature (323)..(323): n is a, c, g, or t
  misc_feature (331)..(331): n is a, c, g, or t
  misc_feature (339)..(339): n is a, c, g, or t
  misc_feature (344)..(344): n is a, c, g, or t
  misc_feature (352)..(352): n is a, c, g, or t
  misc_feature (356)..(356): n is a, c, g, or t
  misc_feature (359)..(359): n is a, c, g, or t
  misc_feature (368)..(368): n is a, c, g, or t
  misc_feature (395)..(395): n is a, c, g, or t
  misc_feature (398)..(398): n is a, c, g, or t
  misc_feature (407)..(407): n is a, c, g, or t
  misc_feature (431)..(431): n is a, c, g, or t
  misc_feature (449)..(449): n is a, c, g, or t
  misc_feature (465)..(465): n is a, c, g, or t
  misc_feature (530)..(530): n is a, c, g, or t
taaagaagtnagcntttatttccttgttttgcaaanaaaactggntaagtgggntgcttttnggggattagncaaagagaccaaatcccanatccncgtccgactcccccgactctcccttggnttcaaccttagcggggggngcngcagcagcggggggcggcggngggggnagcggccacaggggnagcagcnacaaaggnagagggntcagccaagaaggncttgaccttttcagcaagnggganggggttatccgtctccacanaaaaggncagggctngtttgtncccgtggaggaaagaatgggggactgangcaanagtggggnagccaatntgcanaaagaaantggnaanattgcgganacccaggatttcaatggggcccctggngantttagtggngaaacctaaagcctgaaaaaaggngggcttctcgggcccganaccagttttctgggcnggcacagtgacttcacatggggcaatggcaccagcgcgggcagcagcgggcaccttattggccanc

SEQ ID NO: 642474 - DNA, 1009 bp, Homo sapiens
  misc_feature (221)..(221): n is a, c, g, or t
  misc_feature (240)..(240): n is a, c, g, or t
  misc_feature (244)..(244): n is a, c, g, or t
  misc_feature (775)..(775): n is a, c, g, or t
gcgggtcgtggtctgtcgggcgctacgcggggcacaagtgctattgcgcgccgccgctcgcggcctgctgcggacgccagccttgcggagtacggcaaccttcgctcaggcgctccagttcgtgccggagacgcaggttagctgctggacaacggcctgcgtgtggctccgagcagtcctctcagcccacttgcacggtgggagtgtggattgatgttggnagccgtctttgagactgangaangaataatggggcaggctactttttggagcatctggctttcaagggaacaaagaatcggcctggcagtgccctggagaaggaggtggagagcatgggggcccatcttaatgcctacagcacccgggagcacacagccttactacatcaaggcgctgtccaaggatctgccgaaagctgtggagctcctgggtgacattgtgcagaactgtagtctggaagactcacagatctgagaaggaacgtgatgtgatcctgcgggagatgcaggagaagtgatgcatctatgccgcaaggaaattgggtggggtccattttttaaaaccttaaacccttgggccaaattggccccaacaaggcaaattttccccagggggggccaacaaccccgttctagcccccaagggcttgtgggaaggggcccagtgagaatgtcaggaagctgtctcgtgcagacttgaccgagtacctcagcacacattacaaggcccctcgaatggtgcttggcagcagctggaggagtggagcaccagnaactgttagacctcgcccagaagcacctcggtggcatcccatggacatatgcagaggagctgtgcccactcttactccatgccgcttcactggcagtgagatccgccaccgtgatgatgctctaccttttgcccacgtggcattgcagtagagggtcctggctgggcagccggacaaatgtggcttgcaagtggcaatgccatcatcggcacctatgactgcactttatggtgc

SEQ ID NO: 642475 - DNA, 207 bp, Homo sapiens
  misc_feature (32)..(32): n is a, c, g, or t
ttcgggagtgggtgcccagggttaggtgtggnaggcatggggcaggaccattcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccagg

SEQ ID NO: 642476 - DNA, 924 bp, Homo sapiens
  misc_feature (808)..(808): n is a, c, g, or t
agtcctatgctctgagtgtgagggctgcgtcgcccccgccgtgttggcatgtgtgtggttatccccgcctgtcttggccaggcaacctctcatcgtgaggttccgaattgttgtcaggacgacaaccagtgtgtgggaacatttttaacgaatgggagcccttgtgatcgcccgggagggttttcactgggccgcgtccgcggaaggccttattgaaccgtttagcacttgtaacaccacgcctgttggagcgttctccgtgggtgtgctgtaatgaatatcgggcgaatgcccgcgccgattttttccctgcgcttatgaagggaaacaacagcaaccgcggtaatgtgccgctccgccggcgaagtgtgcccccgttgcctgggaatgagaaaacacaaagggtttcccccgtaataagttaacgcccacacggtgccaatatcctgggaaccttatatttttagaaccgtccctggggcaaaaggccaataccataagttgtttctacaccaaaaggcggatacaccctcttcttcggggtcttacacaggagggcaaccccctggaagcgttttccaagcccgtcgaataacgcttcttcgacccatctcaccgagaaaaggggccttaaacatacttggccgcaaatttttttagagaccgaataaacccaagtctaacccccccccggaagtctcaaattctcaccaaaacacttttgtgttcttataatgggtgcacccaaaacacctaatgttcccctctttctcatttgggaaaaattggtgtgatcaccccaccccgncaaaattaaccttctgctgttctctgtcggctctgtacacaccctctccccccactccgggcccccccccggggaaccattaaaaaagggttaggggccccccccccccaaaaaaa

SEQ ID NO: 642477 - DNA, 211 bp, Homo sapiens
ttccgtttttaaaaaaaaaaaattcccctgtggtagtggccttttaaccatataatattttcttaaccccatgaaataggggatataatgtatgaaccttttgccttggcttgaagccatattatatattgttaaccaaaccccgctctttcctaattaaccttttttactgtttgtatgtattaaataaaggtgctgctttagttttcca

SEQ ID NO: 642478 - DNA, 160 bp, Homo sapiens
gggagcaaggcagcatctgcaaagggatacgcaggaaccggagcgcatcaaagttacgcgaagatgtacctaatcagaaaagtgacccgtctgacaccaaggtcaaagatttcgccacaacccaggtaccgatagaagcatcatcggaaacgaccacgca

SEQ ID NO: 642479 - DNA, 314 bp, Homo sapiens
tagagtgggtctcccggatggtaaagcagatctctagatgtaagggaaatatcaagggagaaaagaatctccagcaaagcaagtacttccacacagcgacaagagttgaaggcggctccgatcgcagtgcttacacatcgcagcttactgaatggacggaggatttatttaatgtctctttatgtaaaaagcagagaggataagtccaagtgtctcccttcctatcttgtggctctatgctagtaacacattttaacctcatctgtcaaagctacagtctaaaaaagaagttttatcaaccttgttcaacactt

SEQ ID NO: 642480 - DNA, 109 bp, Homo sapiens
tcacatacggggagaggcgatcgagcgactatgatgatagtgacgggcaggatagttcagacggtattctatttcctgagcgtctgagatgttagtattagttagtatt

SEQ ID NO: 642481 - DNA, 136 bp, Homo sapiens
ccagtcaacaccagaagagatcatacctacagttaaaatttgccgctgtctctaaggggaagagaaatagtcacatagaaagtattaccaagaaggattaaatatatcagctgtccaaacactttaccgaccacat

SEQ ID NO: 642482 - DNA, 743 bp, Homo sapiens
ccagcgcgtgcgcccacgcgtcggcagtgaggggctgccagaagcccctcaccctgagatgggagccatctttcccaatccaccgttgcccatcgatgggcatgttgttggcctggctgtcctactcgaagttgtggtcatcgtggagctgtggtcgctgctgtgatgtgtaggaggaagagctcaggtggataaggagggagctactctcgaggctgcgtgcagcggacagtggcccagggctctgatgtgtctctcaacagcttgaagaagccgtgagacgagcgtgtgctatgtgagggactgagatgctaggatttcttcacgcctccccttttgtgacttcaaggagcctctggcatctcttgtctgcaaaggcggcctgaatgtgtctgcgttcctgttagtctaatgtgaggaggtggagagacaagtccagaacttgtgttcactgtgaccctcgtgttcccatgctgatctgtgtttcctccccagtcatctttcttgttccagagaggtggggctggatgtctccatctctggctcaactttatgtgcactgaagctgcaacttcttacattgcctgctgaaaataaagaatctgaatatcaatttgttgttctcaaatatttgctatgagaggtgtgatggattaactttaatgaggtcaattcctgggaattgagagagcaaataagaacctgagaaccttcaaaaaaaaaaaagttaaacagacaaaggg

SEQ ID NO: 642483 - DNA, 296 bp, Homo sapiens
  misc_feature (53)..(53): n is a, c, g, or t
cttgatggggggttttttacccccctccccccccccctttaaaaattaaggangggatttttggcatcagggcaccctttgcataatcaccccttggaaaaagggggggtttttcaacccccctgccccaggccctacccagaaaataaaacccccttgggtcctccccagaaatttattttttggaaatttatttattgttaagggaaaaaagggtttatttattttttgggggcccaagggtccccctgggcccaaccccccatggggggggcccaaaaaagccttttcttcca

SEQ ID NO: 642484 - DNA, 933 bp, Homo sapiens
ctatggctgcgccactgcagaccagcgcgttgtgggctcccggcgggttcccccggggggtgggctgcgtctacgccgttgtctccggctttcctgctccgctttgggtctggctccgacctcccccctgcgtccctcgtccgctgtcggtcatttaggataatctgtacacactcatgtgacagatgaggacatcgtcggctatctgctgacgtcagaggcggctgctaggcccttctgccgtcttactggtgactgggatctttttgttctgtagtcctgcagttggaagctacacttagctccaactgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgcctttttgggatcaaaggtcaagacaatctgatcaaagccatcttgtcagtcaccacagagtaccggctgacccttgccttggaaaagcctccgttgccggcgatgcatcatcgtggggctggaggcgttcttgcccaacaaagtctctgggggtcccgaattgacgactattgacctttgtgggtgagaactgcattcggcaccagttgaaagggcttgagaagggacgttgggccgcaaaacgacacttggcatcaacctaccccgagggcccaatggcgcgggctgacaggtacgagcgcgaatcctcttggccccggccggttcattggcagacttaagtgctgaca

SEQ ID NO: 642485 - DNA, 95 bp, Homo sapiens
ggatttgctggtgcagtacaactaggcttaatagagagggaagtttctgggctgccccactaagtagaataaagaaaaacggttacaaaaaaaaa

SEQ ID NO: 642486 - DNA, 517 bp, Homo sapiens
aatattgatccaggtctccaaatatgtctcttctagcttatatcaataggtttctaaaaccagtttttcatctccactgtgtcagttagctttcttcccagctaaagaaaatattgaccaaagcaagttgcaaaacaggtgaaactggttgtagtaaaagagttactttttgctgggaagataaaagagatgtaactactgtccttgacatgagtatattgctaagctttgtggacaaacattctgagattggtaaaatacttactgcttcaggaaaattacacttatttcctcatctatgattttgcattctcctagttaatcttcttttgggggacagtgagcctcctttgaaggacttacgggcattaataataatatcactgtacaaaaattaataatatgtattgctcttttaaagatacttttgtacaagatattttaataaaacaatcttattcagtgctgcttattgtggttggtgaaaaataaataaataaaaactatcttataactg

SEQ ID NO: 642487 - DNA, 861 bp, Homo sapiens
tgtagtggctgatgcctgtaatctcaacactttgggaggctgaggcaggaggattacttgagaccaggattggagaccagcctgggtaacataaagactcctgtatctactaaaaaaacaaaaaaccttagctgaagtccaaaccactgcttcagaatatgggcattttggacgaactcagtatacacaggggcaaaaccggatcgctgaaagagctgccccaaatttacttgggttgtacgctagaactgaacgtttggcacagtacgaaggatacagaaagggcctaatctcagacaacgggcttatttacaaagtttgtccaaaaaaaaggcagtctgcaagctgaggaactatccacaacctggcgagagccgggaggcgctgggcccaggcatgctgcatgacacaggcagtccttcagccccgaggaggcactggagaagctcaagtgtctctgacgcaaaggaaacggcagtctgtcacatgcattttcacgacaggatcttggcccggctgtggtgggtcacgccttgtaatcccaaaacctttccggagaacttgagcgcaagtggatcacttaagttccaggagttttggaaaaccagtcttgtgccacatggcaaaaaccaacttccactggaaactacaggaaattacccaaggtgttgttggcacgcaccctgttagatcccttgctaattcaagaaactctgagttggcaaacgactcggttgtgaccccaagagggcagaatgcggccagtgcagtctgaagaactggccccacttacacttacagttctgggtaaccaaaatgtagaccccgttcccaacactttattccacaccacacattcca

SEQ ID NO: 642488 - DNA, 496 bp, Homo sapiens
actggccaacatggtgaaatcccgtctctactaaaaatacaaaaattagctgggcgtggtggcgcatgcctataataccagctgcgtgagaggctgaggcatgagaatcgcttgaacccagggggcggaagttgcagtgagctgagatcacaccactgcactccagcctgggtaacagagtgagactccgtctcaaaaaaaataaggaagccggggacggtggctcacgcctgtaatcccagcactttgggaggccgaggagggcgatcacaaggttaggagatcaagaccatcctggctaacacggtgaaacgctgtctctactaaaaatacaaaaagttagctgggcatggtggtgggcacctgtagtcccagctacttgggaggctgaggcaggggaatggcatgaaccccgggggttgaagttgccatgaaccggaaatggccccattccatcccagcccgggtgacagagtgagactcctcaaaaaaaaaa

SEQ ID NO: 642489 - DNA, 313 bp, Homo sapiens
cgttggcttctaaatagaaaatgtcatggtgtcaccagtcgtcacgtcgcaccgcgtgtcaaacaattctcctacctcaacctcccaagtagctgggactgcaggcgtgtccaccatgcctggctaattttggtattttgggtagagacgggtttcaccatgctggcaaggttggtctggaactcctgacctcgtgatctgccaaagtgctgggattacaggcgtgagcaattgtgcccggctatgggtatgttatagggtacgaaggtacagcattatttgtggtagagatgggctcttgctatagtagccc

SEQ ID NO: 642490 - DNA, 464 bp, Homo sapiens
acaaccaattgcaataggatcagggcccctgcggttaatactccgcggcccgacggggacgacgacgacgacgacgactgacgacgacgacgacgacgacgacgacgacgacgacgacgacgacgacgacgacgacgacgacgacgacgacgacgacgacgacgacgacgacgacgacgacgacgactacgactacgactacgacgacgacgacgacgtccgagtgagtcatcagcggtcgtgcatcgtgcgtgctgctgctgcgtggtgtctgtgtttgtgtctgtcatgcatgattgattgatcatcggtcggtcggtcggcgagctcggtgtgtcgtccttcctatctagtactgactttatagattgtttgaatgactcggcttgctaggcaggcagcgcatggcatgactgctaggtagccaccgacgtgataagagtcattcgttgccgatgggtagc

SEQ ID NO: 642491 - DNA, 179 bp, Homo sapiens
aaagaacaccctcagccatctcttaaatgcttctccaatgtgtaataaaatgtcctggtgagcaggctctggttgaacgtcagactgcctttggattactgagccactatctttagttcctataatgccgtattagtgaggcaagttagatgtatagtgagttaagatgtgagatacag

SEQ ID NO: 642492 - DNA, 159 bp, Homo sapiens
gccccccttaggggggcccccctttggggcaaattttgggcccttccttatttgggtcaaattttttttttgttagatgaaaccccttttttccaaaaaatttttaatgtcccttttggcctttttttaataaaggatgttttactgttgggctcccca

SEQ ID NO: 642493 - DNA, 142 bp, Homo sapiens
caaaagataaatagtccttctcatccctttcatggatgaaaggaaaaatggtataatttatcctattagtaaaaaatatttgaatcacttgcatttcttctcatgtatctcaaatcccatcttcattctaccttgctgcttc

SEQ ID NO: 642494 - DNA, 617 bp, Homo sapiens
  misc_feature (7)..(7): n is a, c, g, or t
  misc_feature (112)..(112): n is a, c, g, or t
  misc_feature (141)..(141): n is a, c, g, or t
  misc_feature (143)..(143): n is a, c, g, or t
  misc_feature (215)..(215): n is a, c, g, or t
  misc_feature (217)..(217): n is a, c, g, or t
  misc_feature (222)..(222): n is a, c, g, or t
  misc_feature (231)..(231): n is a, c, g, or t
  misc_feature (292)..(292): n is a, c, g, or t
  misc_feature (332)..(332): n is a, c, g, or t
  misc_feature (342)..(343): n is a, c, g, or t
  misc_feature (393)..(395): n is a, c, g, or t
  misc_feature (397)..(397): n is a, c, g, or t
  misc_feature (399)..(400): n is a, c, g, or t
  misc_feature (402)..(402): n is a, c, g, or t
  misc_feature (426)..(426): n is a, c, g, or t
  misc_feature (485)..(485): n is a, c, g, or t
  misc_feature (503)..(503): n is a, c, g, or t
  misc_feature (514)..(514): n is a, c, g, or t
  misc_feature (567)..(567): n is a, c, g, or t
  misc_feature (606)..(606): n is a, c, g, or t
  misc_feature (614)..(614): n is a, c, g, or t
acactanaaaatattctgagaggttcagggcttcttcttctgtcaatcaatggatactgaaaattcacgagactttctaccaatgttagttgtttcttggctttttttttcntttttaagaaaataggaaagacttataanangtaatccacatttctggtgggagaaacaattaagtgatctaaaaaaaaaaccaagtttttaaaaatgccttntnttcanaagcaaatnaaaccgtaagtttaacttgattaaaggaaaagcaaaatgtttaaatactagatatcttganaatctaagtttacagaagatgcttattcattttcaaaganaagaataagnntttccaatgacaatcttcctaatgttaaagtatttttattttctgttttnnntntnntnctaagctactcaggaacaaatctnctaagaaaaattaggttcacctacaggtttatagccaacttacctctttttgcttttgntgttaagttgtgcataanaagagaaaaanatttatgtttaactgattctaatgtcaatacataatggcttattccataaatncctactcagagttaaggacctcagaactagtcttttaanagatcctntgg

SEQ ID NO: 642495 - DNA, 415 bp, Homo sapiens
  misc_feature (134)..(134): n is a, c, g, or t
  misc_feature (137)..(137): n is a, c, g, or t
  misc_feature (146)..(146): n is a, c, g, or t
  misc_feature (171)..(171): n is a, c, g, or t
  misc_feature (203)..(203): n is a, c, g, or t
  misc_feature (224)..(224): n is a, c, g, or t
  misc_feature (244)..(244): n is a, c, g, or t
  misc_feature (251)..(251): n is a, c, g, or t
  misc_feature (377)..(377): n is a, c, g, or t
  misc_feature (407)..(407): n is a, c, g, or t
aatttacaagcctgtctacctgaaaaaagcatcaccctgggtgcaagagatataaaatcaaacctttatttatttattttttatttttaaaatttcaacttttattttagatatagggggtacatgtgcaggtntgntacctgagnatattttgtgctgcgacgtcatctnccagatagtgagcatagtacccaataggtagnttttcagtccatcctcccttncacttctagtagtcctccgngtctatnggtcctatctctatgtctgtgggtgctcgatgtgtagctcccacttatacgtgacagcatgcacaaacctctatttaaagtatgaataccatgaaaatattcttttacttggcacttggatattanatcacttcggcgactagctctgttaagtantacattga

SEQ ID NO: 642496 - DNA, 564 bp, Homo sapiens
gggtctcattgaactcgcctgcagctcttggagtttttttgtggcttaccttcaggtatatatggagccaggcctacaccccagcaaccatgtccaagggacctgaagtgggtattgatcttggaaccacctactcttgtgtgggtgttttccagtcacggaaaagatcgagtataagtagccaatgatcagggaaaccgaaccactccatagcgtatgtcgccttttacgtaacactgaacggttgatcggcggatgccgctaagaatcatgttgcaatgaaccccagccaacactagtttttgatgccaatacgtctgattggacgcagattggatgatgctgtagtccagtctgatatgaaacatcggccctttatggtggtgaactgatgctggcaggcccaaggtccaagtagaatacaagggagagaccaaaagcttctatccagaggaggtgtcttctatggttctgacaaagatgatggaaattgcaagaagcctaccttggggaaggactgttatccaatgctgtggtcacagtgccagcttactttaatgactc

SEQ ID NO: 642497 - DNA, 111 bp, Homo sapiens
gctgttaattgtcagtcctaatcagtcagagcacaaacaaaacaaagtttgtctttataatttgaggtggaaggtccggcacgtcaggctatattgtcaacatcatctcat

SEQ ID NO: 642498 - DNA, 91 bp, Homo sapiens
aagaaggtggggaggaagaggaggaggaagaagaatgtgatggtgaggaactaggatggatgatgaagatgaggaagctgagtccgctacg

SEQ ID NO: 642499 - DNA, 112 bp, Homo sapiens
gatagactcgagctggtaccatgttggcgtagatgacaggatcaggccggtcacgctggcgcacggtgtatcctgacaccgcctagccttggtgactgacgcccatgtctac

SEQ ID NO: 642500 - DNA, 103 bp, Homo sapiens
ttaccctgaggcgatgtcgcgctgaactacatcgacatccgttcgctgcagcgtcgtctggagattgcgcgctcgaacgtggctctgcatcaggaaacgctgg

SEQ ID NO: 642501 - DNA, 826 bp, Homo sapiens
ggctaggtcgaggctggtgttaattggccgaggggaaagggactccgtgcatcccagagctggacgcctataggcctgtgggactggctctggattatgaggacgtgagtgagctgacggccagtcagagggaggcagcagagcgggccatgcggcagcgtgacctgggaggctggccggggcctgggccgcatgcgccgtgggctcctgtatgacagtcgatgaggaggacgatggagcagccctgcccgcatatgcgccagcctaggtggagcgggccactggaggacggcgaggaggacgatggagatgattgagagcatcgagaacctggaggatctcaagaggccactctgtgcgcgagtggtgtgagcattggcgggcccccggctggatgatccacctacctgcttcaagaacttcctgcgcactcacgtcgacaagtcactggccacaacgtcttcaaggagcgcatcagcgacatgtgcaaagatgaaccgtgagagcctggtggtgaactatgaggacttggcagccagggagcactgtgctggcctacttcctgccttgaggcaccggcggagctgctgcgagatctttgatgaggcttgccctggaggtggtactggccatgtaccccagtacgaccgatcacaaccacatcatgttcgctctccacctgctctggtggaggagctggctcgctgagcagtgcatctgaccagtgatcgacagtgggtgtgccgttgcttgggtctcccagttagttggcgttactggacgggggtcgccgggctttgggccaacacggggactttcttcaggc

SEQ ID NO: 642502 - DNA, 385 bp, Homo sapiens
  misc_feature (44)..(44): n is a, c, g, or t
gtaactttaaaatatcctaaaccaaaatatctatttccattttncttcttaagtaaaataacaacacctcattagtgtgtagaagctattctaatccattaaaattttatttttatatttatttaaatatctactgtacatgacaaaatatatttctgtggctgccttttataattattttccaagtagacataatctatttaaaacatatttttctagtgacaaagaaatacattttatcctgatatatagtttttaaatactaggctatttcttttcatactgcctgattggtttaataaacatgatgtgacaaatattaagtatatatcattttatcatgttgtaactgatccaaaataataaaagaaataattataccttt

SEQ ID NO: 642503 - DNA, 323 bp, Homo sapiens
ctgcggtcgctctacaggatcccgtcgggagctgtatatataggtgaatatgctacaatgaacacagactggaccagttctattccactctttactaaatggaacgatattagttcgattccatctttttctgtttttggttgcttagtttgtgagacagtctctactcttgtcgcccatgctggtgcgcagtggtacgatctctgctcattcgcaagcctctgcacttcccacggttcaatgtgattctcattcctcagcctccgtgggatggattacaggctgtaccacctacgcgctgagtattctcttttcttcttctt

SEQ ID NO: 642504 - DNA, 392 bp, Homo sapiens
cggcctttacacgctgtatgttcccctgcgagcaccctccttttggcctttggccaagtcccccccatttgtgggtaacaagggggggttggtgttcttttcacccttgctaaactgtttgaatcaaggatcccaaactacagcctgcaggccaaatccagcgcccagcctgtgtttgtaaataaagttttattggaacaaagcccccccccttaattgaagatgatttggggctactttccccccccaacagagtcccatggttttgacagagactaggagacccagtttaaatgacttttgacctggccctttactgaaaatcctgccaatcattttgttggcaagaatgatgttttccttttagcaataagaaacaagtaacctttgca

SEQ ID NO: 642505 - DNA, 1153 bp, Homo sapiens
  misc_feature (891)..(891): n is a, c, g, or t
gggtgttcctctcagccccatttctgagaacaggtgaatggcagaacaagccctggacttggacccacgaccaagctctcatgctgttgcgcccttagtagcctctgctgcccatcagttcctgtcctgctcttggcaaattccagaccctttcataaatggccgaagccctaagcctctcctcactctgcactcccaaaaacagaactaatttacaggatgcttctctttcgggtggtggtggttgtcagttacaggaatttagaagaatcattgctccgtaccgaaaagtgacacataaacacacataacgaatgcggggaggcgccactttaagacaattctcctcgtaggagggggtcgccaagagtctcttcatagcgttacctcccgggcttttcttcttaggccacaaggagcggacgccgcatatatagagcggggaggtgtagcttctatctacacccaatagttcgtgggctcgagtggccacgctagtctcacatcgtcccgtccgcaaggattggggtacaaccactctgtgccttcgacagcatgtaggagacacccttggggtgccaaaaagctgggatggcacctgtgatcaattccagtccgcggtgggcggtggtgagccatacatattaagttgtcggcgccaatacgaatcgatacctcggccattggacgatagggcaatctctgatggagcagtgggttcgcccctataacggggcccataacactttccccaaagagaccttatcggcgacaagtgtgttgccatatctgaatgcgcggcgttgttttagcaaacccctgtgtggtgggcgcgggggccataactatctatggcgcgatgtgacggccagtgtcaacttaggcaggcanacaagggctctttgtcgagggaggtcatattacccccggacggagaatgacacgatggagacaggtcacattctctgcgttaagcacaacaataccttgcctttgtatcctacttccaacggggtgtaaagtcccctagcttggtatataccacactacaggcagcatcccccccgttccacagaagaccacgtatgaggaaggtgtacagtaaagatggttgtagtgggtgaaaacaccagcacagtaaacccaccagttt

SEQ ID NO: 642506 - DNA, 636 bp, Homo sapiens
cttcatactgcgggcagaatccctcatcacccagctaaaagtattaaacacatactaccacctacctccctctcctttgcccatataaataaaaaattataacaaaccctgagaaccaaattgaaagaaaatctgttcgcttcattcattgtccccacatttttttgccttggggccgctgcgctgatcattctatttccccctctatctgatccccacctcccactatctcatcaacttccgactttttaccacccaacaatgcctaattaaacgttcttcaggactcctggtggttttgcacatcattaaaggacgatttctgttttttattctagtttctttatttattcttttttgccacatttaaccctgtcgcccgcccgcgtgactcactacccgggccacccactatctgtatgccttgccttgcttctccccttttgatcgtcctctgtctttttacccctctcctcttcggttactctttctttcaccccttttttttcctcggtcccactctacctctaatattacactagctcttccccctaccctctatttattactttaatactattctttcccttcccttattttttacactattccatcctactcaacagaaacaaaaaa

SEQ ID NO: 642507 - DNA, 329 bp, Homo sapiens
  misc_feature (266)..(266): n is a, c, g, or t
gagagggagtctcactctgccacccaggctggagtgcagtggcacgatctcagctcactgcaagctccacctcccgggttcacgccattcgcctgcctcagcctcccaagtagctgggactataggcgcccgccaccacgtctggctaattttttgtatttttagtagagacagggtttcaccatgttagccaggatggtctcgatctcctgacctcgtgatctgcccgcctcagcctcccaaagtgctgggattacaggcgtgancacccgcacctgggccagtcttctaattatttagtgaattcagtacggttgacatgggggctg

SEQ ID NO: 642508 - DNA, 454 bp, Homo sapiens
agaaaaggggatgggagaaggtggagaggtacgaaggggccagatgacataggccattatttccattcagtggggaaactaaggcccagaaatggggtgaggggtgcctcaaatgtcagagctggaattcaaattcaggcttggtatcttgatatgagatgttcctgggcggggtgtgggggctcacgcctgtaatcccagcactttgggaggccgacatgggaggatcacttgaggccaggagttcaagaccagcctggccaatatggtgaaactgactatactaaaaatacaaaaactagctgggcgtggtggtgcttgcctgtaatcctacctatttgggaggctgagtcatgagaatcgcttgaatccgggaggcagagtttgcagtgagccacgattgcgccactgcactccagcctgggtgacacagatttagtttccaaaaaaaaaa

SEQ ID NO: 642509 - DNA, 837 bp, Homo sapiens
aactgctgtgcgccccctcaggagtaccgcttggagatcctagaggtggatgtgtacccgggtctggccctcagtgcaggacaggttcatgctcactgataaggggtcccaagcagaggtgaagatccaattaaatgtacgaacgctgggccactgtaatgctgtatgctgtgctgcgccgagtatgatccatggagctccgtctgatggtgctgtgtctcgtgctgccgcaggaatgcgaagctactagctgtcatgtgcgacccagttgctcggataccactccggtagcctgcactcatttgggtgctcctagtttgcatcggagccgtgtctggtggcactgtcggggtcacagcgccagtggtgagaagtaacggaggccgttgcgtgggtgtgggagcctcttcgtctagcgcccgtctgcgctgccgtcattgtcgtcctggaggttgctcaggaggtgcgtaatcgcctgtgcgcccctggtaccgatgctggcgcccttcctcgaagcgaagcagagtgttgactgggcagtgggccagtgcctctgccaaggtccgaagggacggaggatgaagctggcgggagcgttgcctaggcagcgtgctaggagagtgctgccaaagttagcacgcgcttatgatacggagtactttgcacaggcctgaagcacggggctgctgctgggcgcagccgacatcagctcccttagaccagaagctgcgtctgggcacttcctgtttccaccagcttatcttggcgtctccaagtctacgacgacgagctgggcgattgtgcccgcccaggcctgctcaaccgtgggccctttcg

SEQ ID NO: 642510 - DNA, 735 bp, Homo sapiens
caaagcaggagaaagcctggaaatcccagtcagacaagtcggacggctggctgataaggatcgaggggaagaagatgctgatggcagcgaaacccaggagctattccgcaggggttgcgctccattcctgaataaactgacatcgctccagagtgttccatgcagtctgatgagacgctaacgtgagcgcagctggcgcatcgacaccgaggaacgcctcaaaggggctcattgacctcattttcgacaaggccatttgatgagcccaatattctctgatggcctatgccaacatgtgccgctgcctcatggcgctgaaagtgcccactacggaaaagccaacagtgactgtgaacttccgagaagctgttgttgaatcgatgtcagaaggagtttgagaaagacaaagatgatgattgaggttttggagaagaagcaaaaagagatggatgaagctgctacggcagaggaacgaggacgcctgaaggaagagctggaagaggctcgggacatagcccggcggcgctctttagggaatatcgaagtttatgggagagttgttcaaactgaagatgttaacagaggcaataatgcatgagtgtgtggtcaaacgtgcttaagaaccatgatgaaaggtcccctttgaagtgccttttgtcgtctgtcaccacattgggaaagaactggaatttgaaaaagccaaggcccgaatggatcagtattccaacaggatgg

SEQ ID NO: 642511 - DNA, 106 bp, Homo sapiens
cccagggctgtttctgggtgctccctggccccagggtggcgtttggttaccatggctgtgtgtgtccatgtatgcaaccagtttttcaataaatggcctgcctccc

SEQ ID NO: 642512 - DNA, 252 bp, Homo sapiens
aatctgtcatgtcgtgtgagtagtgcgtcatgtcactcaggcctcctggctgatagcagcatgtctgctgcaaatcacgcacatggtttgtcattgcctgtccagtcaggtgatgcctctatgtttggggaggccacctctgttgtttcttaaccttcccagcctacccacagtagtcccctgtattgctcatagcattcctccatctttaagccccaggtccatgctccgagtccgggagtacactgcttg

SEQ ID NO: 642513 - DNA, 866 bp, Homo sapiens
gttttcctccctgtcgccaccgaggtcgcacgcgtgagattctccgccgagacgccgccggatgggtagtcgctcctacctgtgggtgccctaggggacaatcctcccccagcgccaaggtacatcaagaagatcttggacgagcgtgagttatcgaggcggacaacgaccgatttcaacaaggttatcaggtgcagctgcatggaaaaaaacgatgtgagggcacttcattggcccaggctatgtggccaagctggccgaaggtgtcccatgctggtggggcttgcagcggttctgtcttgccctaggctgctgagcccactgcttgctgtgttcatgccccttgcttgcacaaagagggagaagtagacgttgaggacgagggaagagagcctgacagagtccggagtgacatgaagcaggggattttgcccctttttggattaaattccctgtgctcgttgtaaagtaaatgccttttacacatccgagaagaaatatttgacacgcatgatagacacatcaattgtgttagggagcctgcccgcctgagaacattttttaaaacaattggttggaggcggggcgccctatgggttatgacaacagtttaagagtcaggtcaaggaagaacactcggcgataagctagcatgtgggtgtttcgcccaaataaaatagcgcggagagaaacagcgcggatttaaccatgccagagggggttggagcgacatagggctattgaagggggccacggaatcgttatcggcgcagttgtagaatataacacagttaaacacgtattgtggctattatcttagagacattatcggtttaccgtattgaagacaatttaaaaagagagtg

SEQ ID NO: 642514 - DNA, 223 bp, Homo sapiens
  misc_feature (59)..(59): n is a, c, g, or t
gatttgtgtgttgttgttgaatatttaggatggatttgaattttgattttatattagtntttttaaaaattttttgaattgttgtgttttttatgtaaaaaaagagatgtataaattaataataattatatttttagaaattgtattattaaagatttttagttaaagtagtattatgtaaaggtttaaaatattattttaataaagtaaagtttttaatata

SEQ ID NO: 642515 - DNA, 787 bp, Homo sapiens
agaggaagttagtcaggctgatggcatcttcaaagctgaactgagatgagttgcttagctcgggagctggctgaagatggcatactctggagtttgaggtgcggagttacaccaaccaggacaccgaaatcattatcttagccaccgagtaacacagagtgtactatggtgagaagggccggcggtattcgggaactgcactgctggtcacgtctcaggaacgaggtttggcttgccagaggggcaatgtgtagagcttgatgcttgacatacatggttggcctactagaggtcttgtgtgccattgcccagtgcggcagtctctgcgtttacaacactcctaggagggctctgctgtgcggggggcctgctatggtgtgctgcggtctcatcatggccgcagtggggccgaaggctgcggacggtctgtgcgctgtctggggaaactccggagcggacatgagggctaggtccatgaagttgtggatggcctggtggatccacagcgggagaccctgttagctactacgtatgacactcgctgtgcggtccacgtgttgctcagacagggtgtgctggtgcatcagggtgaacgatcatgctggcctgtggactccaaattggtagggatatgccctaagaagccctgcctgacatgtgagctttgtggaaccataagatgagatagtgccaacacccccatctctagaacagaagggtgggaagcagagcggttgcatgcccagcagtcccagagcttaccgggctcccttggcagtgatcaggg

SEQ ID NO: 642516 - DNA, 265 bp, Homo sapiens
gcagaggtgttctttgatggagtacgggtgccatcggagaacgtgctggggaggttgggagtggcttcaaggatgccatgcacatcctcaacaatggaaggttcaggcatggatgcagccttgtcaggtaccatgagaggcatcattgctaaggcacgtgagtacacctgcccgagtccctaggaaacccaaacagaattcttactgtcctacatgccatgtgtccactgagcacttgcagggactccctacactataatctcct

SEQ ID NO: 642517 - DNA, 183 bp, Homo sapiens
atagtctcgggaacacacgcacatcatagtagtcgtactcagtggcacggtctagcatgttgagccggccgcgctgtgcccccaggccgtggcgcagcataggaggaggctcggatctaggttagtcctcaatcacggtgatgactccatacccaaatgggagggacacttagactttactcc

SEQ ID NO: 642518 - DNA, 344 bp, Homo sapiens
  misc_feature (219)..(219): n is a, c, g, or t
tgactttggcgatttttaacaaaatttttaaagacccagtgagagtctgtagtgattattacacggataatgttttaaatgtctaggttctgtatttttttcttaaatagcaagaaaatacagattgctagtatagtcaacagtatttggctatcaataaagaatctctttaagatctcacccggctgggcattctgtaacagaggggattacctgggngttttaagtatttaatgtcctcatagtgtgggaaatcccctaaattgattaggaaattgtattttatggaaaaataacttgtattccattcttgtgtatttattaccaatatataaatatgggcc

SEQ ID NO: 642519 - DNA, 111 bp, Homo sapiens
gagcggtgtggggccgcgtgcgaagccgcctccgcgccttccccgagcggctggccgcctgcggggctgaggccgcggcgtaagacaggtgcgtgcaggcctccacggccc

SEQ ID NO: 642520 - DNA, 414 bp, Homo sapiens
gctcggcaccctgaaaattatgttgacggggttagggggcgtctataacattcgccccgcttctcaggaacagccactcgctgggtgagacggcaaaagccaagcccttgtggcaaggccggagtcgaaagcttgtaagtctgcgctagcggatggataagcgcccgtagctcagctggatagagcatccgccttctaagcggatggtcgcaggttcgagtcctgccgggtgcgccatttggcggtcaggcaatttgagtaagcaatgcaatatggtgggcgtagctcagttggtagagcacaggattgtggctcctggtgtcgtgggttcgattcccatcgtccaccccatattccaaagcgccaggcccaaagcctggcgtttttgttttaagcttcaaaccacgcggacgt

SEQ ID NO: 642521 - DNA, 97 bp, Homo sapiens
ttatttgggttcagttataacatagcataataaatacaagttcaaatttatgtagactgtataagattataataaaacatgtctgaagtcaaaaaaa

SEQ ID NO: 642522 - DNA, 713 bp, Homo sapiens
tgaaagcttgcctctcaggaaaatgcacacataccaaactttgaggaatgatgcccttgaggcgtgtgcttcaagtgatcctatgatacaatgaaggcccgctttcccgagacatcgcaagaaacctaaagttttactgcatacatgcaattctttgtagctaaacaggtcatcgcgacgtattcttccacagaaggcctggggcagatggcaaataggaggacgaatgaacaacgctcggagcccaacaaggaggcacaacagcatcaacaagcagtcaccccatgaggttatcacgcaggccacaattaaatcccagtggcgcataacgaaggccaactcacaccggacgcactacgaccgtggggcggacaataccaatgaagcaaaacacatataggccatagaaccgtaacaaatccacccgcaggggacattaacacatattatcacagagttaggggactaataatcgtgctatatcctacgagtatcaacggcaagagaaaacacgaggagggagtattccaatcatcccaacctgcctgggattagtcataataaatcgacaacctcactgccggaacatctacaggcctcaattagggggaaagatacaattcggcatgttggatagccgctccttaattgatgatatgaaacgttcacaccaaaccgacacggtgagaccatgttcgggcgtgtcagccagt

SEQ ID NO: 642523 - DNA, 98 bp, Homo sapiens
  misc_feature (67)..(67): n is a, c, g, or t
taagtggtgtacgtggcgtaaggtcttgtgtgaaaaataattttctcataactcactgtcatgctangataataaaataatattgagtaagccaataa

SEQ ID NO: 642524 - DNA, 201 bp, Homo sapiens
tatatatatataatatttacatgatacatctaaagtatactatctcacttaaaggccataggatcaagtatattatctgctatcaaggtcatccgttatgtcctgacacgtcttcaagcagaagaagagcaaaaacagcagcctcagctgctgaagtgacatgaagagagcctctggatgcatgtccatctcgtctcttct

SEQ ID NO: 642525 - DNA, 485 bp, Homo sapiens
atatcagcagtcattgatgtcctgagtgtagccgtcaagaaacgtgtcatgtgtaacctagggatgaaaacctgacagcaaatgaagtttagacaccgtgtgataggacagcaaatgtagcaatcctgtatcctgggggcatcgattccatggttatcgcaccccttactgaccgtcatatacctttacatgcacccaattgcatcttcttactgtagctttcatcagctgaagcaaaagcaccatgccacctcacctttaacagagaagggcaatccacagaacacatacatgtgcaacatcaccttcagcaagcacatctctcaacagcatgttgctgctgctgctgctgcccagtcctccatccaccatgtcagggtcaccagatcgaatcaccaggcaagggcgggcataaaggacactacaagctgttcagcccttcccgaatttggacattttgttgcaaattaatgtttctcatggaa

SEQ ID NO: 642526 - DNA, 448 bp, Homo sapiens
cgctgtgtctcattgtgtattccactatagtgagacatgcggtgttggttttgccttgtgatagtttactggaatgatgatttccaatttcatccatgtcctacaaaggacatgaactcatcccttttttatggctgcatagtattccatggcgtatatgtgccacattttcttaatccagtctatcattgttgggcatttgggttggtccaagtctgtgctattgtgaatagtggcgcaataaacatacgtgtgcatgtgtctttatagcagcatgatttatagtcgtttgggtatatacccagtaatgggatggctgggtcaaatggtatttctagttctagatccctgaggaatcgccacactgacttccacaatggttgaactagtttacagtcccacctacagtgtaaaagtgttcctatttctccacatgcatgcacccagg

SEQ ID NO: 642527 - DNA, 401 bp, Homo sapiens
cgggttcacgccattctcctgcctcagactcccaagtagctgtgactacaggcgcccgccactacgcccgggtaatattttgtatttttagtagagacggggtttcaccggtttaaccgggatggtctcgatctcctgacctcgtgatccgcccgcctcggcctcccaaagtgcgccttttctttttttaattggcacttaaccctggctccttcttgcgataaaacatattcattcatgtggtagtgagaaattggggaaaggaaatcccatacatctgtcaagagatacattttcaataatatttttatttttctatttgagatctatttataaaagtgtgtttcatatttttttttttgtgggggccggggggggggcccacaattttctcttacatc

SEQ ID NO: 642528 - DNA, 772 bp, Homo sapiens
  misc_feature (86)..(86): n is a, c, g, or t
  misc_feature (98)..(98): n is a, c, g, or t
  misc_feature (125)..(125): n is a, c, g, or t
  misc_feature (145)..(146): n is a, c, g, or t
  misc_feature (178)..(178): n is a, c, g, or t
  misc_feature (215)..(215): n is a, c, g, or t
  misc_feature (223)..(223): n is a, c, g, or t
  misc_feature (230)..(230): n is a, c, g, or t
  misc_feature (260)..(260): n is a, c, g, or t
  misc_feature (263)..(263): n is a, c, g, or t
  misc_feature (270)..(270): n is a, c, g, or t
  misc_feature (277)..(277): n is a, c, g, or t
  misc_feature (286)..(286): n is a, c, g, or t
  misc_feature (307)..(308): n is a, c, g, or t
  misc_feature (314)..(315): n is a, c, g, or t
  misc_feature (325)..(325): n is a, c, g, or t
  misc_feature (327)..(327): n is a, c, g, or t
  misc_feature (333)..(333): n is a, c, g, or t
  misc_feature (349)..(349): n is a, c, g, or t
  misc_feature (375)..(375): n is a, c, g, or t
  misc_feature (382)..(382): n is a, c, g, or t
  misc_feature (411)..(411): n is a, c, g, or t
  misc_feature (414)..(414): n is a, c, g, or t
  misc_feature (440)..(440): n is a, c, g, or t
  misc_feature (447)..(447): n is a, c, g, or t
  misc_feature (465)..(465): n is a, c, g, or t
  misc_feature (469)..(469): n is a, c, g, or t
  misc_feature (474)..(474): n is a, c, g, or t
  misc_feature (479)..(479): n is a, c, g, or t
  misc_feature (486)..(486): n is a, c, g, or t
  misc_feature (498)..(498): n is a, c, g, or t
  misc_feature (506)..(506): n is a, c, g, or t
  misc_feature (511)..(511): n is a, c, g, or t
  misc_feature (513)..(513): n is a, c, g, or t
  misc_feature (520)..(520): n is a, c, g, or t
  misc_feature (528)..(528): n is a, c, g, or t
  misc_feature (537)..(537): n is a, c, g, or t
  misc_feature (548)..(548): n is a, c, g, or t
  misc_feature (566)..(566): n is a, c, g, or t
  misc_feature (573)..(573): n is a, c, g, or t
  misc_feature (575)..(576): n is a, c, g, or t
  misc_feature (587)..(587): n is a, c, g, or t
  misc_feature (597)..(597): n is a, c, g, or t
  misc_feature (613)..(613): n is a, c, g, or t
  misc_feature (625)..(625): n is a, c, g, or t
  misc_feature (667)..(667): n is a, c, g, or t
  misc_feature (673)..(673): n is a, c, g, or t
  misc_feature (680)..(680): n is a, c, g, or t
  misc_feature (686)..(686): n is a, c, g, or t
  misc_feature (710)..(710): n is a, c, g, or t
ggcggcacgcccgtgaggctttctcgtggggtggtaaccgctactcccggacaccagaccaccgccttccgtacacaggggcccgnatcccaccctcncggacctaagagcctgggtcccctgtntccggaggtccgcttcccgnnccccagattgtggcattccagccctcagtgtncaagacccaggcagcccgggtccccgcctcccggatncaggcgtncgggatntgcgccaccagaacctagcctcctgcaganctncgccatntgggggnactcaaccncatggagccaagggccccacnntccacnnagagaaactntngtattnccagctcccaaggaanccgggcgctccgaactcccagctttnggacatntggcacacggggcagagcagagaagcctnagngcccagcctggggaatttgaacactncagcttncaagagccaaggaacttnagtnctgtnaactnacaactntaaggagccctncaaagttncagtntncaggtgntgttactnaactcagtnctaggaacgtngggtcctgggaaggagcncaagcgntnncagctagcttncaggcgctangaaaccccggtgcttnccatcatggtgnccgatcctcctcgagactccaaggggctcgcagcggcggagncaccgncaacggnggcctngcgctggcctccatcgaggaccanggcgcggcacaggcggctactgcggttcccgggaccaggtgcgccgctgccttcgagcccac

SEQ ID NO: 642529 - DNA, 154 bp, Homo sapiens
  misc_feature (69)..(69): n is a, c, g, or t
  misc_feature (127)..(127): n is a, c, g, or t
  misc_feature (151)..(151): n is a, c, g, or t
aggtctagcaggcaccaacaggggcaacggcaggggaaaggggcactgagccacacgaaagccctacanggttccctggaatgaccaagcctgatcagcctacacctgttcactttcctgcgcccangatacacataacccttctggaccnggt

SEQ ID NO: 642530 - DNA, 224 bp, Homo sapiens
catcagcttcaatttgccgccgggcgagtcgctgtcacaggccaccgaagccatcagccaggcgatgaacaagctgggcgtgcccgtctcggtgcggggaagttttcagggaacggccagcgcttttcagcagtcgctttcctcccagcccatgctgatcggggcggccatcgtggccatctatctggtgctgggcatgttgtacgaaagcctgattcacccgg

SEQ ID NO: 642531 - DNA, 379 bp, Homo sapiens
ggaaacccaggcggactgctatctattactgtctccagaaaaaacctccagcttgttaaaggtataactttaaaaagcaacaacccgcaaacacgcatagaaacagacacacacatgcaagcacacttctaccctcagtctagacaatacttacctttgttcacttcttgcgtaatgattctgatcattcagtgcctctatttggtatctgtttggtcaaatgatactattgttgctgagtacaagggatagaacagttggattttgcccctttttgtttagtttgttcattgcatttattttgcaccaagctcttacatgacccagcagtaactagagagtgaaattgaataagatcatttggttttagtctaggcca

SEQ ID NO: 642532 - DNA, 1400 bp, Homo sapiens
gaccacgcgtccgatgagtttcatgatatctagaacggtcatatgaaggagaagaagatacaccaaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatgtatgtacttcaaaagaaaaacggtccttgaaacagcatcagtttttctctcagtttatttaaattttcagttaagtgttaggtacttagttctaagatcatttgtaactttctggattataagattattgacgcagttgtaatgaacactgttcttagacctgtgcagtaaattagatggtaattatatcagaactctgagataagaagtaaaaaaaaa

SEQ ID NO: 642533 - DNA, 1694 bp, Homo sapiens
  misc_feature (1535)..(1535): n is a, c, g, or t
  misc_feature (1630)..(1630): n is a, c, g, or t
  misc_feature (1645)..(1645): n is a, c, g, or t
  misc_feature (1668)..(1668): n is a, c, g, or t
gaccacgcgtccgatgagtttcatgatatctagaacggtcatatgaaggagaagaagatacaccaaatggggcttctactaggtggcgtcaagtcaacatatatgtttgatctgctgttggagacgagaaagcctgatcaggttttccaatcttataaacctggagaagtgatggtgaaagttcatgttgttgatctaaaggcagaatctgtagctgctcctataactgttcgtgcttacttaaatcagacagttacagaattcaaacaactgatttcaaaggccatccatttacctgctgaaacaatgagaatagtgctggaacgctgctacaatgatttgcgtcttctcagtgtctccagtaaaaccctgaaagctgaaggattttttagaagtaacaaggtgtttgttgaaagctccgagactttggattaccagatggcctttgcagactctcatttatggaaactcctggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgctcagatccctttggctaatggacttgactctcacagtatcacaagtagtagaagaacgaaagcaaatgaagggaaaaaagaaacatgggatacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccctttgttggagttttgtcctctcacttcaaggtctttcgagtgtatgccagcaatcaagagtttgagagcgtccggctgaatgagacactttcatcattttctgatgacaataagattacaattagactggggagagcacttaaaaaaggagaatacagagttaaagtataccagcttttggtcaatgaacaagagccatgcaagtttctgctagatgctgtgtttgctaaaggaatgactgtacggcaatcaaaagaggaattaattcctcagctcagggagcaatgtggttnagagctcagtattgacaggtttcgtctaaggaaaaaaacatggaagaatcctggcactgtctcaaggattatcatatatatgaaggaagatattnctatttccagcaacngggaaggtttccttgaagttctngatggggctacagaagatccacgtcc

SEQ ID NO: 642534 - DNA, 109 bp, Homo sapiens
tggcggctctggctccagaccagcacgttattcaggtgattcgcgtctggcgctcggcggcgggcgggcggactatcgtcggcagcaggtcggccccctcacggtacaa

SEQ ID NO: 642535 - DNA, 664 bp, Homo sapiens
ggagttaacgagtgcacacacacagcagacacaattatcaaaaaaggagtgtgcgtgtgtgtggaataacacccagccgctgtcaaactgcccataatctccaatggactttttaaaaccaacaaaagccgaaacggtggcccagaggctgctcctttgttatcccatgctttctaattcaagtcgaatgactgctttggtcacacttttttagtcacagtaaaaaatcacgggcgccctctggcatgcatgacatgctattaatcagaaaaggtaccactcccgtgttttttgtttctgaatatgtctgttcacggaccacaagggcatgggtcaccaatccgaagtggatgggactaaaccattgcgccttagaggccctcaattcaactacgaaccctttaacagcaacagcattaatatacgcttttggagctggaattaccgcgggtgctggcaccagacttgtcctccaattgttactcgattttggatgggttaaatatcccccattgaaaacgacaatgaaaagcactgcggctctaatcttttcgctgcctcattataatttgcattgggcaatttgccgcctttccctccgtaaagtgtactatactagctcctctcgaatgaacctaaccccgtccgtaggcatgagccatac

SEQ ID NO: 642536 - DNA, 220 bp, Homo sapiens
ataggacgggaataggtccgggaagactctctggcagctcagccgctgaggacgcagaaaatgggagggccgcggtgtggagcgcgtggcttcataggctaggtagcggcgccttgtgactcacgagtgtccatatgcgtccctagacatgcgcctggctgctttccctggtgccgcagattgtggcctgggctgtctggggaagaggcgctgtgtggac

SEQ ID NO: 642537 - DNA, 709 bp, Homo sapiens
gaagaatgtatttaacaaactgaagatccaggtaatatcgtatgctatgttattacattgaagaacaaattgacatcagtaggagtaggactaagtgatgctcaacctcagatggactgaggtttagtccctagtatgacaagagtagattcacagaaaataaatgggtccatcaactcacgctttcattataaatcagttcgttaatataacacctctagtagaaagcaagcactagttaaggtggcaggaaggcaatctactttcaaggcttttattaaagtttagaaatgatcaggggacttcataagattataaatttcagtctaaactgaaatgcgtttttaattctctgaataagtaacttccagtttacgatgaatgtaagtgatcagttgctctgaccaaagaacgatgccattgcatgtgattggactgacctcttactgtggagactagaaagtgctgaatattctttagtatattctctcatactaaggagttactatggaatgtgattgaaattgcaaattgaataattgaccaggatttggatctatacctcgctaaattagatacttcttgaatctagtgatagatgcagtgatgccagtgatgacagcttttcagtagcatagatagctgacttggcaataagatgacatgaatccatgactgggaataatggggactgactgtgatgccttgt

SEQ ID NO: 642538 - DNA, 278 bp, Homo sapiens
  misc_feature (31)..(31): n is a, c, g, or t
  misc_feature (37)..(37): n is a, c, g, or t
  misc_feature (55)..(55): n is a, c, g, or t
  misc_feature (90)..(90): n is a, c, g, or t
  misc_feature (131)..(131): n is a, c, g, or t
gtgattattgtatattacagtgaacactgtngattantgtattgacctgattganatattatccaagtgtgtctgagagatataaatttntggtaagttagagagtgaagacatctgtattagtttatttncacactgttataaagaactgcctgagactgggtaatttataggggagagaggtttaattgactcacagttctgcatggctggggaggcctcaggaaacttacaatcatggaagatggggaagtaaacacatccttcttcacaaggca

SEQ ID NO: 642539 - DNA, 183 bp, Homo sapiens
acattggatgcacgattttgagaagcagcaaggaggcaattgggtaaatacactaagatacaagaagactttgtctccgtgtattttaggcagcaggagctgtgaccagtggttagcagaggggccacgttgactcaggccgcagcccataggtcaggatagcaggctgcccgctgcctcatt

SEQ ID NO: 642540 - DNA, 166 bp, Homo sapiens
  misc_feature (16)..(17): n is a, c, g, or t
  misc_feature (47)..(47): n is a, c, g, or t
  misc_feature (160)..(160): n is a, c, g, or t
aactgaagaaaactannccttgaaagatgagtaagaattcaccaaanaaaaaaaataattgagacaatttttttttaaagtaaaatatttttataaaagcttttaatgctactttctgacctacaggtgatgaaagggagtatgccagcagatatagccncattac

SEQ ID NO: 642541 - DNA, 1016 bp, Homo sapiens
ggcccctacgtgcctgtcggctggcctggctggcccgatgatgttatctgggaacgaaggctggcagccgcggcggcagtgtgtctgcagctggcagcaaaccgggacggagtgctggccctgtggacagcatgtgctggctccagaagaacggagtctgacgtgtgtgcctgcagcaagacccctgctggtgaccatgtacgggcccatgccctgaggtccgggcctgtgtggagcaaggatggagaggaagaacaggcacaaccacctgtaaagacaacgatgcctcaccgagagagcacatctgaacccacacgagaggtggacacttggacagagacacacagcacggagagagatacacaggaaacggggcaccatcaagagaccagtgaccactagcattggtacagattgacacttgagaggtacttgacgaacctaccacaattgcgaacaaacatgggaaaatacggcaggaataaacatcacagagacggggagacagttacagggaacaccacagggcgaggtgaatggacaaaagggagagagagccagaaaagcgggattacggaaacgataacacatgacataagaattggtgaattaggcacaaagtgccgttattggtagcaaaagagctttcctttcaaggaaacgacacttgaagggatagttaaaaattatacaagagaaaagaacgagtgaagcaccgaaaaacgttgggcacacaaatatagcacaagagaagcacaaacaggcgaaatacacaaacggcaaaagagtgtttactcagcccccacagaaccaacaagaagactcatccagattcgaacaaaggcaacaaacccaaaaaatcaagtaggaaagtggacaactatcaacaagatgaattagggacaaaaaatatgttagagtcacagattagaacaagtaacgacgcggcacagctaccgaggtagagcaacctaataaagaccaaaagaggacatagcgatcacaactataccaga

SEQ ID NO: 642542 - DNA, 107 bp, Homo sapiens
agtgcggtccatcagctccacatgcgagaggatcacaccagtcacctctggaccctgagagctgaacgagggcatcataggccagacaggcccaaggatggatgaat

SEQ ID NO: 642543 - DNA, 173 bp, Homo sapiens
  misc_feature (9)..(9): n is a, c, g, or t
  misc_feature (97)..(97): n is a, c, g, or t
  misc_feature (131)..(131): n is a, c, g, or t
  misc_feature (133)..(133): n is a, c, g, or t
gggtttcanggactggggggaggggataaatggggagatgttggtcaagggtacaaagtttcagttaaacaggagtagtacgttctggagacctgtngtgcagcagggtgactagttaatgtatacttgananttgctaggagtagatctcaccaggggaaatgaatatgtga

SEQ ID NO: 642544 - DNA, 109 bp, Homo sapiens
ctggatgttgtaagctattacaggaatgagtactcccaatattccctgcactgctagaagcctttagggcagggcccttctcgcttgccacctccctatactgcttgga

SEQ ID NO: 642545 - DNA, 305 bp, Homo sapiens
ccttcaaagatctttgagcatcacctaagaaaaatctgtatatcatttaattgaatagtataaaatatttaaaaataattacatggataaaattaatgttaacgcaacaggatgagtcatttttctttttttttggaggcagggtcttgctcctgtcacccagagctggatgtggcacaacacagtggctcagtggctcacagcttcacggcttcaccggcggcagcatttgacctttccaagcctcaagttgatccttcccacgcttcaggctcccgagttagctagagactataggccatgaa

SEQ ID NO: 642546 - DNA, 176 bp, Homo sapiens
agcgcggcggctataaatagaatcggtagaaaaatctgcattcacactaacaagaatttgaaatttggtggttggctgtagagatctggcttatttctgaaggctaatgactgtcagataccatctatatttgaggaaaataataggaattattgattgagcagcagggaaagaca

SEQ ID NO: 642547 - DNA, 200 bp, Homo sapiens
gtggcacacagcgatttccacaggcattgggtgaagaaaaacatgccccagagtcctgcgttgtgtgaacactggctgtttcgacctccgtcgctgcatcacaagtgtgcggagcgaggaccttttgcacaaggactgcgagttcctgatcctagagaaagacaacacacctgccagcaaggagatggagctgctcatca

SEQ ID NO: 642548 - DNA, 654 bp, Homo sapiens
ataagttggaggtctggcaagcgggttccagtcacagtgtctgaacagcaagcaaccgggggtatgggtccggcccccagtgcctgactataagtcacatcacacttcagcatatgcatgaccgactgtctcaacttctcctccttgtatggatccttgaccctgttcccttcaagatcacacacataggtctccactgcgaaccagtcataggcctctggctctttcttcagcaagttctccagctcctgcaggttctggtatgagtagtcagtgacgacgatctccgtaaagtattcacaagcagagaggagctgatagatagtggggccagagccgatgttcataaggtgcttaagaatctggctttctgcagagtgcctagagccaatcttgtaatactcttctaggtaatcgcgagggttaaaatggcttagataggtgtccttggaggtgaagcctgactccattatgtctcacttctgtaccactgaagcactgccctcgttctcgttcctccacaagacagggagtgaccctgcagcagttgtcatcctgagtctcaggctaacagcattccgttcatcagttcagcccctcttttacagcagatgataggttaaacactaacagaggaatagctctcaaatgttc

SEQ ID NO: 642549 - DNA, 81 bp, Homo sapiens
gatgatgagctcggtccattcattgcggtgagcatcatcacaccactgcacacctgctgggcaacaaagcgcaaccctgtc

SEQ ID NO: 642550 - DNA, 979 bp, Homo sapiens
attgatccagaccctcagggagagtcctagcttactagtgcttactgcaaccgactcgccgtcctttgaccctttagtgtgccggctagtatcgtgagttccctacttatatagatatcgagtgcgtgaggcctctatctatgatatcctcgccacgttgcctaacgtcagatatgtacagaaaaataagagttgtactaaacgactatattgctcttgttgatcctttcttgaactgtatttgcgtgtcttaggagcgtgtacacagcggcatctgttatctttgggtttgcgattgtggattgcatatgatggacggagatgcgaatagggcttgctgtgggcatcccaatttaatgttatatgtgatgacttgtttgtaatatagccaaggcagatagtcttgaatagctattaacgtgttaattttggatttgacgaggcaaatactctattgctggaggtgatttgtagactcatactacgctaatgatcccaatttcaataaatagggtgtgctcaagttcgctttaagaaaatagatatacatagtaaagaactatataagggtccttcctcataatatgcgaggaatcatttcaacttacaatgtgggagtggccgctaaacaaaagtacccgagtatcgtagctctaccatgaaacaaaccctcaagttttttttccaacaatagttggcgcaccgcttgcgtgcagtcctttgcactgaaatgagctgcgcatactacctctcaagtatcgtatgatgtgccaatcgagcagtcctcgctcctgtgtaaccacggacccaatcagatccaatttcgcaattagtcaggggaaagcaacaccttccctaaattttaagcctctacacggagatataaaattgcatccaatagacgagatttgcattacactccttttgtttccaggattaaaacgtttgtcctatccaacaaagaatagacctataaatg

SEQ ID NO: 642551 - DNA, 110 bp, Homo sapiens
gggcctgctactacccccgtgtggagtacggcttccaggttaaggttcttccagaaggacagcagatcttctttctcgtctcttttgagaccaagattacaccaagtctc

SEQ ID NO: 642552 - DNA, 295 bp, Homo sapiens
aggcaagatcccatgtcatcatctgactcttcagactcctccttcttctcatctttcttctcctctgactgcagcaggtgcagaaccagcaacaggggttgtaaagtcctggtgtgcagcagagacggctacagccccaccagcatgtacactggtaagcttgccaataccctgtgtgatgttgttttccgtgaagtttccattcagctcactgataaccttgttgagccggtcgtcgtccgcctcgatacccacgctgtccaagatcttcttgatgtccttggcccttatcgag

SEQ ID NO: 642553 - DNA, 196 bp, Homo sapiens
tctagaggtatcccccgcggttatgtcttacgcttccttgtgggctaccctggactacgatgtctctcatcacattctactgaagtgatgggagacaaaccagcatatgttatctcttgcactcgcggatcgtgggcgatggccattctactcactaggaggttcatgcaacaggcaccacatggtgcgcccccag

SEQ ID NO: 642554 - DNA, 873 bp, Homo sapiens
  misc_feature (1)..(1): n is a, c, g, or t
  misc_feature (68)..(68): n is a, c, g, or t
  misc_feature (91)..(91): n is a, c, g, or t
  misc_feature (96)..(96): n is a, c, g, or t
  misc_feature (100)..(100): n is a, c, g, or t
  misc_feature (132)..(132): n is a, c, g, or t
  misc_feature (140)..(140): n is a, c, g, or t
  misc_feature (157)..(157): n is a, c, g, or t
  misc_feature (175)..(175): n is a, c, g, or t
  misc_feature (180)..(180): n is a, c, g, or t
  misc_feature (204)..(205): n is a, c, g, or t
  misc_feature (214)..(214): n is a, c, g, or t
  misc_feature (228)..(228): n is a, c, g, or t
  misc_feature (241)..(241): n is a, c, g, or t
  misc_feature (297)..(299): n is a, c, g, or t
  misc_feature (353)..(353): n is a, c, g, or t
  misc_feature (457)..(457): n is a, c, g, or t
  misc_feature (610)..(610): n is a, c, g, or t
  misc_feature (743)..(743): n is a, c, g, or t
  misc_feature (858)..(858): n is a, c, g, or t
ngggggggggcgaggggccctgccaggggaggctgcgcgcgagatgtgtggtgagcgcagtgagtgcngctgtggcgtggggcgagcggcngcganaggntcgcgtcgcgcgtgatggaatgtgagagtgtnctgcggcnacagcgtgggaggattntgggcggcagtcagctcngaggngaggcagcgtcagtgactcccagnnatgggatgngcggggggcacagngctcgagagagcngagcaggccaggggggagagggagagacagagtaggccagggcatggcggtgaggnnntgaggtccctaaattttggtcccaggggaaaggaagaggccagttggtccagtnttgatggctatggggaagggaatgtattagtaagcatgggggagaggatgccagcaggcacctcagaggtgacaggacaggctgaaccccccaccctgacaganaggagcttgagagctctggggctctctgggaatgtcactgctaaaatatatatctacatatatattaaccattcgtgggagggcaggggcaaggcctggggtgggatcagaggatctggcgtggcatcccgtagccagttatgcctgcctganacgccccgcggttggtgcccatctgtaacccgatcacgttcttgccctcttgcagctggttatccgagaagttccgaggattctccttggatttcttagggaacagttggggatccccagaaaagagcccatnatctcgggctactgccagcccacccagattcatcagcgtccgctgcacacaggccatgttctttccttcccagaggtccacagtttggaagatgttagttgtgttaatgccatancgctcagctgcttgc

SEQ ID NO: 642555 - DNA, 298 bp, Homo sapiens
atcgaccatgtattattcttacgcgtttacatcttcatcagagtctcccccctgctagtaacgtaccacatattcgtcatcacagtctgtcttgtcctttctgtcttcagaagtgttcgtgtttcaatagttgatgtccacaggagaggagcttcttttaagtacttttggtgtatgttgaatatttatttgctatgatattctagaagaaaatatcagacatgttaaatataagaaccatgttaaaatttaaatttgctatttcaaaagttactgaagatgtcttggaataacaatt

SEQ ID NO: 642556 - DNA, 158 bp, Homo sapiens
gatcccacgtagcaagacatggtggatgtgagctgtgatttactcactcatcgcagcgctgtcgactgtcactacatcacctgagctatctatggcttctactcttctgcagagcatatgaaggggagctgcattcaagccttacatgcgtacctgca

SEQ ID NO: 642557 - DNA, 136 bp, Homo sapiens
gtctatctgtctagtgtatgtcatccacgtactttgataaatgacagctactctcattctctatagcactatcattatatctatctgtctgtctctctaacttcattgatttacttggagcgtcagttgatctact

SEQ ID NO: 642558 - DNA, 138 bp, Homo sapiens
tggacacaagtggccatcccagcatcccagcatgccagcagctcctagcaggcatggacacaagcatgcttgcagcagtgcgccatgccagccgacgaaatcaaagccaagcagcccagcaatccagcacagcagtgc

SEQ ID NO: 642559 - DNA, 104 bp, Homo sapiens
ttggtctcctacaagtgagattttagatatgttaatcactgccagtctttctcttcaagccaggtgcatcctcagaaacctactcaacacagcactctaggcag

SEQ ID NO: 642560 - DNA, 354 bp, Homo sapiens
atcttcagacagctcgagcaaaaaaataaatcactacttggaattatacatgataccaaggatgtgatagatctccacaaggaaaactacaaaacactgctaaaagagagtactcagtgacacaaacaaatggtcatggcttgtgtgctagtcagtgctgtgaaacttaccgtactgccaaaagcaatctacagattcactgcaattcccatcaaagtaccatgatcattcttcacagacctaaaaaaatcctaaaaattcatatggaactaaaaaagcagcctgcatagccaaagcaagactaagcaaaaagaacaaatctggcgcatcacattcacctgcaaggagaaatct

SEQ ID NO: 642561 - DNA, 491 bp, Homo sapiens
cccgacctcaggtgatctgcccaccttaacctcccaaagtgctgggattacaggcgtgagccaccgtgcccggccagaaaattattcttctcctttaggacttacagtctaagaattgtcagcatttataaccattagcatttataaccaaagacacaacgtaccagaatctctgggacacagctaaagcagtgtgtagagggaaatttatagcactaaatgcccacgggagaaagcaggaaagatctaaaatcgacatctaacataacaattaaaagaactagagaagcaagagcaaacaaattcataagctagcagaaggcaagaaataactaagatcagagcagaagcgaaggagatagagacatgaaaaacccttcaaaaaaatcaatgaatccaggagctggttttttgaaagattaacaaaatagatggaccattaaccagactagtaaagatgaacaaagaaaacagcaaagaaaaaaaaaaaa

SEQ ID NO: 642562 - DNA, 617 bp, Homo sapiens
gaagacgtacttcgccgaaagtcgtcggggtttcctgcttcaacagtgcttggacggatacccggctgctcgttcctcgatccccgggcgggtccgctccataggcctagcgcctccgtcactctcttcactcgcaaccgctcggatctgccccatggagccccgtctgccgctctcgatgcgcctcgcatctaccgtctgacgcgcgccggcatctcctataatcggcctgccatgacagaatcgacgtccacgcatcgcaggtagtcggccaggaactaccatcgaggatctcagagagccgccatctaaccgcacagtatcagaactggaagctctacgacatcctaacgtttacctgttccatgtgcttactaacttgtgaccgcagatgcatgtgcgctttgacagaacttgtgccaaaatactttcgttcacccaatctcatgcaggagagggaacatgcgtgagaaactgcatgaacgctgcaggaaccaacgaggtggccgatatcttccttcagcgatatcaaggaaaccagtactgtgcatgactggggaagagcgggcctgacatgcaatggaggtgtgcattaccatttggcacaaaaatgtgaa

SEQ ID NO: 642563 - DNA, 105 bp, Homo sapiens
tcgcctctagagtatcccctgttccacgagaagcggagcgagctgcaggagcagcagatgcagctggcacttgccatgagcagagaagtggctgagcaggaagaa

SEQ ID NO: 642564 - DNA, 1025 bp, Homo sapiens
gcttttaaccagctgaaatcgacctgcccgtgacagaggctgggcatgatcgacagtcaagacgtagaaggacccgtatggaggctttaatcttctagttaaatgcagaacagatagccgtaatgcaaaggccacagggtccgtaatgactagccaaatgctgcagttaaaatgatttcggcttggggcgaccctcgggaggctgagaccacaaggcatccggagcacgtagcactgcgtgaacgcacgttccaccgagtccaaagcgacagcgtacctagtactcacattgatcccaagtcaagcgttgtaccagagcggtagacgaaggtgtaccactaggggactaacagcgcgaactcctcattgctatggagtccatatcatagcacatagggtttacgcatcgctcggagtgttcggatcaggagatcccggatgggtgcaggcgcgtattgaaagggtgtcgtttgttacaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacaaccaccaagaacagggttggttaaaaaaaaaaaaaaaaaaaaaaaaaaaaaaaaaacaaaaaaaaaaaaaaacgaaggagcaaaacacagaagcaagcgcaaaacacaggccaccagcgggccccgccaacacaaggacaacgcacgccgatatgacaaagagggaaaacaagggagccccacaagaggacgcaaacaaacaagaacggaacccagaaaaaaacgcgcgaacaaacaggacagagcagcacagagcacgaagagcagaaggggacacccaccgaaacaaaacaggggaaacaacaacaacaacaagaaaacgaaaaaagacaaaaaacaaaaacagcacaaaacaaacatacaacagaacacacacaacgcag

SEQ ID NO: 642565 - DNA, 293 bp, Homo sapiens
gccgccacagcttgtctgcctgctactatcctgacttaaccttggtctgtatttgcgcgtacaacaaggagttaagcaaagagagagacgccctcaggctggagtttatacaataacagttcattcctttctctactgcttctggtcataatcgaagcaatgaggacctgaagcaggataaatcagaattggatgagaagcttcaagtcctggtgactgagatgctgtggtggccggagaagctgtgtgcggccggagaagctgtgtcggcgcggagacgctgtggcacgagt

SEQ ID NO: 642566 - DNA, 318 bp, Homo sapiens
caaactgcctaagccctccgccattttcaagccctgcagtcacaggtacacagatcacagcttcagccaggagctgggcagaaggccaaaaggctgttccccccaggctgctcaggggtggttttttaggacccttcccctgagccctttatggtgtggcaaagccttcattgccttaactggagccccatcagctccaactggtttgttttttttgcccccaatgctttgccccttaaacaaaaggaggcctgtcctgacctgtttccccatgtacatagctttataaagggcccataaatattatgttatggttga

SEQ ID NO: 642567 - DNA, 333 bp, Homo sapiens
  misc_feature (134)..(134): n is a, c, g, or t
  misc_feature (141)..(141): n is a, c, g, or t
  misc_feature (144)..(144): n is a, c, g, or t
  misc_feature (149)..(149): n is a, c, g, or t
  misc_feature (230)..(230): n is a, c, g, or t
  misc_feature (246)..(246): n is a, c, g, or t
  misc_feature (307)..(307): n is a, c, g, or t
agtcctgatgctcctgggggtagttgctgtagtcatcgcaagctttttgatcatctgtgcagcccccttcgccagccattttctctacaaagctgggggaggctcatatattgctgcaggcatcctattttcantggtggngangctgnatgcatctgggtccaggcagtggctgacatggaaagctaccgaaacatgtggactggctggatttcaccccttctggctgnatggctggcatttttnctggcccactgggatattttttctttgctagctggaatactaattctgggtggtggaccgnataattagatccttactttcctgtgc

SEQ ID NO: 642568 - DNA, 469 bp, Homo sapiens
gcttcgtaactcctctgtggaggtatcctcactgagttagagaacataatgggaaataagggtgtgaacaagtgctgactgacttcggtgggagatttaacagccttgaatagaaagacacaccagcatcctagtggaggagatcatgtgagcatatcacttgcggtgaacagtgtaattatgttaacatcacaccgccttgaaattgtgtcttagagtactaagtttatcaaatgcttgggggattgcatagatgtatttttcattgtaaccaatatttattgggtccctgtatagagacaaggttttagttcatttccaatacattcagaggacggccgctgtactcagcagcacgaggctaccgtgcgtgtactttccactgctggctaaccgtgcactgagcgatctcagcaagccatgtccttcagccgtcatgtggtctgtcatgctaatgaggagcagggaa

SEQ ID NO: 642569 - DNA, 992 bp, Homo sapiens
ctgggggtgaaagggataggacataggggtgcacacaaggggactcacgcatcgatgggccccgaggctggagccgtggcccccaagcccccagggagaagatgtttaataagggaacaaagaggggtccaagccccgttatagaacaaagggtgtggggaaagccactcccaggaaaaagaggggattataagggagggacacctggggaaatagcgtgttcgcccgaaaccactggggttccaagatgcctaattctcaaggaccaaaccgccccctggtatgttttgctgatactgggcgttggtttattgaatcccatgtatagggcttacaaggggtacacctgtgagatattaagagtctcctgggatcgcagaagatctcataggtctgtctcccgccagatgacagatgggtacacaatagttgtaaaaaatattaggtgtcttgaatttccaaagaagaaaaatgtaccggccaaatgccctcggtggactgtattgatatatacccacgcctagaactcactttaagggcgggacttacaccagagaagacggcgttgcgtgtgtacacttagttggtgtggtgtggcaagatattgcttctgaagctcccgacacacacggctctcgaggcgcgtgccacgagaaatggtggctcacaccacaggctttccacagctataacacggttctatgagaaaaccacgtcttgtcgaattacacgttccccctggccacttccctcgtgaagggtggaaccttaagcacgtagacccccacagcctccacttttaagttgcctataagaacttgcctcggcctcttcctcgtgtagttttctctctgtgaagacaccaagaaaatagaaacacatatcacaagagagattggaagatgaagtttttatgatctgcgaacaccgtttgcctcctgtgtactgggttcataaaccagatggattaactggaaatttgtacctttagg

SEQ ID NO: 642570 - DNA, 272 bp, Homo sapiens
tcctgcttttcatcctgttgggtggctgtctcctctcgacagcactctgccctccccacctgtttctgctggtggtgacatgctattctgccgcggcactccagtccacccagcgtcggttcacggttcctcctgtggtttctgacctcccaccacgctccttcgacacttaagctaaacctctgtaacctctgacgacttaaccctacgaccttgataaacttacgccccacatgaccgacgcatttttacgacctactgtgcactccact

SEQ ID NO: 642571 - DNA, 130 bp, Homo sapiens
gtaacgggactctgccagctcagctcgtgccgtctgtgcggttccgaagtctgcttcaatgatcaccaacttacgagccagctcttcatacttcctatcttgcctcttctgcaattgtggcttaggcttc

SEQ ID NO: 642572 - DNA, 421 bp, Homo sapiens
  misc_feature (402)..(402): n is a, c, g, or t
ccaatccctggccaaacatggtgaaacccccatctcctattacaaattacaaaaattacccaggtgtggtgatggtgcatgtcatttcatttcacacacaaaattgttgtggatgcttcaaccttaaaaatccctgcccaggcgccgtggctcatgcctgtaatcttagcacttcgggaacccgaggtggctggatcacccgaggtcaggacttcgagacccggcctggccaacatggtgaaaccccatctctactaaaaatacaaaaaaattagccgggtatggtggtgcatgcctgtaatccagctacttgggaggtgtagacaggagaatcacttgaacccgggaggcagaggatgcagtgagccaagattcgtgccattgcacttcagcctgagtganaaaagcaaaacttcatctc

SEQ ID NO: 642573 - DNA, 155 bp, Homo sapiens
ctacttttccacaggtctgttttccatgcactggtctgtctgcatacttgcccccctgtctgtatgctactagctgtgtttatctgtgacgtgtgcatcagttgttcatttgtgcatgtcagggctggtgtctctgtacttgcctattcttgcgg

SEQ ID NO: 642574 - DNA, 221 bp, Homo sapiens
cagagtacctacttgcatgactacgggatgtgctgccctggggaaatttgacaagttccgaggggtagagtttgtgtgttggccactggctgaagaaagtgacaatgtggattctgctgatgcggaggaggatgactcggatgtctggtggggcggagcagacacagactatgcagatgggagtgaagaccaagtagtagaagtagcagaggaggaagaag

SEQ ID NO: 642575 - DNA, 174 bp, Homo sapiens
aaaaaatatttggtgtgcctataccaatagttgccttgttaaaggtccctggatatgaccagaatatctgctatatttttgggaaggggaccattgagccagtattctatcatggaagtactttataaccttttctgacttgcttgtatattgtttatcagaaaacttaaatta

SEQ ID NO: 642576 - DNA, 440 bp, Homo sapiens
  misc_feature (231)..(231): n is a, c, g, or t
  misc_feature (323)..(323): n is a, c, g, or t
aaagagacgctcgactggttcattcgacttcaccaaccaacgcggcccatcgttccttattggcaggcgctggccgaattccgggaccttggtcgaaggcacgcggggaccgtcgcccgagcaacgctgacgggcaggcgacccgaccgctacggtcaacgcgtcatcgcgtcgtcgccaggtcgatcaggggcgggcggtagggcagctcggcgcccgtcggaatacgtncggcctcgcgatccagcaggccgcgcgatctttccagctgagatagatgcgctgcgcaaaatgccgaaatcgagtttgcgcccggccccccnccagaagcgaccggccgagaacggatcataatgggcattggcgagcagatagacgctcagccggtccgcctcgatttccgcctggcccatcaagcgaccgtttttgccgatctccgc

SEQ ID NO: 642577 - DNA, 152 bp, Homo sapiens
atataagtcatgcatagtagcataacagtacatacccagattccagacatgaaccaagcactatcaaaatagggatcagacattccatcacactttactatatacttagtgaaccatttgccagagtctcttttttatttctaataacttga

SEQ ID NO: 642578 - DNA, 423 bp, Homo sapiens
  misc_feature (1)..(1): n is a, c, g, or t
nctatccatgctctggattaggggtcccgcgttagccaaccagctgtgtcctcagagcttctcctccatggtgtgaaccatagcctgtcaccagacttgcctttgcctgtgcccagcccttaatatcaaagaagatggtgtcaatggatatctcaaatttgcggccacaattctaaagagtgcttgttaacaaagcttgtgggaagaagaatccagtgatccacaagacagctgggatgccatcttggatccaggcatgcagagagtcacaggcgttacggcaggtccttgacccatgatgccagaggcttgagcgatgggtaggccttggcactccagagctcaggcacagtattgttgcacagtatggcagcatatcagctccattagagagtacatcagtcccatctcttagagtgcttt

SEQ ID NO: 642579 - DNA, 235 bp, Homo sapiens
ggggtcttcagcccgttgcgcaactccacgaactaggatagtgtacgacaaccagctggagcgagtgtcacctgtagataccgaggcctccggggcctgacgcgcctgcggatggccggcaacacccgcatagcccagatagcggcccgaggacctggccggcctggttagccctgcatggagctggatgtgagcaacctaaagcctgcatggcccgtgttcgggctacgtcgga

SEQ ID NO: 642580 - DNA, 106 bp, Homo sapiens
ggcgagcacacgtcattatttagtgcctcctgtagcagctcttggttttggcgtcttttgggtcggcccatgtggtttgagcacccatgggagatggagcacccat

SEQ ID NO: 642581 - DNA, 786 bp, Homo sapiens
acagatacgcagaggtcgcttctgctcctggattgttaaggattccaagtaactcttatttggagagaagacgatctgcacttcgacattctggcattgagcatttaattttagggtgcctttatatagaagggagagtagctacatgaatgtgtaagatcttggaggaagacagcagacagagagagagagagtcagagagtcccagggttaaaagttggacgaaatttcagcaagatacatcatccaaatagaggagtccatgatggaggcacaggtaaacttggagaggacaggaagatgtcacccagaagcgcatagctaaaagaaggtcccccccagcagatgccatccccaatagcaggaacggtgaaggtcctcacgcaggtcccacaggagagaacccggctggtgctgacactagggcagggccgcacgtgggccagctggggccgggtgagaatgtgatggagaggaaagaagccggcccggtatccaaaccggaggctgtgtgcaggcctgaggctgggggcatgcacaccgtgtgtctaaaggcgaaaagtgggccaagggtctattaccattcagggggcaatgatgaggggtgccctgggaagggacgccatcagtggagggcctccgggagaatggtccctggggaaaagctggagctgcccacgagacggggggttccaacggttgtcccgccaggacgaccgttcacagcagggagcctcaccgatgaatgggccggtcttacgctggggctccttccggggacacaca

SEQ ID NO: 642582 - DNA, 841 bp, Homo sapiens
cgtggtggcaggcacctgtagtcccacttactcgggaggctgaggcaggagaatggcgtgaacctaggaggcagaggttgcagtgagctgagatcacaccactgcgctccagcctgggtgaaagagcaagactccaatctcaaaaaaaaaaaaaaaaggaaaaaaggaaaaaatttatgggccttttacaatggaattttatacaaaccgggaaaaaaaaagccccaggtatttttttagggcctcaatcgaaggtcatacttggaattatctattactttttattacaaaaggtatttagcctttcaggctttaatattattaggaatggtgaattaacaaggcaaagatggaaattaatgggggcgcttaagacatatctacgggtattaaatttcccctgtgggtaaactttcttttaactacggggattctacttatgggtaacactagttcctgggctcattttattaaaggtaaaattttcttattggacttttaaacagcggggtttttccttgggaatggttccctcaaattacaaaagaatatgaagcttctcaatttttttataacacgtggtgtcaaatattctggatgtgggcttgggagagttgtgttggagcggaagaacggtaccagtaaatttcctgtggaaatgggctatagtgagggggggcgtgtgcaaactcttattttattaatggaattctgggagacctggttttgaaattccttcaaattactattttcgggttaaggagaacattaattattcaaggacaccgttggggacccgtcgaagggtacccggggcaggggaggagaggaattggtcgag

SEQ ID NO: 642583 - DNA, 127 bp, Homo sapiens
tatgtcagggtctgtgctagccgttttagggaactgcagagagacgaaagggtgaagcgtcagtttctttaaaaactattgcataccagattctgtattagttgcttttgaaacttctaaaactagg

SEQ ID NO: 642584 - DNA, 490 bp, Homo sapiens
gtgacctagatgaggcagagaacccaggagcggaggttgagtgaggcgagatcgtaccactgcactgaagcctggtgacacagcaacactccatttcaagaaaaaacaaaaacgaaaaacaacaacggaaaaacagcacagttccctgtggggaggaaatttgacaatctaacaaaattttatataatacatttatcactatactgaacaatctcacttctatctataataacaaaagaaccaaaacaactctagtgtccatacaaaggcgactagttgaatagagtacaaaaaaagatacagtacattgaagctctatcagtcaatgtctacatactactgtgatcttcagcatatatttttaagagaaaagaaatgtgaagactctataatatgctactggttaccttaataaggaaggaaatacaaatatatagatacatatctacatataataagcaagcagggatgagttaggggttctctgcat

SEQ ID NO: 642585 - DNA, 640 bp, Homo sapiens
atagcagcctccccctatggagcccctcgctatcccgacgtaccgttcccccctgaccgccatactcccgccaccgccgccgaacgccatatccgcacggccgtaaccaccgaggaaaaggaatcgtactcgtatgtccgactatccacgaagcctccactcatatcgacccctttgtttgactgcaagtacagcggtgatgacactgctatcctgctggcaccgtgcggacttactatccagtataagaagttcaaccagacgaaaccgcgcagcgaacgcacccctctacccccttaccccttcgattcctccccaccttgctgcacattccgccccctgccccttgtcacctatactctgaacatacacactactacctcacacatcccttacgcatagtaaccacgcgccgctttctcaacgtcaacagaacaacgaacagccaccaacaacacaatcgggcaaacctcgctcaacttgcacgccatccccaggccacatacactgagccaccaaccgcctaaccaaacacaaccacttcaacacagacggctccaccccacaacagaccaacaggaacaccattactaggccccaagttccccacccaaaaacacgcactatcgcccaccagggc

SEQ ID NO: 642586 - DNA, 526 bp, Homo sapiens
aaatattagcttggtgatagtctatgtaatgtaggcttagtgatcatctttatccactagcgtaaaaataagggcttgtgatctgggtagccagagccttcccgtgagggtgaatgtgtgctatatagtccacacggggaagaccacggaggtgaaagggggtgctgtactattagtattcacgcccgatggatggtcacgcccttttactcttgaaatcgggttgccatttgtaatttgttatttgcagcttttgagtgttaactataataggtgttttggtagtttcaggcacccaagcaaagaatcagaaatacggtaatagaataatctcagatatcaggtattgtttgttcaatgttgacaaacaccttaggtacttgttacaaaacaggtagatagaacaactctaggaaaataaagtgtgttgtacatgtagccatttccaggtcaccgaacacttagaaagacgggttttcaatttattcaatcattcaggctgggcagggtggctgtaatcccagca

SEQ ID NO: 642587 - DNA, 622 bp, Homo sapiens
gtggaaaggattgggatgaactggaggaagaagcccggcggaccgagaaagtagttacgaggaagaagaagaacatagtcgaagtatgagccggaagacgaaggcatctgtgcacagttcggtacgtggctctaaccgtggttgcagacacagctctgcacccatcaagataaagaggaagttacttctgaactttggccctgagctgcattcttcctccagccaacccctgctgccatttgtgtatatgggtttaggggggcatttgcgtggaccaatctactcggggaattacagtgccaccaggacacgtgccaatgggcccattcagatggcaagggaggaggtgcacttgcagacagtaggaggctactgctgataataaatattgcttcattcgtctctcttcctgtcaccttctgccaagacattgatggcttgtgacatcttattcggagtctcacagctggatttccaagacagtggtacatggtgacccttagtacccgtatcaatggtcttgagcaagacattcaatccttcagctacgctactgccatgaccttccgacatctttagtttatctttgcatactcacgttctcggagtttgctggctgttt

SEQ ID NO: 642588 - DNA, 262 bp, Homo sapiens
gtcgttcttcttcccatgagcatcgctacagccttatgctaatgctctccctggggaccaagtgttgacactcacgatgaaatcctggagggcctgaatttcaactcacggagattccggaggctcagattcatgaacgcttccacgaactcctccgtaacctcaaacagtcagagagtcagctccatcttaccaacggtcaatggcctgttcctcacacgatggccttaagctacgtggattagtctttggcggatgttaa

SEQ ID NO: 642589 - DNA, 398 bp, Homo sapiens
tggtcattgttaattcatataagagaatcagctcattagtgaaatgaactactgaaacatgtaacaacatagaggcatctcaaaattatcatgctgagtaaaagaagctttctataaaagagtacatactgtatgattccatttatatgaagttctacaataggcaaaactaatctatagtggaaacaactccagcagcaatggttgcccatggggcaggcaaggggcagaggcactgcagtggagcagggcaaatgcgagcaagtctgggatgatggtcatgttctatcaactattaagcataggggttcaggttaagcaggcaagataggggtttaggttaagcatttgtcaacacctcgcttcagatttgcgtacatttgaggtatttaaccttt

SEQ ID NO: 642590 - DNA, 402 bp, Homo sapiens
ttagtatactactaactaaatgtcgggccgcgttgagacattctttgcttcgctgatgatttccaagtaaaaagttgatactttcttgctgtaaatacttagaaatcattgtgcttcacaatcactgaatccaaaagcttcatagctcgacttccttcctcgagaatcttccaaatgtgcataaaaacttcatttcttcatcattcgtgatacctggttacatatacatacacaatacgcatcttttgcacttttgcaacagttatgagtaaatatagccgattatcatgcacaaaaccaacaataacgctattaaaaacatgttcattttaggcgttatcaaattcccccacacttaagttatactcgccctcgagtagggtcgacgcggccgcgaattta

SEQ ID NO: 642591 - DNA, 254 bp, Homo sapiens
actgtgtgggcaattgtatttaaagccacaggattgggcttacctagagaggataatgtccacagcgtgatagggagagatgctgagaaagggtggtcagtgacttgaagagacccatagctgtacgatgtgtttcctgcctgcctgagtataaggtcatcgcggtaagatgagagcagcctctcttaccaatcgaccttggacgcatgtaatcgggtggataatgttctacgtgattattcccagctggagta

SEQ ID NO: 642592 - DNA, 214 bp, Homo sapiens
gtggagcaacactcaacgaatgtaatcagtgttttaaagtcttcagcacaaaatcttcccttacacggcacaggaagattcatactggagaaagaccctattgctccagttaattttgggaatccctcaagcagtaagatcttaccctgcttttcaaaagagatcccaattggagagacccccattgatccatgccttgggaaccctcagcagc

SEQ ID NO: 642593 - DNA, 427 bp, Homo sapiens
gggccccccccggcttcccccttttttccccgcccgtttttttgggggaatgggggggggggcacccttttcccccggggaccggttttgccgggttttgggttttttaccccccccccaaggggatttggcccccccggccccaaatttggccccggggttttttttccgaagggggggccccccaaaaggggtttttttttttttgggttggggggggggcccccccgaaaaaaaaacccccccttgggggggtggacccccccccccggaaattttttttttgggggcccgcccccgggggggttttggggtttcccccccccccccgggggccttttccccgggggccgtttttttttttgcccccccccccccccggaaagcccggggtttttttttttattaaatttttttttttccccca

SEQ ID NO: 642594 - DNA, 108 bp, Homo sapiens
agtcggccggaccgacttttccatacttacttcactgttaatacatcactgattatgttcaaatcgtgatgagaaacctaatactgtaatttgacttgagccataaaa

SEQ ID NO: 642595 - DNA, 571 bp, Homo sapiens
  misc_feature (4)..(4): n is a, c, g, or t
  misc_feature (8)..(8): n is a, c, g, or t
  misc_feature (51)..(51): n is a, c, g, or t
  misc_feature (118)..(118): n is a, c, g, or t
aggnccgngacccggtttggccaatttttcccattgcaacgggcgtttttncccaataccctgggcctccatggacctaggaaataactaactgctttttattttacaggctcataancagaagagacttgcttgtctcagatgaaactttggactgtggacttttgagttaatgctgaaataagactttgggggactgttggggaggcatgattggttttgaaatgtgaggacatgagatttgggagggaccaggggcaaaatgatatggtttggctgtgtccccaccaaatctcatcttgaattgcagctcccatgatccccacatgtgggagggacccggggggaggtaactgaatcatgggggtgggattttcccatgctgttctcatgatagtgaataaatctcatgagatcttatggttttataaagggcagtttccctgcacgggctctctcttgcccgccaccacgtaagacatgtgtttgctcctccttcaccttctgccatgattgtgaggtctctctagccgtgtgaaactgtgagtccattaaacttctttttctttat

SEQ ID NO: 642596 - DNA, 278 bp, Homo sapiens
gagaaatccatttatatacttaatattggtttctagggaatttttttcgagacagagtttcactctcattgcccaggctggagttgcaatggcacaatcttggctcaccacaacctccacctcccgggttcaagcaattctcctgccttcactactcagaagctgaggcaggggaatggcttgaacctgggaggcagaggttgcagtgagccaagatcggaccattacactccagcctgggcgacaaagcgacactccatctcaaatttaaaaaaata

SEQ ID NO: 642597 - DNA, 923 bp, Homo sapiens
ggggccgccactttcctctttctcttccggcgaagccgctccccttgctaagaactggtggcctcccgggaggagagatgggctttgccttgcaaacccgtggcatcgccaggggcgctcccgacaagtgggggtcctccgtggactgggcaacgcccacggctgggtggtgctccagggcgtcctttctccctcgctttcttacctcacgcatcggcctggtcgccgtttcctcgcatgcgccctagttgcgtgaccttgatcttcggtcggccgcgcttgtcccatctcatgcgcctccacgccacgagatccccgtgggcgctcgagtctccgggggcctcgtgtagagtagcattcccgggaacttgcccagtagcgggcgcactcatgctgcatggggctgccactaccagggggccctttggggggtgccccttggccggcccttcgggaagggtgcgcggaacctaactggggctctatgggtgctaggagtgatcggccgtgcccttgggattcattcctcggtctctttctttcctcacgagtctgaaacccggagacgagtaatgcaacttgtgctccagggcatttccgatcgtgctcgccccctaccccaggggttggtaattgggtgcatccgacgtccctatgccccaggtactgggggcgtcaggtggccgggaacccaaccggacatatgtcccgcacggcacaaggtgtgtcctccatgtatagcccctttgcagcacccaggaggccaagactgggccagatggtcgcaggggggacaccatcaacacacaggtgtctggtccaagtgaacacgggtggcgtgtacctgcacacattgtgggcactgagggacagcacccaagcagtggggtgggcccccccgttgagggtttggttgtcagccg

SEQ ID NO: 642598 - DNA, 344 bp, Homo sapiens
agccatcactagagtatcacccggcgaagaacaacggcacgatagccagacagcgcacccggagatactgcaatcatagattcacatatttgtactgtcagttgtgaaggagcagaaggcatctttttcactgttgctgcaaatcttaatatcctttacaatacggactcctgtgtatatgttatactgattctactctgcttttactcctttggagcctgggagactccccaaaaaggctaatgctatcaagagtagaacttagtatctctagactagttatgtataaaacgcctactttcccttcttgcttctttgggatatccccatgtatttagtgatgt

SEQ ID NO: 642599 - DNA, 334 bp, Homo sapiens
aagaatgcgctattgaactccagcctcagtggcagagccagacagtatcaaaaaaaaaaagagtaccaataacaaaagctaatatttaaatagcttgatgtgtcgggcactataatgagtatcttatacttttaacctcattttaatatttacaacaacttcttattgaagtaggcacttacaatttactctgaatttttacaaattgaggaaacttgaggtttaagttaatttggcctgcagttcacacaacctagttaattggtaaaggctagaattatgaatctccaaaccgctctgccctcctgagatagcttgtgggggtcaccgagcc

SEQ ID NO: 642600 - DNA, 190 bp, Homo sapiens
  misc_feature (12)..(12): n is a, c, g, or t
  misc_feature (14)..(14): n is a, c, g, or t
  misc_feature (39)..(39): n is a, c, g, or t
  misc_feature (107)..(107): n is a, c, g, or t
  misc_feature (139)..(139): n is a, c, g, or t
tctgagtctttntnataagcgaactttttaaaggaaagnttataccatgaagtaggaactcaggaaatgtgccaatggttaaaccctattagcttggtactcctagnattccatggaaaaacgctttacaggacttctngcttaccttttctcagaatcaccagccttcttcagcaccacctttttgggg

SEQ ID NO: 642601 - DNA, 388 bp, Homo sapiens
ataggtgagcacaacataattataaaaatgatgccatgaaacaatccaccgcatcagttcagttgtatagttgtccaaagtacatatgtgatcatcaatgcaagaaatatttgtagacatgtaaacacgttatttctagtttcttcacaacagtatagttcagtgggctcattcaaacttggatttttcatttttattcaatgcagatatgttctcttttcattcacagtatgaacttgttgcagcaacactcatagtacatcatgcatttttcaagcagatttatgttctcacttcaacaatgtgcaattgtcacttctgtttcgcatgtggttgttccacttgcgggggcatccgtctcagcagtcgcacctgcaaggcaatgcaa

SEQ ID NO: 642602 - DNA, 244 bp, Homo sapiens
atgggctgatctaatgtaatcacagaggccagtatgtacagacaagtggggaggtttaattactgggcctctccctcctgtgaataaggtctggatgatctcctcctttctggtgccgggaggctgctcttcagggtggctggcgttggcttcctgtggtctaacgattcaggcggggccttcatgcctgggttcagccagggatgcttcttggcggggccataattatggcgggggtcccgga

SEQ ID NO: 642603 - DNA, 1193 bp, Homo sapiens
  misc_feature (1168)..(1168): n is a, c, g, or t
agcgggtagcctgggttccagaaggcctgcttgggaccggaagcgcggaactctcagcccagcagctccttgttggcggcggtccgcgcccccgcccccaactgcttggggttctgcgccttctgccagcaatccggcccctaccgagggccgaagacgccaggaaaagcgtcatgatttgggctcgtaaaatgccacatgccttggggcctgtttctcttcccattccttttgtccactgctgcttgcttcagctcttgtacatctggtcctgttcccgccagctgattttaatgctcagatcctcctcctcttccaggtctccgtctaccttccactacagtcaacttctgagctagcgcattgctgccttgccctgctctggcgctcccacttggatctcgactgacttcgtagtcgtctcgttaatctgtcacactttagtattccgaggatcgtatttagatgccctttgagaaagactttgttcctgaactgctcccttctcttttagggttggactactataatacaattctcttgtgtacattctagagacccttcaagttacaacatttaataatgtataattgctattactttgtacgtgtattcaggctgttggtgtgattattttcgattacttatctttgaagttatggacagtttcctttttccttgagaacagggtctcctcctggcggcccagggcttgggagtgcaagggatcataagttcccgggcagcgtttcccaacttccctcagtgaagggcgccaagcgaatccttcttgacgctcaagcgttccccgagttaattaggagtaagaggggatttggcgccacaatttcgggttagaaaaccgaagtttgttttgaaaccacttttggagacgacgagcgacttgtgggcggggtgtttgtgacacccaagcgacgcggttcgaggataaaacctcgtggacgctcaaagagcacacccacttggagaccttgatttcccacggaggtgtggtgaactgtgcacgcgaaggtttgagaccacctgtccggggtccatgtgaggtggctctagtcaatgaccactttcagagaggagcatatccacgctagattttgcaggctgtagaccatcgaacttgtggtgcaacgctgtcggggtcgaccanacggagtggaggtacactcaacata

SEQ ID NO: 642604 - DNA, 1477 bp, Homo sapiens
  misc_feature (110)..(110): n is a, c, g, or t
  misc_feature (651)..(651): n is a, c, g, or t
agagtggatatgtaagacttccttatggtgctagacgggaaaggtgaagatatctgtcgcgggaaagagattggtgctccagtctctgtggaataacgacgccatgaccnggaagtgaactcgtcgaactagtctcactcacaaggcattacgcggcctctagattgactgattcgcacattaagatacggttgttcgacgtcactatgcgtattgtcgtgatctaaaaattatagagtgtgcgtttaatatagtgcttagctcgttagctcatggttgagtggcacagtatgcttgtgtatggatcgtagaggattcgtttgcatacacgaaagcacactgaggtaactaggggtagtggtaccaactcaattaggacattctcaaagttacaaaacagatcaaggcgtatatagaggcaaaggctcaatatattacatcggttgccggaagatagttgacaagcgaagaatgagttatcgcgcatccttgttaaggtttgcaatagaattcgtgtttaattgtgggcggatccatagttgttagtgcgtcaacgttcaatcggccgcttctaaacgtagagtgtgggtgtgtctatgcttctgaacatgacgatggagattgcaacgactctgtttggcgtcaaacagnccgtttatggacttcgcggatgatactgacgcaatttactcaatcattgcaatccccaaattcaaaagaagtggcgcccaacagttcttcaagagccacttcgtggccactactaccttacaatcgactttttccaccaggagtctcggcaatactaactctcctatggctacaaccacaaatgttcaaccatatggggaacaccgaaaaaaaaatgctcaagacatcgtccttgggggtggagggctaaaattgccctccaagcccctcggactccattggtgctggcatcacgggccccctaaaacgatccggagtcggttcggaccccattttggtgacaacctatgttcaactagcttggcttgggtccctcggccaaagtccatggttacccttgggggcactctccagttggtgtctgtaactcctcgcggcttggccttatctgtggaattcaccaaaaaaacgccccttgttgtacaaacagcatttgcgaggttgccctttaaaaccacttggcacttttggcaaactcgtgtttacctgtgtgtgtctgtggaaccgctcgttacagttgagccttccatcttcaggggcggatggccaccatatactttcgggaataaaatgccctttgtgtgttctacagaaccgtatggccatcaaatgtaatgtcctttgacatgtcccgaacattaaagggccactctacacatacgcagggcataatcttaatttcacacaaggcaccttattgcgcgtggtgatacctatgcaaatatgaagagcacttaagactttggccgcgccttcactttctatg

SEQ ID NO: 642605 - DNA, 337 bp, Homo sapiens
tccataagatggggccataagatctatttcattaattcattcaacagatatttaccaagtgtgtgtgatgtgccaggtgccgggtcaagccctggaagtgaacaaaaccagacacagaccctgcctaaatggcaccgtgtggtctcgtgggaagccagttaccagtcaaagaatcatgtaactaggggcacagctgtgaccatggtcgatgtggtgctgggagtgtgcaagtcaggagacccagaaggcttcccctgggaggtgatgactgagcgaagggatgaaggaaaggtcaaaagtaagtaggcaaagggggtcaagagatttccagccagag

SEQ ID NO: 642606 - DNA, 906 bp, Homo sapiens
  misc_feature (881)..(881): n is a, c, g, or t
gagccgcgggtgatcgtagctcggaatggcgggtctccgtctaccttccactacagtcaacttctgagctagcgcattgctgccttgccctgctctggcgctcccacttggatctcgactgacttcgtagtcgtctcgttaatctgtcacactttagtattccgaggatcgtatttagatgccctttgagaaagactttgttcctgaactgctcccttctcttttagggttggactactataatacaattctcttgtgtacattctagagacccttcaagttacaacatttaataatgtataattgctattactttgtacgtgtattcaggctgttggtgtgattattttcgattacttatctttgaagttatggacagtttcctttttccttgagaacagggtctcctcctggcggcccagggcttgggagtgcaagggatcataagttcccgggcagcgtttcccaacttccctcagtgaagggcgccaagcgaatccttcttgacgctcaagcgttccccgagttaattaggagtaagaggggatttggcgccacaatttcgggttagaaaaccgaagtttgttttgaaaccacttttggagacgacgagcgacttgtgggcggggtgtttgtgacacccaagcgacgcggttcgaggataaaacctcgtggacgctcaaagagcacacccacttggagaccttgatttcccacggaggtgtggtgaactgtgcacgcgaaggtttgagaccacctgtccggggtccatgtgaggtggctctagtcaatgaccactttcagagaggagcatatccacgctagattttgcaggctgtagaccatcgaacttgtggtgcaacgctgtcggggtcgaccanacggagtggaggtacactcaacata

SEQ ID NO: 642607 - DNA, 1112 bp, Homo sapiens
  misc_feature (212)..(212): n is a, c, g, or t
  misc_feature (322)..(322): n is a, c, g, or t
  misc_feature (324)..(324): n is a, c, g, or t
  misc_feature (365)..(365): n is a, c, g, or t
  misc_feature (412)..(412): n is a, c, g, or t
  misc_feature (476)..(476): n is a, c, g, or t
  misc_feature (489)..(490): n is a, c, g, or t
  misc_feature (528)..(529): n is a, c, g, or t
  misc_feature (583)..(583): n is a, c, g, or t
  misc_feature (598)..(598): n is a, c, g, or t
  misc_feature (603)..(603): n is a, c, g, or t
  misc_feature (610)..(610): n is a, c, g, or t
  misc_feature (627)..(628): n is a, c, g, or t
  misc_feature (646)..(646): n is a, c, g, or t
  misc_feature (653)..(653): n is a, c, g, or t
  misc_feature (692)..(693): n is a, c, g, or t
  misc_feature (700)..(700): n is a, c, g, or t
  misc_feature (703)..(703): n is a, c, g, or t
  misc_feature (730)..(730): n is a, c, g, or t
  misc_feature (748)..(749): n is a, c, g, or t
  misc_feature (753)..(753): n is a, c, g, or t
  misc_feature (765)..(765): n is a, c, g, or t
  misc_feature (779)..(779): n is a, c, g, or t
  misc_feature (792)..(792): n is a, c, g, or t
  misc_feature (805)..(805): n is a, c, g, or t
  misc_feature (809)..(809): n is a, c, g, or t
  misc_feature (823)..(823): n is a, c, g, or t
  misc_feature (849)..(849): n is a, c, g, or t
  misc_feature (858)..(858): n is a, c, g, or t
  misc_feature (865)..(867): n is a, c, g, or t
  misc_feature (869)..(869): n is a, c, g, or t
  misc_feature (876)..(879): n is a, c, g, or t
  misc_feature (883)..(886): n is a, c, g, or t
  misc_feature (925)..(925): n is a, c, g, or t
  misc_feature (934)..(934): n is a, c, g, or t
  misc_feature (937)..(937): n is a, c, g, or t
  misc_feature (942)..(942): n is a, c, g, or t
  misc_feature (956)..(958): n is a, c, g, or t
  misc_feature (972)..(972): n is a, c, g, or t
  misc_feature (975)..(975): n is a, c, g, or t
  misc_feature (1018)..(1018): n is a, c, g, or t
  misc_feature (1022)..(1022): n is a, c, g, or t
  misc_feature (1027)..(1027): n is a, c, g, or t
  misc_feature (1029)..(1029): n is a, c, g, or t
  misc_feature (1111)..(1111): n is a, c, g, or t
cgcggagtccgcccagtgcgcgttccctgcggcctgcagcctcggcgaccgggacccgccggcctctctagccgccgccgccgccgcctcgatggtgggcagtcgcacgcagcctccagcgccaggagggggcgccaggcagggcctgtcccgcctggggagactgcgcccgggataataggagcgcttggcctctgagactacccggcagnagggacgtccccaaatgacactcggaggccgcctccctgggctccggtgctcggtgccgggaggagcggcacggctttctacacaccgcactcaaggtgcgccaccgttntnttcatgggcaagcaatcatgtgtgttaggcagacaaggcgnggtgggttccatttataagggaaataaagaaaaacatgaaaacatgncattccaaacatgcaaggcaagaaaggaaagcaagtgggtcaattgcatgggagggttaaaaanatagttcatggannaggcgcagcaagtgcgcatcacagccatggtcatttcnnaagcacattttgggggaggcatggaggcagagcaagtatcacagaaagtcaagnggagtatcaaagacnaatcnatgcgcnaaacaaagggtgaaacnnacaggcatcatacataanaaaatanaaaaaaattaagcatggggcagtgggtgggcgcagcgcnnggaaagntcncaagcatacatatggggaagggatganggcaagaaagaaatcagnnttgnaaaaacaggggnaggcagggagggtntgcagggtggagnaagaagaatcagngcanaatttgcaacatcnaagcacatgggcagacatcaagcagnagtacatcnagctcannnanatcatcnnnnagcnnnnaaaagaaaaaaaatcatgctttcaaggtggggggaggcngacaaaagnganagggnggcattttcaagcnnnagaacatggggggntcnccaaggggaaagaaaattcaaaagaatgggcaggtgtttttanggangcacntnagcatccatttggacaaaaattaagataaaaaatggtttagctcatttaggggggaaagaaacaggaaaaagggcctcatcna

SEQ ID NO: 642608 - DNA, 209 bp, Homo sapiens
caaacttatactaattcaggcaagatgatgaagggcagaacaatctgtgagtggtctctttctccagcaaactttctattttagaagagctaaattgtagggttcatgtctaaaattctcccttggggtgggagtaggtgagtacagaaacaagtaaatacaactctgcattgccatgtgggggagaaagctaggatacagtagggaga

SEQ ID NO: 642609 - DNA, 364 bp, Homo sapiens
aaattaactggggaaaatgtttttctgttctccatttcccttaagtttgtttttagataccccgcattgcaagtatgtgtgggacagtaaaatgttgctaattgtatttgcgctgataacatgccatttgctgtaggtcagtttcctaccccctcccccaactattcctagccagtgggagcatgcttcttacttccaaaagggtgggggggtgtgtgtgtgcgtgtgtgtgtgtgtgtgtgcgcgcctgtgtggatcaacaatgtgatcctaaaataaaaaaatgacatatatttgacattatttacatactaaatatgggagcccataaatcaattacagaataaaatcaatttttcaagga

SEQ ID NO: 642610 - DNA, 242 bp, Homo sapiens
  misc_feature (35)..(35): n is a, c, g, or t
  misc_feature (43)..(43): n is a, c, g, or t
  misc_feature (235)..(235): n is a, c, g, or t
  misc_feature (238)..(238): n is a, c, g, or t
tctggtccacacgccaccggagaaggggaatggtnaatatgangacatcatcataagatttagagcagtttcagtgctgagacaaacgtaagataaaattgggtacattccattgccaaggtaaaaggaagggaaaccaaattccaataaagcccacagcacagcatacctggggaggggacaggagagaacgaaagccttcttagaagtgtgttgatggaagccttctccggtngcntggt

SEQ ID NO: 642611 - DNA, 213 bp, Homo sapiens
  misc_feature (11)..(11): n is a, c, g, or t
  misc_feature (20)..(20): n is a, c, g, or t
  misc_feature (67)..(67): n is a, c, g, or t
  misc_feature (132)..(132): n is a, c, g, or t
  misc_feature (142)..(142): n is a, c, g, or t
  misc_feature (151)..(151): n is a, c, g, or t
  misc_feature (158)..(158): n is a, c, g, or t
  misc_feature (168)..(168): n is a, c, g, or t
  misc_feature (173)..(173): n is a, c, g, or t
  misc_feature (207)..(207): n is a, c, g, or t
  misc_feature (211)..(211): n is a, c, g, or t
ctttggagccngccccaggnagcgtgtgtcggtcgcctaggctggagaactagtcctcgactcacgngcaaggatgatgctgaaaggaataacaaggcttatctctaggatccataagttggaccctggggngtttttttanaaatggggncccaggntcgccaaagnatttnctgctcacctagataaccaggttccagttggggntccngg

SEQ ID NO: 642612 - DNA, 452 bp, Homo sapiens
ttgtaatccagaaagggtgggtgtgtggataggcgtggtgcagtgtgtggatagaccgtggtgcggtgtgtggatagaccgtggttgcagtgtgtggataggccgtggttacagcgtgtggatagaccgtggttacagtgcctggataggccgtggttacagtgtgtggataggccgtggttacagtgtgtggatagaccgtggttacagcgtgtggataggccgtggttacagcgtgtggataggccgtggtaacaagcgtgtggaataggccgtgataacagcgtgtggatagcgcgtggtaacagcgtgtggataggccgtgtttacagcacttgtcggatgggccgtaggttacagcgtgtaggatagggccgtggttacagcttgtggatagcgcgtgttcacagcgtagtggattgcaccgttggtcacagcattgtggaataaga

SEQ ID NO: 642613 - DNA, 1421 bp, Homo sapiens
tttttgtggggcgttccttcgttcgttgggtggtcgttacttactcttgtgttgttgtgcagctgtgttttgtttttttgtcctcctccctcctcgatgagattgttggctcttttgtctgttaattgctgttttgttttgtttgtccgctctatttgttgtttgtggtgtacttttgtgtgtttgtgtggtggagggttgcgccgacgtagtttgctctctctgtctcgtggttgtcgtgttgttgggtacgtcgtctgcttcgtttcgtgcttcgctgtgtgtttgtttcttttctctttgtttgttctcttacttgtttgttggtcctccactcctcttcgtcttcctgttgtgtagttttatacttattactcgtttgcgctgctctgcactgctgcccgtcacccgccgcgtggcgggggtggggtggtggagcactcacacgactctgcgcgtcttcgtgtgtggtgtccttcgctcctcctctgctggttctggctctgttttgtggtggggaggtgcgtctctactcgtcgctccgtcccacctgcgctgtggtttgtttcttcttctgtgtagtatgacccggctccgcacacgtccgcgccgtcgtgtggggtctccgcacgcgtgtggtgcgctcggcgaggtgggtgcggctgcttcgctgccgcttgcgtcgtctgcatgtgcttcactccggcactggatcgtcttcgcggcgtcttgtcttcgttatcttcccatctacctcgtcgtcttctacgtccgtcgtctgcattctcttccccttctcggctgcgtgctcgtttgtggtgtgtgtgtttgcgtcggtggggagtgtgtggttgtgtgtcgttgaggagaacgcgcgcggtcacgctcgcgcgcgcgctgttgtgtcttgggtgtgtctgtatagatgagatagctgtgggtgtgaggtctctctctctcctccctcgctcgtcgcgaggcgagagtttcgcggcgctcctcctgctgcgtgccgctcctctctctctctctcaggcccctcgtccgctgctcgtctcccgactcgcagagtgtcgctccgctccctcctcccactcccgacttatcagtaagcgaggctgtgagggatgctcgccgcgcgcgtggtgggtattcgcgctgttaaggtcgctcatgctgtgtcgaaggagatagtggtggtgcggtggttgtatataagtagagtagaacagatcgactacaaaatatagatcgtgttggttgtgttttgtttttcccagctctaggagttgtttgagatatagagaacaacatctgatagcccagccggtgataacttgtgttgtggtgcacacacaacctccccacaatttcacaactctggttgtatttttataaaaaaaaataaaagatataaataa

SEQ ID NO: 642614 - DNA, 804 bp, Homo sapiens
gaagataatgagaaagttagacagctgcttctggagggtgtgcctgtggaatgtacgcatagtgtttatctggaacgcatagatatctgtatagagtgtcatcagtagcaatacaatggtctcgggatcacggatttcaaagccggaatgaggagtgaattgctggtgccatgggtcagagcttaattttagggtccccatgaatccatatgatacctatacttttcgattcatgcagccgagggaaaatgtgacgtggtggaaagatcggacgtaggctggggaagtggcgtgggatgtcgcgtactcccaaagggctggtggctatggctttctggattccattgatttatcgaggtgtgagagtcggaggggtggaaacgagtactgggaggtgcacttcgtcagatactaagaggtcgcgctaagtgtcccaggcgaattcctccaggactggcccatgtacggcgcatgcctgatcttgcaggaaagcagcagagtctagagtaaatcgttcctattcaatacaggtacaaacagatcgacctcatccatgggaaaaatcgggccgagcgtacgattcaagcgttggcgactctggtcgaccttggtcatggtgtccctggggagtcaagtgtaacgcaggactgggagtcaagagtccaggcttacgaagaaccttctgtaggttcatctccaaaatggtaaggagagtgacctaagaagatctgaggtgccttgtgctcccatgcctagaaaaaactcatcagcatctgatgaagtgggcacatccataagagcacc

SEQ ID NO: 642615 - DNA, 655 bp, Homo sapiens
tcctaatgattgcgtaacgtactatgagaaagcacataccaagggcagcatacacgacctgtccaaaaaggccttcgatgcagggttatcctatcaattacgtcataagcagtgacttgcccaagacttttctgagcactttaccactcgagaatagcaactattgacgaattgggagggcactggactgacaacagacctcagccggctccatcgcttagaagtaccactcctaaacacatgcgtgttactcgcattaagagtatagatcacctgagctcactcataggctaatagataacaaccgatgccaactagttcaagcactgctaattagcaatgaactggatcaatatcatacccttctacaatccgtacacatctacgagtgtgcctataccatttgcgacggcgtctactgctcaacatgttatgaatgcacaggctttcacggacttcacgatgatatcggctcaactttacttactatgtgcgtcatccgacgacttatatttcacgatccactgatcatcactttaggtatggacacgtcgtctgaactgacattatatagatgaggggtgcctattggagctgtcatcatataatgtgggcccattcgattgtagcattcagcaacttgataaatgggccg

SEQ ID NO: 642616 - DNA, 160 bp, Homo sapiens
aagctataccaccctacttgtcgcatacttagttccacaccgatgattttatatacggggctatcaccctctatggccggactttccattccgttctattatcaaagatgctaaatcatgcaggctcttcccatttcgctcgccactactttgggaatct

SEQ ID NO: 642617 - DNA, 1351 bp, Homo sapiens
  misc_feature (1061)..(1061): n is a, c, g, or t
ggggtgccctggcccccgttccaggagcgctagagagtgctacggggggccggagaccttgcccgggtcgctgacccaccgtcacctgtgattcaggggctggaactgcacgcaatgcagagggcgctgatgtacccacaatggctccccgtgcgctcgagtcacggcggagcaccaccggacagtggagctgaggctaccgctacaatggaacggtgatgaagtgacacgtatccggatcatagcgacccatggtgagtgcaagctgttgtccctcagagagagtgcatctcgtcaaggcattatttgaagacgaccctagatggaatggacgagagttcccgggcttgacgtgaacagaagatttgtcacactggtgataacagagttgttaaggggcgagcctgttttggcaacgaggttcccaaggactgcgaagctcgaatctcaaggactccggagaaatgaaacgggcgggaatggaagcaatagctgcacaggggatcacatcgggatggcatagcattcgccaatcgcaaatcttctgtgctttccccttcccattgttggtctatcactttttcgcaaccacacacttggaccattgtatgcattctacaagtgtacaaggaacctcagaaacttggtccaacaaaggcaattctttccaacaagcgatgtctcatccctttgtcaagttggccccccgagggtttggaaccaaaaggcccgagggcaaacaccaaggttccgcaaggaaaagaggcctttcccaaagtctccaaggtttgcggcgagcgccattcccgttctttgtaagagttttgcacaaccgctggggatcaagccgtcccccttagaacgagggaagccaagtgaaaaatttccaagccccaaaagaaggggaaggccaatggcaaatgtgcgccaaattggccccaaaatttggccaggacttaggggagcggccttaggagggacgccacccacattggacccccccaggattcggagaaagtggaaaccggggcagaaaagccttagaaatttgctcccctcgnccctcggccaaaggccggccccatttggtggaaggaaagccaagcgaggccttggagaggttggttagagtgagtaggccaggagaagagagaaaggcccagggagacacaagaagagggagcaaaagagagttccagttgtgcagaacacacaagccccatttgggggggacctggaaaattgagagacgcaccttgagaaaggtttcgcaaagagcccaggaagacgtatggggggaaatttctcccaagaagtgaggttggccaacgcaagaaagaaaaatttggag

SEQ ID NO: 642618 - DNA, 271 bp, Homo sapiens
cctccgtctcagaccatatagggtaacttcttgaatcttgtcgtgacatgtataaccccgtcgtggttctggtacgagtgcacaggcacgatgatgcggattgtcacatcttgtctctattatggttacggtgggtttaggccagctcctatcactgcaacctgtatgatcaccaacgtctttctgactggtattttgtgctgaccttctatgtcatcctgtgacttacaatgccttaaccatcaggaaatgcaggccactgcttcagagt

SEQ ID NO: 642619 - DNA, 106 bp, Homo sapiens
agaggatcttcgctctcaccacccagctaggcagatgtaacacttcactctgaagaagcgccaggatatggtgggggtactagcacttgggatagatgggtccgtg

SEQ ID NO: 642620 - DNA, 166 bp, Homo sapiens
tgggatggacgtacgtgtacacaggcagagtagttgatctcacgcaatgggtgatctcacaaaaatggtaagtttcttatgctcatgagccctccatttttttttttaaatttggtgcctgacatggacttaaaaattattatactccctgggcacatataaggag

SEQ ID NO: 642621 - DNA, 324 bp, Homo sapiens
  misc_feature (4)..(4): n is a, c, g, or t
  misc_feature (161)..(161): n is a, c, g, or t
  misc_feature (303)..(303): n is a, c, g, or t
ccgngagtgtgccactgcactccaccttggtgacagagtgagactccgtctccaaaaacaaaaaaaacaaagttgaactataaactgaattcctcccaaggttagttcagcctatgccctggaatgaacaaggacagcttggaggttagaagcaagatggngtcaggccagatctctttcactgttaacattttctcagttataatttttgcaaatgtggtttcagtccctgcatccataatacctagaaattttgataaatacttgttaaacaaccaaaaataaaacatccacagcaaggantcgactataaggcgttggtgg

SEQ ID NO: 642622 - DNA, 647 bp, Homo sapiens
ggaacctacccacctcctcaagggtacccctaccaatgatacccacacgtacggctggcagggtggacctcaggagcctcctaaataccacagtgtatgtggtagaagacctaaagaaagagatgagctaggaccatcgcacctgtcctcaccagtcctgctggacggctctctgattgcgtgcatgtctctggtgacatgctcagcactgaccatggaccagacccagtccgatcctgtgcctgaccaggctctagctgccacctctgacaggtgttggctggccccatctcttctgattgctgttaccaaatgactagctttgctccgacacctctaccttcagcactatgggattctagatctaatgggggttgctactgtttacatctcagtgacttgatcgtttttacatgtccaaacatcctattctcgttataagatctttagaagatgtgctaaatgactttgtgggccacaaggcttagttgtgaagaagatatcatttgtacattcatacattcgaaggtcatggggcacaatgtggacacatcgaatcatggcaatgcattctctctgctaacagccgcctgtatgtttcaatgacaatttgtccgagagtctcacacaagccttacagaatgtgg

SEQ ID NO: 642623 - DNA, 898 bp, Homo sapiens
gcaaagagtgtgagatgtgagattgtatagagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaagggcttcagtttttttaaaattggggattgtcctattaagggggatctcccgggtctactatcatttaggaccaggtaccaggctaaaattgagtctcttgaattcttccatccccaattggcccacaaagcggggggggggtttcgggtactaaaagcactaatataatgtggctgctctgagaacagcccagtagtccccatttccttccacaccaaaaggtgtcaattcagtatgcaatggagtccttacaagtggagttaatgtgggtctggccctttttttagcacaaaaaaatgggtcctttttatggccgaatgtttaacaagacttcatccttaactggttcttacgaaaagggatatacgggagaagcaatgcaggaattgcttgcagggtttcatcatcccggtttctacaaaaggcaaggcaggttttccctttgagagattctccagagggtggaaggcgaaaccccaattcgggtgctcccttggaatttggccctctttgtggaagagtgttttacaagcacacataggttgtagacaattgaagccgcaaggaataacttagggttaccccggatgtggagtccaaaccggtattg

SEQ ID NO: 642624 - DNA, 168 bp, Homo sapiens
tggtgcagcggaactgctgcaagctttcttcctgagggcagatgacatcatcggattcaggcccttacccgccgacgacagatctgctcgtatcagaagccgggcgtgtttttggatgccatcaatgatgctaacctcctggaagcatgtatctaccgcccgctgaag

SEQ ID NO: 642625 - DNA, 502 bp, Homo sapiens
cgcagggggtttctgtgagggggcaggcggaggttgaggaacccgcagataagttttttcctcttgggaagatagagcttaatacaactacttcaaaaatatagtcaataggttactaagatatggcttagcgtcaagttttacacgtaattttaatagcttaagatttcaggagaacatatgaaagacttagaagagtacgcatgaggaaggacacagactaaagtgttcctacaaaacatgacggaggttgagactgaacgcttcttcagtggcgtacaacacgtgttttaacagacaaccttgagagacgggactacaagagccccgaattaataccaatagaagggcaaggctttaagattaacaatgaaggtgacttaaacggtcttaaaagttacgttcaacaagtggtaggtgattaaacataattggaaggcgatcttttaaaaaggagattaaacggaaggtgttaaaaagaccttgaaatccatgaggcagg

SEQ ID NO: 642626 - DNA, 320 bp, Homo sapiens
aagctgattgcaaatcaaactctcactgagaatccatcatatcttcagcctcacttttgtttattttcacaaccttaagctagtagcttccaaattctattctgtaatactcttgagctccaactctgatctttcagggaaatctatttttattcagtttgtttcttgggatcacaggtaagagttctttgggaaaggattctcactggagaagaaattgaaaataacattaaaaaaaaataaataaaatactttctgcagttaaagaaaactctaaaaagctaaaaatagttaaattcagaagaaatgatttacaacgt

SEQ ID NO: 642627 - DNA, 968 bp, Homo sapiens
gcgccatagagctgcgtgctcgggcggtgccgccctgcggcggaccggcccgattctcggcccccggtgtggcaatgctccccggtgggcgcgggtatgacgccagccgatcctgaactgtgtaccatgctcgcactagtgactcgtgccggtccgggtcatgggagaactccagtggcgggtcatcagtgggtctcggcgggccaaattgagcgtgcgtgacattttcgcttccaattgtaggcctacggtggagcgccatgaatgaatgaaccttggccgatctgggatcaatgcctttgtgacggcctggagtcatcccgggatggtgagtcgcatggctttcctgtactaggtggctggaccactgtggacaaacgaaaacttgatgtgcaaaagaatgcccaaactgccgtgcaccgaaggcgttgctccggtgcatttgggtagggcctgcccgaccctggggcccgacgggttggttgggccctttccagaggcagcagcatgatgtaaggtgccataggacatcccgtttccatgggctggctagctggacaaagcagttgaggacaccgctatcagtcacggcttgggtgcccggagttgggaggcctgaggtggtggcccagagaagggcttggctccaattggtaattgagagaaacttgaagctggaaccttgtagttgcctcgcagccaaaaagaaaacggaccgaaccaggaacgccggttgggggttagacttggttggcccctttaccattgggaaacgaggtagggggcggccagggcatcaatagtagacagacacactaaacccattatggggagaccattgcacattatggcaccccccaaagagggcacgttcagatgacgccacagtagtagaacagcagagaggaatgaaattaggagaaagcagagagaccgcttgcacgattggcataggacagacgaccagg

SEQ ID NO: 642628 - DNA, 220 bp, Homo sapiens
ggggggggcccccccgggcccccccccggggggggggcctttccccctttttccccctgggggggggggcccccttttttttccccctggggcccccctaaaaggggggggggggggccccccgggggggttttttggcccccccttttcttgggggggccccccccttgggggggggggggggttttttttctttttaattccccccggggccccccca

SEQ ID NO: 642629 - DNA, 156 bp, Homo sapiens
cacgaggtgcactctcattgacacgtttgatgaacatgacggcccattgagatgcattgacttccataatcaccacccactgttcgtctctggaggagatgacaataccactaaggtttggaattacaagcttcggcgctgtcttttcacattgct

SEQ ID NO: 642630 - DNA, 116 bp, Homo sapiens
gcgcataacatcttttatcgaaactttttctgcagtcgaatgcgttctctctctttctgtttggcactcttaggcaggatctgcaggttgaactgcaacatgttccgacgatcttt

SEQ ID NO: 642631 - DNA, 188 bp, Homo sapiens
ttatcgatgccacctaggattcatatttaaactatgtaaaatcaaacatgaacaaatttggaaagaagccagaaaaaacctcccaacaccaacacctgtgcctggtagctggaaccaatgatagagaatgacatccacctctctctcagagaaccatgtgtctggagagaaggtggcatcgataaaca

SEQ ID NO: 642632 - DNA, 131 bp, Homo sapiens
  misc_feature (9)..(9): n is a, c, g, or t
  misc_feature (19)..(19): n is a, c, g, or t
  misc_feature (44)..(44): n is a, c, g, or t
  misc_feature (70)..(70): n is a, c, g, or t
  misc_feature (106)..(106): n is a, c, g, or t
cactccagncctgttcccncaactggggaggtaggctgggagcnaaaggagagggtgggccccagttttncgtggttggtttttattaattatctggataacagcnaaaaaactgaaaataaagagagaga

SEQ ID NO: 642633 - DNA, 159 bp, Homo sapiens
gttacgtagggtatctgcgtagtgaactacctgtggccagaaataccgtggcggctttcatgatttcaccatcatggtgcgactggcattcacgtgttccctgcgcctcgtagctggcctgcgcatctgcggtggttataacctgtcacaacgtatgag

SEQ ID NO: 642634 - DNA, 427 bp, Homo sapiens
aattagctggagtaggagtctgggagtggagacccagggaaacagcatgagttcacaggtgcttactcaggaagtcaggacatttttggcctttggcttaacttccagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacgaagcgcttcccattttgaactttctgtcctcacagattctgtttgacagaatctaagggccatcagggaactcttttcatcttgcaaagagaaaaagccagtctttccagaataaatattcatctgtttgaaataaa

SEQ ID NO: 642635 - DNA, 528 bp, Homo sapiens
tcggaccgtccttcatcatacctaccaagggagaggatttcggagtaccagaaaatggaaacctggccgggcgtggtggctcacgcgtgtaatccgagcacttcgggaggctgaggcggggcggatcacctgaggtcaggagttcgagaccagcctgaccaacatggagaaaccctgtctctactggaaatacaaaatattagccggtgtggtggtgcatgcttataatcccagctactcaggaggctgaggcaagaaaatcacttgaaccccgtccttcatcatacctacctatcttcttcttagttcttcctttcttcttccttcttctttcttcctcttcttccttctttacttcttttctttttcttcttcttccttattcttcttcctctttcttcatctttttctttcttctttccttctactttttcttcttcttctttcctctgtcttcttcttccttctcctcctttcttcttcttattcttctccttcttccttctccttctttttcttcttccgtct

SEQ ID NO: 642636 - DNA, 941 bp, Homo sapiens
ggaagaagccgagcggactgtggggcctgctcagcgtgcgggagtgaggcgatagctgcggtggcgacagcgcgggctgggatgaaccgctgatggctgagtgcagcgtgaggtgccggctgcgcgggcccagtgagactccctcgaatgcggcatgccacctgttctggggctttgcctctgagccagagccctgcccccgcgagcctcccggaccctttgtgcggccggaggctggggctgggaacggcatggctggcaaatgtacctgggtgggagattacgtctatttttgagaactcttccagcaatccttacctggttagacggctcgcggagctcaacaatgactgcacaatggcacaatgtggaggcaaaggtcgtctgtcttttccggcgcagggacatacctagtagcctcaacagcctggctgatagtaatgccagtgagtttcgacgcggcactccaagcagccaggggtgtcctgaggcagcagcgccatcaactgaagcaccggcgaactttgctttctcggccagtttgaatcattaccagccacccacataccgggggaccatgcagtgtgaccgtcttgaatgagacagatatcttgagccaggtactggaaaaggaggactgctatgtctatcagatggtgtttgaccccgtgcacgaggacagttctcgcttgatcagggcgaagattagagttgttttgaagataccgaggcgtgagattcgcgagattcggactacgtagacgggaagaactcttgaattaatgtggaaacacggacgaacgactggacgaatgagaggagtctgtgtaaccaaggaagaagatgtgctaaaggaacggagaaaaatggcaacaggatatgttgagtgaggggcactgacgattatggcggaaacatttggacagagagcttagatttga

SEQ ID NO: 642637 - DNA, 548 bp, Homo sapiens
gatggccacatagtctcgtgggacattgtattcttcagctaatctataaaatgatgtttatttttaactgagctgtgtttgccacactcatcactgcacaaactgtgagcgcatggcttgggaattttgccagcaagtgcatgtgacaacatggccaggatgttgacgccaccgagggaggcacagcctttcgcccacccaacccctaccccccagatcgctagtccttcttcctccatggctccgttttaagcgggcacatttcacagattaaagactacatttcccagcctcccttgcagtgaggtgggtcgtatgactacgttctagccaatgggatgtgagcagctgtggcaacacaacttttgggaggcatccttgaagaagaggccctgcctcctttctgctggctggagtgcagatgtgatggctggatctggggtgccattttgagccatgtgaacgaaaagcctatccatgaagtctggggctccctggccacccatcccagcttcattgggctgagaagtacactgtgttttgacacc

SEQ ID NO: 642638 - DNA, 385 bp, Homo sapiens
  misc_feature (13)..(13): n is a, c, g, or t
  misc_feature (385)..(385): n is a, c, g, or t
cacaatggatatnataaaactacacggagggactccagccaactttcttgatgttggtggaggcgccacagtccagcaagtaacagaagcgtttaaactcatcacttcagataaaaaggtgcaggctattctggtcaacatttttggaggaatcatgagatgtgatgttattgcacaaggaatagtcatggcagtaaaggatttagaaatcagaatacctgttgtggtgcggttacaaggtacacgagttgatgatgctaaggcactaatagcagacagtggtcttaaaatccttgcttgtgatgatttggatgaagctgctaaaatggttgtaaagctctctgaaatagtgaccttagccaaagaagccccatgtggatggtgn

SEQ ID NO: 642639 - DNA, 234 bp, Homo sapiens
gactctacaggatcttagtacatggcccgtgggtggggttcttttaatgccttctcctataaatgggggttagtattgatagttagctggtgtgtgtcgtggtgtgttattattctgaactttgggggaggttatatgggtgtaatagttcttttaatttatttagtggggaatgatggtcgtctctatggatatactacagctcatggctcattgagtgcagtatcctgcagg

SEQ ID NO: 642640 - DNA, 845 bp, Homo sapiens
gctcccctctcttctgtgccgagttgatggtgctcgtgcgaacaaagtggccgtgctcaacccatcccccccggggtgttccagaccatattaggcttttatcagccccccgcgtaaagcctgtcaggacacgctgaagcgttttcccttaggtcaacccgacgggaaaaataccctgtgcccccctatgcgaacaccgtagttggagcgcgctcccggttacctcggcccactaattgggaacaaggagcccatgtatcgtccctgtcgacgaagtacagaggcaccccttatggtatgggcaccgctgaagcatttccccccccgtattttggccccaggagcccaattcgcgccacagctgtccccccagaataccccagattagacccggaccccatgtgccaggaaacgtcctgccactgtcacccaataactgtacaacgggagaatttaaacccattcaccccattgtcgccactatgccacttaatataaagcatatggaatatcttatataggagttaactcttaccccaaaggagggaggaaaatgggtgtacacccccccaaacaccgcctggtggagtgaaaattatcggaagatatttaatacatggaacaaataacaccccgtttttcactggagttgtgaaaactaaacagttggtagatattcaccttcttccccaagggaaacttaacagcgatgccactccctattcgaacactttcgcaaaaccctttctttgtctgcaggaagattacatacaaagtaatcctcaaactacagtggggtaatcgtccaatgaagccccccaacattcaccaaaccattttgagaa

SEQ ID NO: 642641 - DNA, 457 bp, Homo sapiens
tcttatcactctttttgctctgttctttgcagtagtatgtcccctgagcacttgctttggcctcaccatgtcttctattagttcacaggtgcttactcaggaagtcaggacatttttggcctttggcttaacttccagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacgaagcgcttcccattttgaactttctgtcctcacagattctgtttgacagaatctaagggccatcagggaactcttttcatcttgcaaagagaaaaagccagtctttccagaataaatattcatctgtttgaaataaa

SEQ ID NO: 642642 - DNA, 151 bp, Homo sapiens
cccttgccctttttcccttttatttggggggaatggggggaaatgggaaccgggaggtgggaggtggattttggttatttttttagcccatttcccggggggggaatttttttttaatatgtgtcctgaataaagttttttttggaaatta

SEQ ID NO: 642643 - DNA, 386 bp, Homo sapiens
tatttatgtttttaactttaagtcaggagtacatatgtaagatgtgttagtttgttgcataagtaaacatgtgtcatgggtgtttgttgtacagattatttcatcccccaggtattaagcctagtatccattaggtttttcctggtcctctccctcttcccacctttcaccctccagtaggccccagtgtgcactgttcccctctatgtgtccatatgttctcatcatttagctcctacatataagtgagaacatgcagtatttggtttcctgttcctgcattactttgctaaggataatggcctccagctccatccatgtccctgcaaaagacatgatctcattcttttttgatggctgcatagtattccatggtagaaccgact

SEQ ID NO: 642644 - DNA, 655 bp, Homo sapiens
agcggagtcgccgccgacgcggttcctcgcctgcctggccactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcagtcatggtctgtgctaccgccgctcccacacagctcgtgctttggactgtgtcctcagtctccttccagagtgaccaatcgagacggtcaacaatctggagctcacttcctgcgccaacctggtgacggggacgagctccgccaccagtgtccgcggtccttgaggctcagagcggggtatcccagcgcgggcaagggaccggtccaaggtgccccacggggcctgcacgccgtgcatgtcgccgggggtcctgcggctggccttgatgcaacgctgcccagccagcaggtacttcctgtggcaggctcctgggcgctaggccgaggcggcccctggctatccgtagcggagcacgtaccactaggccagctgctaggtctttcctgcttgcccgccttgcctcgtaccccttcgacgtc

SEQ ID NO: 642645 - DNA, 258 bp, Homo sapiens
gtggctatgtataagcagatattatctagtaaatgtaaagtgaacccaatcgatagacccaaaaagtgttttaactggaaaacaccttatgaggtttattttgatgaagtgttgcagttggtttgataattcaaggcattaaggcaatatctcaatcaccgcattttccacaaccggccacaaaacagctcgtctatttcgaggtcagttacggcgtccagtctttgagcagatgatttgccccgagtgatcgtcggc

SEQ ID NO: 642646 - DNA, 119 bp, Homo sapiens
gctcgaattcaagcttctaacgatgtacggggacatgatgtcctttcttttctgactttccagttgactgaacctggaaaaaagccgcccacaccagataaagaaatttcggaaaaaaa

SEQ ID NO: 642647 - DNA, 405 bp, Homo sapiens
  misc_feature (34)..(34): n is a, c, g, or t
  misc_feature (362)..(363): n is a, c, g, or t
  misc_feature (398)..(399): n is a, c, g, or t
  misc_feature (401)..(402): n is a, c, g, or t
cggttaccccctggcagaagaagaagcctagttnagtgtatttcaggatagggcccaagggaagctgtcatttctcctactaagtcctcattgtggaaaagcccacaaatgtcccctagtacagtaataaggaaaaaaaggctgagcgtggtggctcacacctgtagtccccaggactttcggaaggattgcttgagccccaggagttgcagatcggcccaggacaatataagaaaaccccatgtattagaaaaaaagaattagccaggcgtgatggtgtgggtctgtagtctcagcttgggaggctgaggtggcaggatcgcatatagcccaggagttcgaggctgcagtgagccatgatnncatcactgcaccctagtctgggcaacagagtctcnnannatt

SEQ ID NO: 642648 - DNA, 344 bp, Homo sapiens
gacagagctcagcattcatcagaccgagatgcgcggtatctgccttccggtagacaccgtagggcatcaagttactaatagtccaggtacctcgagacgtccatcttggctcgagcttgcattaacacttggcaatggtccataaacagcgcgtccttaccagtaggataaaaggatcgtcggaattcttgtgcaaggcatgagccttaatgatgttgggcacggccgagatgtcatcagatcaatacgtcaatgcgggcctaagaatggcccagggtggtatgagaagggatctgcgcctggtgtcagtcccagagttcgtctctaagtttgcggcagtccac

SEQ ID NO: 642649 - DNA, 150 bp, Homo sapiens
agctttgtgctagtcctctctggtgctgtgtccggcctggctgtagggcgacgggcaccatggatgcattgtgtctggggctgagcaggacttgcggttgcctgggccctttgagcctggatgcctcctggaggtgtgactcctgcgtct

SEQ ID NO: 642650 - DNA, 293 bp, Homo sapiens
  misc_feature (109)..(109): n is a, c, g, or t
  misc_feature (184)..(184): n is a, c, g, or t
gtaagtattaaggctagtcttatctactgtgcaaaggttcttataagtttgaaaatctagctcttgcaggccgggcacggtggcccacacctgtaatcccagcactttnggaagccaagccgggaggatcacctgaggtcgggagtttgagaccagcctgatcaacatggagaaagcccatctntactaaaaaaaaaatacaaaattagccagtcgtggtggtgcatgcctgtaatcccagctactcaggaggctgaggcaggagaatcgcttgaacctgggaggcggaggtt

SEQ ID NO: 642651 - DNA, 1050 bp, Homo sapiens
  misc_feature (288)..(288): n is a, c, g, or t
gacggagctcgtagtttcccggacgggcgctcccggctcgtggctcgcttccccaatacaatcccacgggcagcgggcgcggtccccgtaccccaccagtgccgggcagggcacgccacctttcgcggtcgggcccgcgggggggggaacccggcgccgaccgggccggaaacgcatggcggaacgtgtccggggctaacaagaccaacggggcgggggagcagcgggctcaaatattcggctgcctcttaattcccgcatccgggtcaactcatgcaggaagcttcnccccagaagggtggttccagcaatcaacgtcaggaaggcgtgggtgcacacggcccaagggccacacggacgcctctgggtccaagtgcctttaggccaaccttattttccgtacaggacaacggggaacggtggggacacgcggcaacacggaacccgctcgtggcaccttaacagggggtttgtacgctaaaaccaagtgggccacagcacagcacacggacaccgttttcccagtgtttgtggcaagattattattcacccaaacggacagaatttagcgtaacgtgaacattaccctgtgacaacttgcttaagcggcggaccacacggggggcaacgaacggattgacggcagcttggccagtggtttatttgacaggtggaccattgcatgacaacctgactcctctacacaccacagatggtgctttaccacacactgctgggaggagtaccgtctggaccaatctcccagtggttctatagtacacaacgcaatggccggtttagggatttagttctcaacaggaggtccagggggggaatctagcaggggtactaccagccgagattggatactattgtccatgcactgaatggcgaggataagctccagaaggtgcttcttgaaggtcacccgtagtatgatacgagaacagcgattgcgctctggatcacaggacgagcaataaatatttacagattcacgtaaatgcggcgaatcatatggcatctacgcccgacgtcaattctacgtca

SEQ ID NO: 642652 - DNA, 295 bp, Homo sapiens
gtggcaacagctcagcccattcaaagagcaaggattcaggaaaggcacactgatggtggggagcctcttagagcctctaatgttctccaaaacagagttgagagtcggagtccagtcgtcgggcccactattcctgaataaggacatgcagggccagagtagcttgactctcgcctaaatatctgtgcctttgctgtctttctccactctactgaaccggacagatcccgcttgcttctgatgaggaggtagtaagaggttggaggaaaagcacagagcagctcgggtagagagg

SEQ ID NO: 642653 - DNA, 364 bp, Homo sapiens
tagttcttacataacagccttttattttattttgttttatttatttatttatttatttttgagacagagtttcgctcttgttgcccaggctggagtgcaatggcgtgatcacggttcactgcaacctccgcctcccggttcaagcgattctcctgcctcagcctcccgagtagctgggattacaggcgcccagcaccacgcctggctaattttgtattcttagtagagatagggtttcttcatgttggtcaggctggtctcgaactcctgacctcaggtgatccgcctgccttggctcccaaagtgctgggattacaggcatgagcactgcacccagcctacataacagcttaatcaactgttc

SEQ ID NO: 642654 - DNA, 244 bp, Homo sapiens
tctgatagacttacgggcgggtatggactaagtaaagtttctatactgttaggaatgggcaaaacattcagatattggataactgaagatgggtttaagaaacccagatatcggctgggtgcagtggctcatgcctgtaatcccagcagttggggaggctgaggcaggaggatcacctgaggtcagcagatcaagatcagcctggccaacatggtgaaaccccatgtctactaaaaatacagaa

SEQ ID NO: 642655 - DNA, 1199 bp, Homo sapiens
gttgtgtactgtgtttgagtcgaatatatgttttgtattaacggttggtgtgcttgtattttttgtgttcgattgatgttgagtgttgttaagatgatgtcttgtagcgttgattgtgagttttatgtttttttgtatgtggatgttgtgtataatattggttgtatgtttctgtagaggagtgagagagatggttagtagaagagtgatactatcagaatgtcttttggtttagctatttgttatagtagtattgtgtgtaggaagatggttttatgagtattgttgtgcagtgggtgggtgttgtgttgccttttaggtggttctgtttaccgcggatggttttggagatcctaaggttgctgatgggcagtcttactagtgtggctaagcgggtggttattgcttgcaagctgcttcaacaggatatattactagtacttagacctctcgaggaagtacaccgcttgcgagatgtatgttcttagaggtttggcattagctcgcactagcaattatgttcgttcaccagactttaaatggattaacgttcttatggctctttaagcagtccactcatctactcattcttcgagtctacacttattgaatgcctgctaagatctgaagtatcacgatttatttgtctttggatcaccacctatgacatagtaaacttgaagaatataaactaccctcagaaatatttttaaaagaagtagcaaattatcttcagtataatccatggtaatgtatgcagtaattcaaattgatctctctctcaataggtttcttaacaatctaaacttgaaacatcaatgttaattctcttggaactattgggatttgtgacgctctcgtctgctagtttaccgcataccaagtatttgaaaatatagtagtaatcaactgaaatgtttcacattcgcgttgttagtagtgtaatcatcaatgaatggacttgcttaagctgattacgcccacctgtgggaacacaaagttaggattcgctacgtttgttggactctctttcctgacttttaacaatattaccatcccattctctgccctgtgattttttcttaaaagcttattcaatgtgtctgcagcattgtgattgtatgctggaaatcacctgcttttagaatgctctttctcatgatgacggcgcataattgttgaaattccgcggggggttt

SEQ ID NO: 642656 - DNA, 370 bp, Homo sapiens
gaggtacccgagcccccggggtataggtgacagtgcctcccagctgcgtccaggttacggataaggctagctagagcgcctagtacatatggcactgctggatcagctaggccaggttctcctacactacacaccattccgaaggagagatagtacgagcagcatgacccggatcttgtcgtcggcagagcaccgcacgacgtccaggagcaccggaacgatcgagctacatggagtccttgatctatctccccctctgcgtcggaacccatggccaggtacctgctccacactacacagattactaccaccgagcccttgaagtgcttcatacaatacatctgctagatgacaggtgcggtaacatact

SEQ ID NO: 642657 - DNA, 640 bp, Homo sapiens
cgcggatggatcacggcctggtaatcccagctctcagggaggctaagaggcgggaggatagcttgagcccagagagttgcgagacctgccgtgggcaatatagcgagaccccagttcctccgaaagaaagagaaaaaagaaacagaaaataagaacaaaacttgtgtggagggcgcgcgtccttgggaggcttccggaaaaaaggtgttcttaaacacaccatatgtgcggttgagggggcgaggggggccccaatttgaggagtaaaggagcaccaccgtgggcgccgcatacacgcggggtcaccccaacaagagagagagaacacgcggggggacacagagagaccagaagagcgcgcggggggggatgtctcccacacccatatactcaaaaaaaaaagcgcgccggggggggggcaccaccgacgaagagcgttctcgtagcaaaccaaactttctcacaagagattgggagagcagctctcaatgggaaagggtcacaatttagccgggggggccctctctattttcaaccacagggggaggagtcttacacagagggcgagaaacactgaagagaattttttcaacattttatacgcgccccgagagtcgatgggggtggggagcacgagaac

SEQ ID NO: 642658 - DNA, 938 bp, Homo sapiens
  misc_feature (1)..(1): n is a, c, g, or t
  misc_feature (194)..(194): n is a, c, g, or t
  misc_feature (196)..(196): n is a, c, g, or t
  misc_feature (233)..(233): n is a, c, g, or t
  misc_feature (236)..(236): n is a, c, g, or t
  misc_feature (239)..(239): n is a, c, g, or t
  misc_feature (298)..(298): n is a, c, g, or t
  misc_feature (611)..(611): n is a, c, g, or t
  misc_feature (620)..(620): n is a, c, g, or t
  misc_feature (631)..(631): n is a, c, g, or t
  misc_feature (645)..(645): n is a, c, g, or t
  misc_feature (676)..(676): n is a, c, g, or t
  misc_feature (830)..(830): n is a, c, g, or t
  misc_feature (877)..(877): n is a, c, g, or t
  misc_feature (924)..(924): n is a, c, g, or t
ntagtgattcttcatcttacataggagcacaataaaatacaccacaatctgaagaaactccagaattacgggagtaggggtggggaaaattcaaatgggctacaatatccattaccttaaactgcaagagacaaggttgcgacccgaggttaacatttatgtatttatgactggctacatttatgacttaaaantnacagggatcggggattggatatgggggggggtggggnggngcngttttgtgggggggggggttcgtcagtaaggggggaaaattactgggttccaaattggngggtaagacgggctcccacggcggatactgggggggtgggggcgggggtcattagctgggggcttggtactctcgggggggtgggcctttctggtggcgcgcgggctgggtggttggggtctgctcgtcgggtttgtggggggggctcgcgagtgcctcggcgggtcccgggtggtcgggtcggtgtttcttggcgcgcgtggggggttgcgggtggggttttcgggtggggccggggggggtgtcgtggcccgggttttgggcggggggtgtggcgcggctgtgggggtcctgcgtgtcggtcgcggctgcngtctttgcngtggctttccngtgcggtggttttngggcgttgtggcggggcgccggtgatcgtcnggtcggacaacacaaacacatttatttcaaattcctagaaggttaaaaaaaggtcagatactgatgctttatgcatgctcagggccagtttataaatactccattcagtactatcttaacacaaatctgcatcagtgaaaagaaactggcaaantccacctcttgccattcaatttgtcagatggtgaagaccaagaaagnatgttccatcagtttcattttttaaatacgattgtcaattggggaantgaatgaacacagt

SEQ ID NO: 642659 - DNA, 274 bp, Homo sapiens
tctcagaaggctaccttactttcttgaacacacatgcattatgcagcagtaagaggacacggcgagaggcaggacggctgttgccgtgggcacggtttctggtcctggcccttccgtgctcctgaggccccttcctatgggtgccagcgaacttctttctagggtggcctttcccactgtggagtggcagagcccacacagtgctggatcacacagtagaaatgtgaaggccaggattgggcaagggtcattttcaaagtgctaggataagtag

SEQ ID NO: 642660 - DNA, 326 bp, Homo sapiens
agaggaccaactctttaatttttagtaaaacctggaggtgatgggccgggcgcagtggctcacgcctgtaatcccaacaccttaggagtccgaggtgggtggatcacgaggtcaggagatccagcccatcctggccaacatggtgaaaccccatctctactaaaaatacaaaaattagccgggcgtggtgacacgtgcctgtagtcccagctactcgggaggctgaggcaggagaatcacttgaacctgggaggcggaggttgcagtgagctaagatcacgccactgcactccagcctgcggacagaccaagacttcatccccccc

SEQ ID NO: 642661 - DNA, 394 bp, Homo sapiens
  misc_feature (382)..(382): n is a, c, g, or t
gatattttgttggattctgttagccagtattttgttaaggattttagcatctatgttcagcaaggatatcagtctgtagttttcttttttggttatgtcctttcctggttttggtattagggtgaggctagcttcatagaatgaattagggaggctttcttctttctctgtcttgtggaatagcgtcgaattctgctgtgaatccatctggtcctggacttcttttgttggtaatttttaaattaagatttcaatcacactgcttgttattggtctgttcagggtatctaattcttcctgatttaagctaggaggattgtatttttccaggaatttatccatgtcttctaggttttctagtttatgtgtgtaaaaggtgttncatagtagcctt

SEQ ID NO: 642662 - DNA, 407 bp, Homo sapiens
gggtccccggaaattcggccattatggccggttggttttaaaggtttttgccaggtttttggaatttaaacctggattagccggatttaaggtttttattaaaacggggcattccgatttatgcattcccattccattggtggttcccgagggtcctagggaagggcacttttttgaagctggggggttaatcctatgtattaaagggttaactttaaaaggaggctgttgccatcctttggggaggctgtttttggttaggggcagtagggcctccgtttcctagggataaggctccaggtttatgaccggttaaatcagcattcattttaggaaaggcacctttagtttcaaggatccttttaagcttttaaatggaccatttaacctattcctttaaataggac

SEQ ID NO: 642663 - DNA, 109 bp, Homo sapiens
aatgccccgatatttatatccgccagattcgagtacctcccatcctccccctcctctttctgtctaatcaatcctctcttaattaaatggctattcctaatctctttct

SEQ ID NO: 642664 - DNA, 177 bp, Homo sapiens
agataaacgtcctctatcaccatttggagtctcccttttctccaggatcttgatcctggtccccaaaaccagagtgaatcaaaagagcttcctcccctgaggcaaagtggatttgtaagcagttctgaaacatcacttactcaaaagagggaacgatgtattttgatgagtgcaaat

SEQ ID NO: 642665 - DNA, 611 bp, Homo sapiens
tttggggcaaaatcctggcaatcgagagctttccttcaaaccaaaccggtcctggccaatcttgccccgaggccccaaggtgggcacccccccccaagggctcccccgtgttctatgttacgcccacgcccccggaccctgttaggcttgtaggcaccacaccctctgcgtgtttgcgcccaactcacaaaataggccctgacaatttctttggaggcccctctgatcccgcctttggggcccgcgatctcgcgacagcctcgccccaagagtaccccctctggtcgagtcgcgggacacacactcttgagaaaaacttttgacactttgctgttttcatgttgtcttacacgacgccaccgtctcacacttcctctctgctagtgctctctcagggagaccgtcacccccgcccacacccgccttcttgttgtgcaccacctgacgacctccaaatatcttgcggttcttccggcccatgttccctctgtggcggcgcccaagtgtttgtcactctttgttcccctccaccaccacggatgttgggtgtgccagagagagttaatatttcataggaatatatagcggaataatacaaaaacagaacaaat

SEQ ID NO: 642666 - DNA, 114 bp, Homo sapiens
cggggtctcattactgagtatttttctcgggaaatcctggtaatcttgaaggaagggacctcaaaattatgggcatcgtcaaagcatggtgggtggtctttttttactggcggc

SEQ ID NO: 642667 - DNA, 139 bp, Homo sapiens
actcacgcctgtatccaacactattggaaggctgaggcaggaggatcacttaagcccaggagtacaagaccaggctggggaacatagggagacctcatctctagaaactcacaggtcgcatagcgcctgtggtctcaga

SEQ ID NO: 642668 - DNA, 707 bp, Homo sapiens
  misc_feature (33)..(33): n is a, c, g, or t
  misc_feature (37)..(37): n is a, c, g, or t
  misc_feature (103)..(103): n is a, c, g, or t
  misc_feature (115)..(115): n is a, c, g, or t
  misc_feature (489)..(489): n is a, c, g, or t
  misc_feature (567)..(567): n is a, c, g, or t
ccgggtaagaaatgggggtggagtctcacggangtcncccagactcgaggtggttgctacacaggcttgatcattagtaccccacagcttaaacccccggggnttcagtgatccntcctgcctcagcctcagaaccacaggaacatgccacattgcccagctttgattttaatccaaaattatcccttaacttcccacaactaaaggtactctaaataaacatcagttcctgccctgatatgaccccaaatgaacctctatcagacactgctgatgctgtagagtgcgctgtccaaagctagaggtgcactagccacatgcagaccttgcctgtgtgaggcccacagtactgcatatgaccctggctgccagcaacttgccaggttggctggggagggtagacaagttaaaagcccatgtttaggactctggtaattaataactagaaactattacaggaaaacatgatggggatgctctcctggcttnggggtgggtcaatgaggtttctacaggaagtgatgtagaatgcgacctagaagatgagttaggcttagcaacgaaaanggggttggaagaagagtggatcatgcaaagacagaatattggcaaaggccttcaggcaaaagacaggtgcttgctcctggaattgaaaaaaaggtaaatgtacttgaagaatagtatgaggagtgacaaaaaccaaggtt

SEQ ID NO: 642669 - DNA, 360 bp, Homo sapiens
cgtgctcgaggggagcgaggccgctccaggaggtgggtgcccgcagaggggcggcgagggctgccgggacggttcacgcagcggccagcagactggctgcgtgttgcaatgtctggtggcgtttgcagcatcctgtccgtgtgtgcagctggggtaacctcgggccggcggaggagcgcgtgtggctcgtaggccctgcggccggaggctgctggcaccttgcatctcatttacagctccgggttcagccacaggtcagcggcgcccgtgacatcacggcgtctgtttacccgacgggtctgggcaagaagcggacggtcccggagcgggagggggaccccagcagctcgcccctgagtt

SEQ ID NO: 642670 - DNA, 208 bp, Homo sapiens
aggagcagctgctagacaaactatcccactgaaatggaagggtgaggagcacccggtcctatgtattcaaaatgtgagagggatggcacgtgctcccctaaatgtctgtgagtaacagaggatatgtggaattcagccatttccaccacacaacaccttgctgccaagcacagccagctggtctgtgttccccaaagtgatccttctg

SEQ ID NO: 642671 - DNA, 1375 bp, Homo sapiens
tgggtgttgtttttagtgtgttgttgctgacgtagatggattttggtgcttcctgtattgtctgtggtttctttgtgtctgccttttggtctggtttgtgtgtggtcctttttgttcctggttttgctggtttgtctcattccttttatggttgtctttgtcgtgggggtgttttgttgctgatctgtttgtgttgtccttgctcctctttttggtcttgttgtgttttgtgcttagtgctttgtggtttcatttcaatctctggtgcctgtgggccgcatgtgggtcttgcttgcttcgcagtcctggtggtcctcttgctctggccggttgttcatatgtgttctggttgtgtggtgtccatctgggaccggtgaatgggccgcttagttgtgtgggtcgtgtgccatttgtggggtgttagtgcaccaggctgttcatgcgttatagatgtatgtgtcctttcgcccgtgggtcattggccgggcttgtcgtggtctcttcgtgaggctatcgttgtggtcgtcgtgtgtagggctatgtccactggttgtgtgtatgatcccgtatgggttgtggcgccttatggtgcattgtgggctctgtttggctgcatgctgtgggggccccgtcgtaggggcttgtgtgtcatgttcgtggtgggcatctggatacgtgctgtcctttgctcgcgtggtggtatggtgtggtgccctgggtcatggcccgggacgtgggcatgcgccgtgatggcgcggtactgtgctccttgtgtgccggtggctgcccgtggcaggtgtccgccatggcagcagggttgttagccctgtctcgctgcgtgcggcggcggtgctccatgttgacctctgtgtaggctgttcccgcgctgtgcctacaggatatcgcttcgctgaggcgcgtggggtatcgtgtatcggggcagtgtgccagcctggtactcctatgtctgctaggcccctcccttgacttcgcgtgcagctctccgtctaagtatctgtttgtctgtgtcggctggtaccgccagtgtcggcccgttggtttggtgcagtcgtggcctctgggaaagggtgtacgtgcagctgtttgatctcctagaaatagctcccagaaacccacagttttgatcaagcaaacccaggatgtaatagccctgtcttacggtctggtagttcatacagccagcagactcagctcttggctgcgggcgatgcccagggcacagtgaaggtgtggcagctgagcacagagttcacggatatcatagggtccccgggaagactgaggacctggactgcctggctagcagtagtgtgcggcctgaggggtcccggtaaactgcggtgggagccttgcg

SEQ ID NO: 642672 - DNA, 314 bp, Homo sapiens
acaaactgcccccactgtcaccttgtgttaccatttactcgctatatgagggagcctttatgcaattatagttttctttacgtagagcctatacatttatagatttgatattctttgttacttatagcttttttgttagctattgaaacgtgaccttccattataagtcgcatattatctgcatataaaaagtgattgacttcacatactttgtaaatggcagccttaagtgaatttactgtgtttttggaacagcattttagtattttttccgaagatggccatagtatctgcaggtaatgaagactttctca

SEQ ID NO: 642673 - DNA, 445 bp, Homo sapiens
cagatgatgactgcaaagcgaaggcctaccgggcagctggcgatgcccgttctcttgatctctctcttatcgcgcgcgcactctctctgaaacactcccctgcgtacccgggttctggcaaacaccaattgattgactgataatctgataaagcaacaaaagatttgtcccaagctgcatgattgctctttctccttctctcctgagcctctctccatgcccctcatctcttccttttgtcctcgcgtctctcatccacgtcttccaaggcctgatgcattcataaattgaaaccctccccatatccccttggggagcctatgcccttcttcagcccggatggcttctccttcatttagggttgaaaccatcttgtttgtcatctttatttcggctgctagggtgggttccaatccctttccccgggaccttcttgggagggaca

SEQ ID NO: 642674 - DNA, 264 bp, Homo sapiens
  misc_feature (79)..(79): n is a, c, g, or t
  misc_feature (97)..(97): n is a, c, g, or t
  misc_feature (107)..(107): n is a, c, g, or t
tactactacattcgcggccgcgtcgaccagaatttgagtgatgtgtttgattggttctctcaaatgtatggatatgaanaatccaacagtagtaatnggaagggggncggagctcggggcctgtgtggttgtccataagtcagaaagacatggaggagaaccaaccagtaaaatcacagacttccttcattataaacacatcgtgctgacaacatcaaagagccactccaagctctaacatccgaaggaggactttgagagtta

SEQ ID NO: 642675 - DNA, 701 bp, Homo sapiens
ctgtgagaaaggatataggtccccaatgcccccccaaccaccttagggcctcgtcgtatctatatatgtccccccgctcccgttaaacttggggttaaccccccccctctcttggagaaatgcggggtgagaaatttccgacagacaaccgcggcgggctaatatcgtctgaaaaagatatgtttgtatcacgtgagacagtatctcacatctacatgtgtgcgagaaacacaatacaaatttgtatataaacaaaccaccatcactaaaaatgtatactcttctgctatataactccccaccctcctcttattaggatgtgtgtataaaaaataatatgttgcctgcacccgccgtaatacacacaccatcttgttttataagagaagggagacagagaaaacacaccacatggggttccgaattgacccacatataccactcgatacacatcttctttcaaagatttttccaccactacttttgttttttacgcctctctccctcatttctctaccactcttggtgataatggcgaaacttatagttgcactctctaaggtatgtaacaggtagagccgctattgaagccgcaccacacacactacaactttttccctcggactgcgtctctcagaagaaagctgcaatgttcccacgttagccccccttcgctgaaaataaaaatccaccaaaatcca

SEQ ID NO: 642676 - DNA, 137 bp, Homo sapiens
actagcactaatacaaaaagggacacagcatcaagcagcagcaatgcagccccaaacgcttagcctagccacacccttacctgcccattttactaccccaggcagcaatgtgctattgaaacttctaacaactcagg

SEQ ID NO: 642677 - DNA, 1523 bp, Homo sapiens
  misc_feature (77)..(77): n is a, c, g, or t
ctgagtcattctatcaagtaaacttggtaatccatcgtccgcagtagcgtcgactcggatctagatcgagatactcntgctcgaccattaagtggcgagttgtcaattcgaagcgcgcttagaagcccaccgcacttgttatgctagccctttagcgtcatgtgacctttcctagttactacactagtccatctattgtctaattcaggtcgtagttcacacgtcaaagaccaacagtagcgtcaggtctctgaacgcactcgcgtacattaccttctactgcagagtcgatcttgctaaatgtacgtgagttcctgaagaaaaattgggccctgggaggtaatgtacttctgtaaatagctagagctcacgggctacagcacaacggctcgttatcacatcctcttattaattcgctagcatcgaagtaggctgcccgtgtttggatgggatacactctcgctcagtggcctgccgtgaagtacactgcctagttcacattcgttccataaatataaccctggatctattcaactctaggtaggcaatgttagaagcaaggacactaacatagttacctctacttaaacagtaatcatagccagaaaaaagacaaaaagtaaagtttagccctaacaccttactatgaacccatccaattaggtttcaaaccaaatccggtagggaactggacctggagtatacgacccaccgtcacggaagagatgcgatcccatacacctgtgtactcctagcgacgcgtaatctcctccgatgtgtcatcctggcgcctagatcacggatccaagacgctcgaaacaagtacagcttcacccggggtgtaacttcgcattcattcatgtccccccacgactgcatttcaccaagtgggtcactgtacaggccctataccagtttcgcggaacttcttgccgcaaaaaagcactgaaccaactcacattgaagtgtaagacccaaatgcgagacacgagaacaggccccatggaagtcatggccaaaccaaaagaggagcgatccgcaacccacaaagatggcccgcgagaccaagacgttgacagaggaacaattacaccaacactcataaaaaccacgtaacccagtaagaccggacatagcctggaaaaggcgataccataaggccaacccaaactaacaattagcgtaatgtgggcaacaccaggagccgccacacgcccacaacgacgatacagaggagccacgagggaactacaaacgctgcgcgcggtaagagtcagagcacaagggagtacccacgatgccagcacgacagagccccagagatactagggagaaactttcgacggatggagacgagaacgcgagatggggaagtggggggcaagctcgcgactgagctagttggtcaggacgacagaccgcagtagggtgtgtggcccacttatgagacagagggtctgctcgacagaggacgggctactcaagcttgcgggatgtggaagtcagaagcaggaagttcttaa

SEQ ID NO: 642678 - DNA, 187 bp, Homo sapiens
cgctcttgcactctccctccctccctgtctttgttagcttgttgaagtcgatgacatacagtcttcagtttccctcgagtccatgtggctctagtggtgtgatagcatctgtccttgttcccaggattgattttaaaaccttgatggccatgtctgttcgtattattcttgcatctagtttcatagt

SEQ ID NO: 642679 - DNA, 373 bp, Homo sapiens
gatgcccagtgcacaggaagtggtgcagggctaggagtaggcactcctgactttggaggtcatgaagtgagtgacgtagaaaagcctttggtttttgttttgatttctgttttgtttttaaaactaatagttttgggctggggaatcagaatcaacctatggtgaaagtgctggcctatgtaaaatttgatgcgcaccccacccccctttttttttttaaaagaattgggtttagctatgggtcaggtcattttgctaagagttgtgattccactgggtcatcagacttcccatccccctgcaggtaggagtagagctgagctcacaaggaagttattaagtgtcctgctgatgagcaggtgtatcatacgcg

SEQ ID NO: 642680 - DNA, 665 bp, Homo sapiens
cagctacctgctgagcaggagaaaatcagcttcctgtttggatacccactagacatttgaagttctacaatgaacccatcagagatgcaaatgaaagtgcctccgcagagacagaaaacctgcaatcgagcatcatcgactcgcagggtgaacagaatggtgatatcagaagaacagatgaagttaccatccaccaagaaaacggcacacgtggagagccagggagagaaagagaaagaaaaagagacagagatcagagagagacacagaaagtgagactggggagagagatagtgtaagagagagagagagagaccgtaagagaagggagacaaagagataaaaggtgcgagtgagcaggtgaggagaaagactgaaaacgatgagaaacagcaactaagacacaaaggaagtgggagactgcccgggtgccgcagcacccacaccgtcctcttgcccccgtcacttgggttaaaaccaccggaaactccactattgcaaattttgtattaatccttgtatgtctgtcctttctattgttagtctacaggtgtatccagcagctccagagagacagccaccagcgagaagaggccatgatgatggtggtggtttgtgaaaacgaaaagggggatatgtagggaacagaaagagagtgcagactg

SEQ ID NO: 642681 - DNA, 192 bp, Homo sapiens
tcaacgaccacgtatatgacgatgtcacatgtagcagcatcaggctgaggctgctgagttggcagttgttgaattagtcctagactgcatactgcggactgtgataggcataggttaagtctttcttcctctggctgagcacacatttagtccatatctgtggtacgactcgaatcgaatcagtctactgtt

SEQ ID NO: 642682 - DNA, 273 bp, Homo sapiens
tttaagaaacatccctttaattttttcattcctttttcataacctcttcatccataagcattgagcacgtcgcctattcccgaaggtggcagcatctgaccggttccacaaggtaccgcatctaacccttgctttgtcgctctggccccctactgcgctccaaagttaatgaggtctgttttcctggttgataccgtagcccaggtacctcggcgcaacgtgttgttcacgctttctttgtatccaggcttagtatttgctgttgtcgtagac

SEQ ID NO: 642683 - DNA, 1409 bp, Homo sapiens
  misc_feature (352)..(352): n is a, c, g, or t
  misc_feature (377)..(377): n is a, c, g, or t
ggagccctacaatgccacggctctccgtgcatcagtggttacgatgaatactgatgatacctatgtgttgagaaggaggcggagagctgtgactggtcctcgcaaggacttcgagtggatccattcactggggcgggggcacaggcattcgggcaagtgggcacgtcatcctgtatttacacaagatgtccgagaaagaactacacatgattcagcatgtcatgttgaaatagctgtgttcagatgtggttgcctatcaggccaagagatggtctgacacctggggttgcagatggcccgtaacgagtgactcctgaatcccataacttgctctcaaactatccatgtgagntgggtcgtcaacacgacttcatggncctcgcgatgtgtcccagtggtccctagtgtcgaactggctgcatcatccgccaataacgtaggggcgaagtccaaacgatggggtcgcccagtgtcaccagacgtctcctattttccttgtgatgccctggacgtattggcccgcatctctacccagcgcagttggtaaggacccatgtcgagtcattccgaggcttcttctagcaggttgccgagaagaactacaacctcaggccagtgttctttctgattgaccaaagaagcattgatgtgacttggcttgtgaccccacgggcacggagctggatatccgtcatcgttgggttgcgtgtcttgccgggggtcgggatggtcccatggaacggacgggtcgaatggagccggatgtcttaatcggtgccaggaaacaacgaaggcagccaggctaacttctgctgggaacctggtatcccgcaaaagattgttcaacgcatcagaccggtactcggtggaagaattcccaacctccgttggggcgtcaagcaagggcaggtgcgaccctttcgagtttgggcaagggtgaagccaacagaccaattcccccatggaagccatacctctcaaaggccgcagatccttcgggaggccaggttctaacagccttgcccaatgtgttccattggctgggaacaggggccttgcccttccaagcgtggttaacccacacgcgggcagaaacggtccagtggacccgacaggatgagcaggttaccaacgggaaagggcttgaagaaggcaaccgtgtggaacccgagagctgccgactcctggagaagtaattaacacgctgggtacaccccagggatcgccaacaccggtggaaaacaaggagggagagcacaaacgggttgaaagggaagggccgacaaaaggacaggcgtgagagggaaaagaacacaagaaaggaaaggcaacgaggacagatagagggacaccgtgacacaagctgggtagagcacattgagcgacacatacagtttgggcgcagaaga

SEQ ID NO: 642684 - DNA, 321 bp, Homo sapiens
tcataggaatcatcgcgcacaatacatgataaaaagtgatttcctagcaagcagacagtaattcttgctgactcaccgagcctagaaaatcctagtttaccaggcagtgtcctgcctttgagtcagctattattgactatggactcctctagttctgccagtaagcaggtatggaaaaggttatagctactgtatgtacaagtgcagataatatttaaatttgctcttcattgagaacaaccaaatatatacttgatcaattcacaatacaaatgctttatagtgttgaagacacatcttatgggggaaagggatggatcg

SEQ ID NO: 642685 - DNA, 1348 bp, Homo sapiens
cctgtttgttgctgcttttgttgctttgttatgtactggttgatctgcttgcattcatgtgtttgttgtgctgctgtgttctgtctgtgttgcttgctagtcgcattacactacatgaccaatgtacggtctccttgtgacacgcggttgcgccctccattattcgtgtaggagcgcctgggtgtgttcctcgaaggccctaccccctttttggtctcccgctgtttctttagggggttttttccctgttggggccccgttggtcctccctcttatgggggggggtttcccttagggtctcctgtcgccgggggccccccttttgggggccccactctggacttcacaggggccacagcacttcttttgtaaaggaaaattgttgtgcatattttataattcccgtaattgtcccagaggccccttggggagtaagcgtttttttctggccgagcttcggcgccaagtggggtccccctttggaataccccgcctgaaatgtccaagtggttaatatcgcccccccacggggaaatatcttgcgcccagaagggccgttgtgcctttaagtttgtcctgcctgcccccctgggagccccctcccccattggctgggccgcctgtgcaacttcctggggacccttcgctcttgtccccgagtccacggctatcctttccgggggctcaccggctttcttgtggttactgagcccccacgggcttgacaccccacgcctttcccggaggccttcttatggttaacctatcctaccctgtgccctgtgtaaataccgagttttcccttctgccctattttggacacttggccactcccactgccacccacccagggagtctcacctccacatgggtttaaatttggctggaatgctggctccgggaaattttgcccactgcgtggcaccccatttccccctgaaccaccccactgggaggttcactgccctgatctgtaactttctaccacgagatcctgaagagattgaaaaagaagacccggctgcttctgagaagcgccagtgacccaggaggatatttccagggtgaatggactgctccccgctcctgagttccctcgcgtactccagcctgaggttcccagactggtctgtaaggtgtaccggtgccctctgtgcctattccacgccaattccctactgaagactggagccgctcagcctgccccggaagactggtttcccagcgtccccctgctccaggcccctgaatgggtaggacccacccctgactggtcttaacccgtttttgcataggctcttaacccgcctggaaaaatggttgatggaaaattaacctccgtttttta

SEQ ID NO: 642686 - DNA, 110 bp, Homo sapiens
gatggaacatctccaggtggtgaaaattatggccttgccggcaggggaagacctcaacgctggtcaagtatgcagagaagtggtctcagagcaggtttctgtatgtgaca

SEQ ID NO: 642687 - DNA, 142 bp, Homo sapiens
agggtgatctcaaaactcttgatctacaagcagtcctcccaattcggcctccagagtgctgggattacaggcatgagccaccaccccagcttgggacatgacatttttgagagaacaatatgtgcaaagacaaagggaaaca

SEQ ID NO: 642688 - DNA, 1202 bp, Homo sapiens
cgcggggcgacagcttgcggctgcggggagctcccgtggtgcgctccggctggctgtgcaaggcggccatgggattgccttgcaggaacaatgtcgtgagtctcaggtcgcgaatgctgggcgcagggcgctgtgcgtgggctactgcgcatcctcgttatcgtgaccccgggagagcggcggaagcaggaaatgctaaaggagatgccactgcaggacccaaggacgcagggaggaggactggctcaggacccaggcatcgtattgcgtgagccgactctgtcagcgaggactagccgagcacgcaggagaaacgtgggcctaggaggacagaactggactgtgttggcgagtgaatggcgtgtgccagcgggaggtcaccgtgagaccggatttgcctccgatgggcgccggaccttggattgggcgcaggaatccgaggcagcctttctccttcgtgggcccagcaggagagtccggaccgagatagcaatgccaggactctcctggggtcctgtgagctagccgtcgggtgagcacgtttcccccaaacctggaatgactgcttaaggtccgcaaggcgaggcagggccgagacgcgagatcggatgtggtgaactgaaggaaaccataaactcatgtgccttacaaccagaagtgagccctgcaggtcgagaccataacaatggttgagagaacgcgatggaccggagcggggggcgcggactggagctgtagacaggtccgaagcccaacagaagaggatgatccggatgggaatcgtggccaaatatggcagaagcaacgaacgagagcggaacacaggaccaaggagtgaatcaggacagaaaacacgacacatgacacggcacgggaacaagaatcacggacacagaacacgaaccagaaaccaaggagcgacgaaccagacaacgagtagaaagagaggagcagaggagaaaaggtaagaacaacaagagaacggaacgcaaacgagggagaaaacagacacgcacaggaacaagaaaggaatgaagaacgagagaaagagaagagcgaggaaagaaacgggaacagagaatgaaactcgtcgcatagtagagaaagaaaggagaagagaaagagaggacagaagaagaaagaagagagagaaaagaagagagaaagaaaaaaaagagaaagaaacaggaagagcgagagaa

SEQ ID NO: 642689 - DNA, 692 bp, Homo sapiens
acactgccctgagcatggacctggaccttgagaggggcccaccgggcccgcgacggccccctcgaggaccccccctctcctcttccataggccttgctctccttctcctgctcttggcgctactgttttggctgtacatcattatgagtaactggactggaggagccctccttgtcctctatgcctttgctctcatgcttgtgattatcattttgatcatctttatcttcagaagagaccttctctgtccacttggagccctttgtctactcctactgatgatcaccctcctgctcatcgctctctggaatttgcacggacaggcattgtaccttggaattgtgctgttcatcttcgggtgcttacttgtcttaggtctctggatctacttattggagattctctggcgacttggtgccaccatctggcagcttttggccttcttcctagccttcttcctagacatcatcctgctcattattgctctctatctacaacaaaactggtggactctattggttgatctcctttggctcctcctgtttctggcgattttaatctggatgtattaccatggacaacgacacagtgatgaacaccaccacgatgactccctcccgcaccctcaacaagctaccgatgattctagcaatcaatctgactctaactccaacgagggcagacacctcctg

SEQ ID NO: 642690 - DNA, 380 bp, Homo sapiens
gaacgcagagtgagcaccagtgactgcgtgcgtggaggtgactgcactgcagtggtcgtgtgtagttctctaacttccaaccatgtcttgtgcgtctccagaagcaagaaaagttgtcttctctcccctccttcccaccctttttgcataggcaccacaagtattgacaggagcactacatcaaatctttttgtgacactagtagaaaccagtacacttttagattagacagtatcttcttttaatatttcgactttgttccccttcactgtgaaaagttgtataatacttaactgactgtagcagagtcggatatgtggtagcgtacctttaatatatcctattacagcactgttctggattttctttcggtttttaaa

SEQ ID NO: 642691 - DNA, 953 bp, Homo sapiens
  misc_feature (45)..(45): n is a, c, g, or t
  misc_feature (74)..(74): n is a, c, g, or t
  misc_feature (266)..(266): n is a, c, g, or t
  misc_feature (574)..(575): n is a, c, g, or t
  misc_feature (580)..(580): n is a, c, g, or t
  misc_feature (583)..(583): n is a, c, g, or t
  misc_feature (634)..(634): n is a, c, g, or t
  misc_feature (636)..(637): n is a, c, g, or t
  misc_feature (646)..(647): n is a, c, g, or t
  misc_feature (652)..(652): n is a, c, g, or t
  misc_feature (656)..(656): n is a, c, g, or t
  misc_feature (686)..(686): n is a, c, g, or t
  misc_feature (692)..(692): n is a, c, g, or t
  misc_feature (695)..(695): n is a, c, g, or t
  misc_feature (718)..(718): n is a, c, g, or t
  misc_feature (726)..(726): n is a, c, g, or t
  misc_feature (781)..(781): n is a, c, g, or t
  misc_feature (812)..(812): n is a, c, g, or t
  misc_feature (814)..(814): n is a, c, g, or t
  misc_feature (831)..(831): n is a, c, g, or t
  misc_feature (873)..(873): n is a, c, g, or t
  misc_feature (883)..(883): n is a, c, g, or t
  misc_feature (952)..(952): n is a, c, g, or t
atgtatatttggttgtgattaaacactaaaaattaggcgagagantggaggggataaggataagagaacagganaaggagagcagaaagacgctcagagagagtagaaagacactgaggagagaacaagagatcctagcccattcttattatgaggatgaacgatggctacaggacatgagtagcgccaatcagatctaactaaaataccagcctctccaaaaaagttttccaaataaagaatcccctaacaattatttactgganaaaaaaggttgatatttctagaaagagatgatctctttgacacaaaagacccaacttaggacccaacttaatacatagatagcaccatgacagagctgggatccattaagacatgatgtagacaataccatctctaggacacactgtcacatcacacatggatgtttgttttatggcctaaagatgttgtagacggttgtcacaaaatttctcggggggggcttcttcttgctgccaggttcaggaatctcttaattgtagggatattacttagttatcactgtgtattccatggaggaaaaggaaanncaganaanaaaaaaaaaaaattttctcttctagagctaaaatggtttggagtaaaatgnannctgacaggnntcaangaanaccaacaagaaagctttgtccgtaaacacnaaaaanctnttacaaacacaggaaagtatctnattatagncttctgggccatgttaaccacttccttttgctgatcatctggttttaagaaaggntgcatgataagcagtaccagcagaaccagtntnccctccacgtacatgtnaatcagggttctctccttgaggttcttgccaaagagattgtncttgtctgcnatgtagtggagaatgcttcgggtctgtaccaacttcatccgtcaatttcaccatgggcacttgtgggana

SEQ ID NO: 642692 - DNA, 634 bp, Homo sapiens
accaagagaactagcctgcagagttcagttgctctccctagactccattaggctactgagtcttatgacacctgctatcctgggattccccgccagctgcaggtcagacctccattgctactatgtgcgctcatagcattggctgcgtacttagcacattctaggcagtagatcctgtacaacgtctatgcaaacaccggatgtactgtgctcaatacgaattatgaatgcgacatcctgatatcgactagaacagatatgtaccgacggatgatagttaccagatagttgcaactaattccttaatgagacttactacactgtcagagatcttgagtacgcctttgagacagcatccggaagctattcttgacatacatagtgaatttagcttacactttggcaagagaaccacctttgactatacctgctgcatagatgctttaacgtcttctacagaactaggacctatcggcgcttgagacaggattacctgcacacagatggattcttgtacttatgaacatggcgctaatgataggagatgaactatggccatacaggttcgacgtgagggcatttatgagttggagtaatccaggaagcttgcattcactggcccatttttcgttct

SEQ ID NO: 642693 - DNA, 987 bp, Homo sapiens
ttgaaacgatgctatgattattggtcttatctattatgttagtgtgctaattatatgtaatactttggattgaacacgcagtgcacgcgatagtacttatagctgtgacctcgcatcactctggttcttctgatactcgtgctaaggtgttaggtctggtgctctcggttagtcagagatatgttcgctttgtggcacgatagcgacttatatcgctgtggggggagaaaggacgattatttggatggtgccccatatagcgaggctgtgaagccacgactaaggtgttatgttagggacgcttgtgttaaaccagtgtgtttcccgcgcggtctgccccgacatttctggggtgaaacgccctttgcccggcctcttagtcccgtgtttattcggccgcgctccccccgaggtgttttgtgttaagccgtcccccctcatatgggccgctttctcgtaccccccagtcgaacaacgcggggcggcgtcgcgagttcccctgcgtgtggcgaggaacacgcggcggcgcacaaaattcttcctcgttgggcgcgctcccatcctacatgagcaatgtgttaccacacgtcgctgcgcgcctacccacgcaaacaatttccccttgggtgatttttcttcgccactcaccgccccggcgggagttcaattactccacagggggaccaccacccacacactgtggggaaggaacaaaggagggtgcgcttagaggcgggtcacaccccacggtctccgccgccccaacagacggtccggccccccaccgggggtcatgacattctaggcaggccgccgccccaccgacagtgaacagcttccacgcgcagaggctggaggaggagcgagttgggcgaaggaacgaagagagaatggggcgaataaaaacactataccggaacacccaaccgaggagaatccaacaacccccgccggggacccccaaaaaaacccccccggacaaaaaca

SEQ ID NO: 642694 - DNA, 1313 bp, Homo sapiens
gccgcggctgggggcggggaggggggcgcaggaccccaaagatgggggtaccggcagccagaagggccaagttccgtgtccccaccagcagcatggcatcgtgtgctgaaccctctgcagccctctagccccacatgccctgccgggcgtcccgaccggctcgcaggcacctctcgcacggctaaccctggccactggccgcgcttcggcaccccggcacctgccccacgcaaccgcgctgaccgaagcgcaaccaccgcacgcgaggcaacgcacggcacggacagcacggcacttgaacccatcgcaaggttgaaccgccgtcgcccaagccccgggccttcggcgccacgcggcacccacttgcgggcgaacccacagccccacgccactggcggcctgcggcaacgcggaacgccgccctctgcaaccgccacaacgcccccactcggcccaggcgaccccccccatggcgcccccccccgccaaccgcaacgcataatcccccaccttcgtggcccacttgggcccccacacgtggccgcaaccggcccccccccggaaccggcgtaccctcctcggacacacacccacacaaaggaccacacaccccagcgaggctctaccacccccacccgcacaacgctcaacgccacgggccccaatgcccgcccaccccgaccttcccacgccatggcggcctcgccctcaacccaccccgcccatgcgccccccatggcccccccgcccacccccgccaccacccgcgcacgagcccaagcccgcgcccctccgccgccccccccgccccccacccgcgcccccctcgttcccccccccgtcggcccgcaccccgcacgccgtgcccaccctcccccccccctcccgcccctccccccccctcgtcggtccgtccccccccacacgcccgcccctgggcgcccccctccctctccctcccgccggccccccccccccccacctctaccctctgactcccccctcgcccacccccgccgtcctccccggcgcgcccctcgcgcccgccccccccacccccccccccgccgcgccccgtcccccccaccccgcccacgcccccccctgtcccccccctcgcgtctgcacacgcctgcgcccccgcgccccccccgcgtcgtccccgccgccccccgccgcgcccgcccctgcgccattttccccgcacccccccccctcccccctctcggccgcccccacttgtctgcagcccccactctctggccaccctccccacactacctgcgcgttctcccacgcctctctccccaccc

SEQ ID NO: 642695 - DNA, 518 bp, Homo sapiens
gtgcccagccatctgcaggcttcatgctgcggagacgctatactcagaacgatgctgctggacgtcccagctgaggagaggcatactgtcaacatggactatcctgggaaagagctcggaagtacatgctgaggtcccatccaaacagcaagctaggcaaaagcctgccttgaacatatttctagacatcaaagataacttacaacccaaagtgaataataagtaaatagtctgatgaccctcttaatagcattgcaattgtattgaatcacctactgattcataagtaactagggaaccaactgagttttgctaagcagtcttccccttataacaccacaggcccttctgacacacaaaaaaatgaaagttaatcctgggtacagcatacagttttacatgtaaacgcacagtcttacgtggaccaatgcaagcacaagcctaaagcaaggtcgagcagatggcaaaaccgaagttgcctgccaagaaatctatttaactgaatcagctccaaatct

SEQ ID NO: 642696 - DNA, 516 bp, Homo sapiens
  misc_feature (113)..(113): n is a, c, g, or t
gtagggcgcgttaaactggatctgtaactatggtcatgggtggaagaggagtcatcagttcaaagatcagactctgtatcaaaagtaccttgcccttaggaagagtgagtatnggagtcatctatatctattactccaaaactccctttatatttcttgagcctggctaggaacttggcattccgtatgaattccttctaactggaacataagtgtagtatctgtaacactggcactgaaataaagaccacacggttaaagaaatcttaccatatagtactttatggtgttggagtgaagccttgtagcttccatacccctatgtcagaggaggtcttacggacaccatagggtaggaatagcctttcctcagtctgagaaatcggtctcttttaaaagacgaatctcatgaatattcacatcaaagacttgagctttttaaactcgtgagagtgccaagtgctttttagaaaggacccatatgttatcacactttgcaatcgagttgctggaatg

SEQ ID NO: 642697 - DNA, 192 bp, Homo sapiens
  misc_feature (51)..(51): n is a, c, g, or t
  misc_feature (72)..(72): n is a, c, g, or t
acactcaactagctgtatgatggataagattgagagagtgaggagaagctnacgtcacgtgagggagagatntgcgatatgattgagatggcggctagttttgtcatgtgagaagaagcaggccggatgtcagagtgggtgcttgagtaaccctctgtgactcagaatgtgaaagggggctattcctagttt

SEQ ID NO: 642698 - DNA, 381 bp, Homo sapiens
gctataagtctaagtcctcaacaaaagtcatgtatgacaattagatccctaaatgtggcatgtatgggaggtggggcctaatggaaggtgtttgggtcatgagggcagatacctcatgattggctctggtgacattctcatggtagtgagtgagttctccctctttcaaaactggattcattcccttaggactgaattagttacccacaagagtcggattttataaagccaggatgcccctaaggttttggctcttcacatgtgtatcactataccctttgaacttctctgacatgttatgatgtgtcaagaaagctccggccaggcacagtggctcatgcctgtaattcccgtacttagggaggccgaggcaggcggatc

SEQ ID NO: 642699 - DNA, 1618 bp, Homo sapiens
tccctgggagctgcccgttgccctttgccctgtccgtccccggaaaagttggggagccggccctcagctatgacccaccgaaaacttttattttacaacacgaaggcgtggagtataagaagggggtgggagtgggaggaacagcagcgagggccgacgaggacccttactttcgtgcctcccgccttccagaacgaagtcaccagtgccgcgtggggtctcacacgtggagaggccaagaaaggctctctctcgttcgcaagttgtgaaacgcgtgaacatatcaaaacgccacgaggtgtgccactgtggtgcgccctgtgcaaagcgtgtgtgtgtgacacaagcaagcgtcgcgaggggtctcccctctgcgtgtgtgtctcttcaacacaccgcttgtgtagagagacaagacaaacttgtgtttgagagggcacaagccattgtggagtgaagccagaggtggagggacactccgcggggccctctcgggggggtgtgcacccccgaggacacgcgggggcgtgaagaaagtgctgtgggctcacacaggagggtcctccccctctttctttgttgcccaccacacacaaaaagagccgctttgtgcggtcttttggcgctccagaaggctatctccccctgtggtgtggggcccatatttattcaaacagcagaggaggaaaagaggaagaaagagaccaatacgtgttgccggcaagggggggtcaaaataccacccccgtggctcactaaagagaggtcctgggccaaaaactgttgtggtgcgcgcccaggagtgtttctgcgcgaaacccaaaaaaaaaagacgccggggtgctgaaacaccacaaaaagggcggcggggggcccccccgagggggggcctctcacaacactctatttttaacgacgcaaaacagagggtcttactattaacaaaacgcgggccgcccctgtgggggggtcacacacgcagcatttttttccacaagacgacggcgtgaaacaaccaaaaggggcggcgctgtgtgttgtttgctcgagcaggggggaaagataatatttcggggccccataattataatttcgccgccccccgtaggggaaaacaaaagagggtcgtcgcccgggacacaccaaaagagatatatcgcggcaggggggtttataccggttttccacgcggcgccattttttgtgtgtagttagaaagaggacgaaaaaattcccgaggaaagagaaggggccggccaagtttaacaagaagagaggggtttatttcctccccatacattagatcgacgtgcttgtgccgagggagagagcggagaggggcaccaactagaacaacaacagggggtggtagcagagacaccaccaattattatgttgtgttcccccctcggaaagaggggatcgctccacagctctgtgtggagattcacacgaggggaaagcaaatcttcttcgtgaggatggataagataatcccttgggcaacacttatagaggagagaacatgttcgttgtgcaagactttttggggggaaatttcagtggagggttgtcttgttcccaaaccctcttcgggggtttcactcacggacgttaa

SEQ ID NO: 642700 - DNA, 725 bp, Homo sapiens
  misc_feature (441)..(441): n is a, c, g, or t
  misc_feature (497)..(499): n is a, c, g, or t
  misc_feature (501)..(503): n is a, c, g, or t
  misc_feature (528)..(528): n is a, c, g, or t
  misc_feature (536)..(536): n is a, c, g, or t
  misc_feature (540)..(540): n is a, c, g, or t
  misc_feature (547)..(547): n is a, c, g, or t
  misc_feature (556)..(556): n is a, c, g, or t
  misc_feature (558)..(559): n is a, c, g, or t
  misc_feature (561)..(561): n is a, c, g, or t
  misc_feature (563)..(563): n is a, c, g, or t
  misc_feature (572)..(572): n is a, c, g, or t
  misc_feature (574)..(574): n is a, c, g, or t
  misc_feature (577)..(577): n is a, c, g, or t
  misc_feature (580)..(580): n is a, c, g, or t
  misc_feature (584)..(584): n is a, c, g, or t
gtaacagatccacagcgctctcgatgctgtctccgggacccgcagcgcgtgctggagtactgcagacagatgtacccggagctgcagattgcacgtgtggagcaggctacgcaggccatccccatggagcgctggtgcgggggttccctggagcggcagctggcccaaccccaccagcaggttgtgcccttcctgtgcctgctgggtgaatttgtgagtgaggcccttgctggttgcctgaagggctggccggtttcttgcaccaggagcgcatggaccaatgtgagagttcaacccggaggcatcaggaggcacaaggaggcctgcagctcccagggctcatcctgcaacggctcgggcatgctcttaccctgtggctcggatcggttccgtggtgtggagtatgtgtgctgtccccctccaggacccccgaccatctgngacagcagttggtgacccctccacccggtcctggccccggggagcagagtagaggnnncnnnaggacgaggaagaggaggaatcctncccacagncagnagatgantacttcgtngnncntncgcagctgnangangangagnccacggtcccacccccaagtcccatacacttgcagggtcggcaagtcactcccaccccgaggcccacagacgggtggatattacattggcatgctggggacatcagtgagccgagggttcgtgaggccaaaggacctggcg

SEQ ID NO: 642701 - DNA, 150 bp, Homo sapiens
tgatcagctcggtacagggtgttggttgggagggttcgtccctaaccttggagcatcactacgccccgaaatttcacggcagacttaccattggcgcggacgacgacacggccacaaactacctggagctcagcagcctgagatttgagg

SEQ ID NO: 642702 - DNA, 268 bp, Homo sapiens
  misc_feature (32)..(32): n is a, c, g, or t
  misc_feature (55)..(55): n is a, c, g, or t
  misc_feature (62)..(62): n is a, c, g, or t
  misc_feature (124)..(124): n is a, c, g, or t
  misc_feature (148)..(149): n is a, c, g, or t
  misc_feature (226)..(226): n is a, c, g, or t
  misc_feature (248)..(248): n is a, c, g, or t
gatttatctattctggatatttcatataagtntaatcatgtaatatgcgtctggnttctttngttctgacttctcagtgtaatgtttttaaggttcatccacattctgtatcagtacttaattngtttttttgggcagatattatttnnttgtatggatataccatatttaattcatccattcgtttgctgatggacatttgggtttctacttttaagctattgtnaatagtgctatggacatttgtnaacaagtacttgttttcagg

SEQ ID NO: 642703 - DNA, 932 bp, Homo sapiens
  misc_feature (1)..(1): n is a, c, g, or t
naaactatgccagccatgtcatattcccgcggtattttccaccgggtgacttttcccaacttgtgggaacccccctctttagagtctattcccccggttccggtggtcgcaccccccgtgggcaaggtctcctccaacagccctccgatttccgctgggaccaccgacttgccaaagaagcgtccgccaagtgttgttgaccccggccgcccctgtgttggccaattgagcccgtgaccccgacaccaatgtggtcccttaacagggccaccaccatttaccttggggttccccaaaggcgatttataaacactcttctcccctaataagggtcttccaaaggcggtggccgaaacaaaaaaacgccgccgggaaaaatggctaaattcgccctcctggccccttgggtcggtccccccccctgggggcgcacgagagaaccccccttgtggggcccgccaaaaggagcgcaaaaacatcgtggttgcgcagcccagagaggctcccacccgaccgtggcgagagcaagtgaaataacactcttgtgggcatagacgcaacaacagagaagtgtgttgttcccccccccgccccgccaattgaccacccagggggcggagcggaaaacaccccacggtctaggaaacacaacgcccccaattcattcatgcgacgcccgcccccccccctgtcttaggaactaacaggaccctcggctgcaaccacacgtaatgggggcaccccacaaggagccacagaggaggctcactaggcccactccgccctcattcaacgtgaaatgccaacgtaagacactccaccgccctccctggaacctggggcgcaacaggtaaacatgcatcccctgatccgagcccagagaacccccccccttggcaatcagcgcccccggccccccaacccacaaaaca

SEQ ID NO: 642704 - DNA, 156 bp, Homo sapiens
caactgagtcttgaggaacgaaaatataggagattgtgaagatacattctcagtttattgggatatcccattactctttttgtgcataaggaacgtgataattaagtgagctatgattaggctgaagatttggatcacaaacaacattaataagaa

SEQ ID NO: 642705 - DNA, 246 bp, Homo sapiens
gattcatcaatagtagactcttcacatctcccggcgattttagagtactggaccgcggccctggctcctctttccttgttcacaacgtgtgtcctgctatgacgtctttatcctcaaatttaaatttccctcctctaagatgacatcacctaactgataccctgccctagtcccccacctttaacttaagatcccacacctcacaaacctacagcccagaaaccagaagcgcctatagaggcccca

SEQ ID NO: 642706 - DNA, 686 bp, Homo sapiens
  misc_feature (7)..(7): n is a, c, g, or t
  misc_feature (172)..(172): n is a, c, g, or t
  misc_feature (177)..(177): n is a, c, g, or t
  misc_feature (198)..(198): n is a, c, g, or t
  misc_feature (205)..(205): n is a, c, g, or t
  misc_feature (208)..(208): n is a, c, g, or t
  misc_feature (240)..(240): n is a, c, g, or t
  misc_feature (297)..(297): n is a, c, g, or t
  misc_feature (309)..(311): n is a, c, g, or t
  misc_feature (315)..(315): n is a, c, g, or t
  misc_feature (371)..(371): n is a, c, g, or t
  misc_feature (373)..(373): n is a, c, g, or t
  misc_feature (377)..(377): n is a, c, g, or t
  misc_feature (384)..(384): n is a, c, g, or t
  misc_feature (401)..(402): n is a, c, g, or t
  misc_feature (418)..(418): n is a, c, g, or t
  misc_feature (423)..(423): n is a, c, g, or t
  misc_feature (427)..(427): n is a, c, g, or t
  misc_feature (429)..(429): n is a, c, g, or t
  misc_feature (438)..(438): n is a, c, g, or t
  misc_feature (443)..(443): n is a, c, g, or t
  misc_feature (446)..(446): n is a, c, g, or t
  misc_feature (473)..(473): n is a, c, g, or t
  misc_feature (483)..(483): n is a, c, g, or t
  misc_feature (499)..(499): n is a, c, g, or t
  misc_feature (526)..(526): n is a, c, g, or t
  misc_feature (535)..(535): n is a, c, g, or t
  misc_feature (568)..(569): n is a, c, g, or t
  misc_feature (657)..(657): n is a, c, g, or t
gtaggtnttgaaattgggaagtgtgagttctctttgttcttcatttcaagactgttttggccattctgggtcccttggatttccatatgaattttagtatcagcttgtcaatttctgaaacaaatccagctaggattttgacagggattttgttagtcttgtatatcaattnggggngtgtatccatcttaatattangtgatcnggnccacaaacatcagatgtcttttcatatatttngaccttctttcattttcttcaacagtattttgtaattttcagtgtacaagtcttgcncttcttttgttnnntttnttctaagtattttattctttttgatggtattgtaaatgggattgtttcttaattananctcngactgcngactgtcagcgtatagnnacaaattggtttttgnatgancccncnaaatttcanaatcngcnttttttcctcttcaaaatcgagggtcnttattttccnagaggggttttctccnttcttaaggccagagattatttgaggnctgcccatngagcacccaaagcttggggttgtccttgagagnnaacaaaaaattcttggtgtcgggaactgtagcacatggtttacttagtctttaagataaggtaggcttacagaaagtcatgaactttnaaatgtctgagaagtccttgagcacagaa

SEQ ID NO: 642707 - DNA, 154 bp, Homo sapiens
cgacgcacatttcatacctctaggagtaatgtataatcgtcgatcgatatagccgtcttgatagcacaaactcctgagtgctgggctgcttgagattattatctccatcttgcagaggagaaaaccaaagtccagagcccaggtccgcataata

SEQ ID NO: 642708 - DNA, 809 bp, Homo sapiens
gctcttgccctaagcagcctgaggtgatctgtgaaaatggttcgctattcatgttgacccggagaaccccacgaaatcatgcggagatcgagatgaggttccaatcttcgtgttcactttaaggaactaactgcgtgaaactgtctcaggcctatcagagggatatgcatatacgaaaagccacgaaggtatctgaaggatgtcactttacagaaacagtgtgtaccatttccgacgttgcaactggtggaggtaggcagtgtgtgcgcaggtccaagcctagatggaggctggacactagggtcggtgggccataaagaggtgcggaactttttggtgcacatgcttgaacagcgcagagatgtgagtgctgaatcttaagggtttaagatgtcatgatgctctggtcatctgaggctttatccaagtgtagatcaaaggctactctaaggatgcgccgcgggacctacagagctcatggttcgggattaacccatagcgtgagctcgcctcgtgccacatttgagatgatccttacggagcataggaacgagattgttcgctagtaacagactgaggagggttgctcagaatgaaataaggatagtcccaggaaagaagcttgaacgataatcaccagaagtttgtggcaactggggggttataagtgcaaggctttaatagtcagattgtaattgaaaatgggaatagtcacaggttttccctggtaatttaatttggagacaaaattaaatccaaaattaagaactttaattattaaaaagaaccagaatagcatcagaaaatta

SEQ ID NO: 642709 - DNA, 431 bp, Homo sapiens
tgggacctgattgcgggccacgaggcgcaattcggggcggagctgctgctcaggctcttcacggtgtaccccagcaccaaggtctacttcccgtacctgagcgcctgccaggacgcgacgtagctgctgagccacgggcagcgcacgctggcggctgtgggcgcggcggtgcagcacgtggactaaccctggcgcgctgagccgctggcggacctgcagcgctcgttgcgcgtggacccagccaactttccgctgctaatccagtgtttccacgtcgtgctggcctcccacctgcacgacgagttcaccgtgcaaatccaagcggcgtgcgacaagttcctgactggtgtgcccgtggtgctgaccgaaaaataccgctgagccccccggcgcaggccttggtccctgcctgtcaatacacagaggcccga

SEQ ID NO: 642710 - DNA, 359 bp, Homo sapiens
accccaagcagttcatacagactcagatgcatctcacccctgctgtgatgtgtcaccctgtgttgtgtgtgtgtgtgtgtgtgtgtgtgtgtccccaactggatgtgtccacggtgcatgtgtgtgtgtctgtccctgtcgggatgtatttactgtgtgtgtgtctgtgtgtgtgtctgcgtgtgtatgtgtttgtgtccctgctgggatgtgtacacggtgtgggtgtgtagtctctagtgtatgtagtctgtgtatgtgtctgtccctgtcgggaatgtatacactgtgtgtgtgtagtgtgcgtcagcgtgtgtatatgtatgagtccctgccggaatgtgtcactgtgtttgtgt

SEQ ID NO: 642711 - DNA, 101 bp, Homo sapiens
aactagaaatcatctaggaaaaaaaaagataattagcctatagtttcagctacttaggaagctgaggtgggataatcacttgagctcagtcgaacggactg

SEQ ID NO: 642712 - DNA, 1801 bp, Homo sapiens
  misc_feature (209)..(209): n is a, c, g, or t
  misc_feature (1268)..(1268): n is a, c, g, or t
cgaccgacgtgttttctgttctccagccacacgcggtgtgttgcttccgctgttgtggtggtgcgcctccacattctccacgtgtggtggataaattgcgtgctgcgcgtcctgttctgccctacatgtggatgccatccggtgtgatctgttatctttcacactgggggtggcgtgtttactactcactccctaccaacagatatggntggggctcgaacacttttgtgttgatcccccgcgggcgaccttcttctcgtgggttgttgtcactccgtttgtgggtttccccccccatcctcctcctccttgtgggaagattgtttcgtgtgtgtgtcttctgctgactgactttgtgttggttggtctcccccctgctatagaaatcctctggtcgtccccaccaggggggtgtctgttgttcttctctcgtctcttattatgggggcgccattatataccacagcatctgttgttctgttctctctttaacctttcgtgatggtgggaaaagctggtttgtgtttgtaaaaagaataaagagggtagttgttgttttgccccccccgcggtaaggcccacctggttggtgtgaatattatagcgcctcccaaaggatgttgtgccccccccctgtgggggaggcaacaaaaaaacatgtgttgtaggggaggaaggagtggtgtctcccggcgcattgtgggtggagagaggtttgtaagaaaaaggtttcgacacgacagttcgttgggtgttgcacaacatgatgtcctctcaaaaataagtttgggggggagaaaacctcttgttgatataaaggaaataagtttcttaccgcctcgtgtgtggtcccacggaggtattaaaaccacacgtcgggtaaatttgggggtcgtcaagacccccgcttgggtccacacacgacgccacacatgacacctattttgtggggggagatagagaaatgtcttacacacactgtgtgcttgagagtggacacacacagcagttgtgagatgaagacatgtggccccccacacagagatatataggttgataatactccacacaccacatatacactcgaggggagaaatatatcatatttggtatacaccacctcgcgctcgcctgctgtgtacacacatccttcgctgagtatcacacacacaggcgcgctgctctcacgccacagcgagagagaataatagtgcgtcggggcctcacagagagcctcgcagcaggagagagataccccccgcgcgctnccccctgagagagagaggagacacctgtgtctccacaacgctgcttgtcacacagacacacctcacacacaggcccgcgcctgtctctcagaggagagggacactctctcgtgcgctctcactttgtcccagagccccccagagagtatgacacacacactgttctgttgtctccagagagacacatctcacagaggagagtctcacactgtctcctccacaacactttgagagggcacagacactctcttctcatgtgcgcccagaggtctttctcaagagaataacccacccacttagaaaatagaggagatgttctccagagaaatagagaagagttacacatgtgacatctttgtgagagtctcacacacccgggcgcaacattctgtgggaagaaaaaataatttgccatattgtgaaagaccaccgagagggtattttttagaggtccattgcccgatatttggggataaaccagggtgttttttagcccatataatataaaataacacccaaattcttggaaaaaa

SEQ ID NO: 642713 - DNA, 994 bp, Homo sapiens
tgctaaaccgtagccccagaacccacgtccaccgttactaccagtacaaaccttagccaaacctatttaccccaaactaacagtatagcgcgcatagcaaacttgacaaccctggacgacaactagcactatagatacccgcacaggcgacaagcatgacacaacattactaagcctaagccactacatactagacacaggcacgtaacgcccatactagccattcctgacactaactgcaacttaaccgtacgacaactacactattgtcaacgtgcagcagcccaatacgcgtcaagcaccactccggacagacccagcacagcacgcatacacgtacagcacacgagtcttaacacagcagacgacgacactcgtatcgtactcgctaggctaacacattagatagaggacagcagtcttactacgcgctacgcacgagcagaaccaatatccgtagcacgcagacactgagatgcactacgcataggctatgatcctaactactcagcaactctatcagatatcatacatattacaactaatgcaccaccatgacacacgctcctacacatcccccattgatcaaactctctacacgtcgattcagataccagcacgacgagacacacgcgctcattacgcgatcaccctagcgacaacaacaccgtcgccacgcacgacgacgtaccaaaactcctacacaccacactagctagcgccataacaacgcagccaaccacattaaagaacagcgcttcaacgcatcacacatcccatctaccctacacacaaccaatcacaaaaaccaacaacatacaaacaccagcaaagcgccttgcgcgccctcacaggctcgcagtagagaaggtactacagggtgccgtccgagacggcgcccgagggcacaccggagggcaaagagacaaagggataataaaaagtagaacgaagccacacagtcacaacagacaatgacggtgagaaataagag

SEQ ID NO: 642714 - DNA, 859 bp, Homo sapiens
  misc_feature (11)..(11): n is a, c, g, or t
  misc_feature (101)..(101): n is a, c, g, or t
  misc_feature (103)..(103): n is a, c, g, or t
  misc_feature (105)..(105): n is a, c, g, or t
  misc_feature (145)..(145): n is a, c, g, or t
  misc_feature (147)..(147): n is a, c, g, or t
  misc_feature (161)..(162): n is a, c, g, or t
  misc_feature (192)..(192): n is a, c, g, or t
  misc_feature (194)..(194): n is a, c, g, or t
  misc_feature (212)..(212): n is a, c, g, or t
  misc_feature (216)..(216): n is a, c, g, or t
  misc_feature (255)..(255): n is a, c, g, or t
  misc_feature (272)..(272): n is a, c, g, or t
  misc_feature (274)..(274): n is a, c, g, or t
  misc_feature (285)..(285): n is a, c, g, or t
  misc_feature (288)..(288): n is a, c, g, or t
  misc_feature (308)..(308): n is a, c, g, or t
  misc_feature (322)..(322): n is a, c, g, or t
  misc_feature (327)..(327): n is a, c, g, or t
  misc_feature (334)..(334): n is a, c, g, or t
  misc_feature (480)..(480): n is a, c, g, or t
  misc_feature (544)..(544): n is a, c, g, or t
  misc_feature (563)..(564): n is a, c, g, or t
  misc_feature (604)..(604): n is a, c, g, or t
  misc_feature (854)..(854): n is a, c, g, or t
gggggcctgcnccccactgcatcctccccaggcccccagagtcgcccgaaggggacatgggcgtttctatccacattaagtagcaggagattccctgagtnanangcattttcttaagtcggacgtgtccaggctccagcagcantnctgggggtgggggnngtgggccttcaggccagggcactgcccatnanttcggagaagccacctgntgtnccaggtgctgctggctgaggctcctgcagctcaggctgngcctctttccaggccananacttctccaanttngttttaaaaagcaatccgtnacctgggcagtctncagtntctttgnaggctcgcttcttgcagcagccgcggcacaggctgaacacacatctgttgccctttgggtttccacactggtcacactttgcatattttggcttcagagaggggtcgaaggtcttgtgggggttcctcagctgcttcttttgcttnttcttggataggacctccgtgccaccctcctcttcctccagggcccgcttgctgcgcgcacctnccttctccttgctcccctnnctgggccccggccggatgtagggctggcagatccagtggnagggctagtcgccggtgggcttcgctccctcctgcctggatatctcctcctgacaccgcagcttcagctcctggctcacagcagcgatgccctccagggtcttcaccttggccagctcctctcgcagctcctggtgcacctgcagcgtgtggtgccacagcttgaagaggtgggcccggacgtaggacagggggcaggggtgctcccgcacgatgtccagatactcctcggccagctcccacacggcagngctcc

SEQ ID NO: 642715 - DNA, 294 bp, Homo sapiens
  misc_feature (188)..(188): n is a, c, g, or t
  misc_feature (238)..(238): n is a, c, g, or t
  misc_feature (242)..(242): n is a, c, g, or t
cacaataggaattttaacagcatactgccaagacacaataagccactagtaaatggtagttgctggtttttgaaaataataaaagatcacaattaaactggttccctatctcctcagtctgaaaaaataataaaaacatgactgaatgacatgattttttttttttttttttttttaaaaaaaaggtntcattttgtcccccaggttgttgggcgggggcaaaaaaatagttaattgnggcntaaacctccaaggttaaggcaatttttttgagcaggtggaacaaaagggggg

SEQ ID NO: 642716 - DNA, 178 bp, Homo sapiens
accagtagctgccatagtttggttctgaaaactaacttggcatcaacacttgggtgtaggagacattgctttcgttatgtatcagaggacatgctcagcagatcaagagatatatttggcaacgtgtgtctagaaaggcacattgggtatcattcattacatttctaggttgtctggg

SEQ ID NO: 642717 - DNA, 1064 bp, Homo sapiens
gggcccttccagagaaatgtactgaaaaagtctacgcaatgtctgggatttgctaaacaatacctggaaagcagacaggtctttttgccattcctccaggacatccaccataaggaaaggagaccctggaccaacattctctaagatgtttatatggaccagtggccggacctcttcatcttatagacatgatgaaaaaagaaatatttaccagaaaatcagggaccatgacctcctggacaaaaggaaaacagtcacagcactgaaggcaggagaggaccgagctattctcctgggactggctatgatggtgtgctccatcatgatgtattttctgctgggaatcacactcctgcgctcatacatgcagagcgtgtggaccgaagagtctcaatgcaccttgctgaatgcgtccatcacggaaacatttaattgctccttcagctgtggtccagactgctggaaactttctcagtacccctgcctccaggtgtacgttaacctgacttcttccggggaaaagctcctcctctaccacacagaagagacaataaaaatcaatcagaagtgctcctatatacctaaatgtggaaaaaattttgaagaatccatgtccctggtgaatgttgtcatggaaaacttcaggaagtatcaacacttctcctgctattctgacccagaaggaaaccagaagagtgttatcctaaccaaactctacagttccaacgtgctgttccattcactcttctggccaacctgtatgatggctgggggtgtggcaattgttgccatggtgaaacttacacagtacctctccctactatgtgagaggatccaacggatcaatagataaatgcaaaaatggataaaataatttttgttaaagctcaaatactgttttctttcattcttcaccaaagaaccttaagtttgtaacgtgcagtctgttatgagttccctaatatattcttatatgtagagcaataatgcaaaagctgttctatatgcaaacatgatgtctttattattcaggagaataaataactgttttgtgttggaaaaaa

SEQ ID NO: 642718 - DNA, 118 bp, Homo sapiens
tgagtcaggagttggacagcttataacatagtgaaacccatctcacaaaaaaataaaaagttagctgtgcatggacacacacctgtagtctcagctacttgggagtcaggaacggtcg

SEQ ID NO: 642719 - DNA, 214 bp, Homo sapiens
tctagaggattccagatatcctggatcttatagtgatcggattttgtgcgtaggtttggtctagtggtgtagcctgagaatagtgggaaatcagtgaatgaagcctcctatgatggcaaatacatgctcctattgataggacatagtggaagtgagctacaacgtattatgtgtcgctgtagctcacgactgtctcagctgatgcagtttgcta

SEQ ID NO: 642720 - DNA, 401 bp, Homo sapiens
gggcccttccagagaaatgtactgaaaaagtctacgcaatgtctgggatttgctaaacaatacctggaaagcagacaggtctttttgccattcctccaggacatccaccataaggaaaggagaccctggaccaacattctctaagatgtttatatggaccagtggccggacctcttcatcttatagacatgatgaaaaaaggatagctaccaagggaatctgaatttaaatgggtgtgacagccaaggaggaaaaactttctttcacattttgctctttatatccatatttgtatgtgcatggcctcaaaaataatttgtttatgaattatgggctgacccccaatatcaaacttcaagaaactacataaaaggagctcaaaataaaattttactaggttg

SEQ ID NO: 642721 - DNA, 101 bp, Homo sapiens
tcttgtttcctgcacttcgggagggcggggtgggtggatcacgaggtcaggtcttcgactctctcaaaatggctggggattacagggcattgaaccacgcg

SEQ ID NO: 642722 - DNA, 616 bp, Homo sapiens
  misc_feature (236)..(236): n is a, c, g, or t
cccccccggttttttctgccgctccccacacacaaaagtttcccccctctggtgggtgttttcccccccccccaggggaacccccctgtgtatttttcctgtgtggggtgtgccccccaaaacaggaccccccccgcccctttttccaggggggtgttttttaagcgcggggcacccctttttagggtgttctctaagggggcgccccggccaaattttttttttttttggggcgnatttttctcccccccctgaaagaaaaagggtttttttttttcccccccccttttgagagaccccccccccggggaaagggggttttccattttgaccccctttgtttttttttcccccaaaaagggaccccccctcggggtttggggggggcccccttaaacccccccccatttttgaccccccggggggggccccccccccttttttttttttcccccccggggggttcccccccccccccctttttgggcccggtccttttttttttaaggaaaaagggggccgaaaccccccccccggggtttttttttaaagggccccccccttttttttttttctccttttgggcccccccttttaaacttggtgttttttttta

SEQ ID NO: 642723 - DNA, 168 bp, Homo sapiens
tattttgtttgtaaaatgaacgcactctgggttctaagttcccacaccgtgagtcctttagtgtacttttttttttcaagccatcggtgcatgtcacgttgaatgcaccagttctcgtcagaacgccaaagttaaggaacgtcgaagggggatcctcctagacgtcga

SEQ ID NO: 642724 - DNA, 776 bp, Homo sapiens
ctctttccttgctaacgcagccatggctcgtgtcccaagaagcatctgaagcgggtggagtccaaagcatgatgtgataaatggaccggtgtgttgctcctcgtcatccacgtccccacaagttgagagagtgtctccccctcatcatttcctgaggaaccagacttaatgtatgccctgacaggagatgaagtaaagaagattgcatgcaggggttcataaaaatcgatggcaaggtcggaatgatataacctaccctgctgatccatggatgtcatcagcattgaccaagagggagagaattcccgtctgatctatgacaccaagggttcgctttgtggtacatcgtattacacctgaggaggccaatgtacaagtgtgtgcaaggtgagaaagatctgtgtgggcacaaaaggaatccctcatctgtgactcatgatgccgcaccatctgttaccctgacccctcatcaggtgaatgatccattcagatgtgttgagactgcagaattacttgatttcatcaccgttccgccacttgtaacctgtgtattgttgactgggggtgctcacctaaggaagaattggtgtatcaccaacagagagaggcacccgtgatctttggacgtggtcaggtgaacagatccatggcaacattttgccattcgatttccaacattttggtatgggcagggaacaacctgggttctcttcccgagaaaggatcgcccacatgtgggggcggaacaaactgggcaaaaaacggggaatgtcctg

SEQ ID NO: 642725 - DNA, 718 bp, Homo sapiens
tcagtttgcaaaatcatagtaaaagtccactctgtcttaaaacatagtgatacaatattagaaagtcgagcacttgctataagttgaattaacatcactagtgattctataaaataacttctagaatgcatgatgtgttagtgtgtcacaaatccagaaagtgaactgcagtgctgtaatacacatgtaatactgttattcttctatctgtagttagtacaggatgaatttaaatgtgtttttcctgagagacaaggaagacttgggtatttcccaaaaccaggtaaaaatcttaaatgtgcaccaagagcaaaggatcaactttagtcatgactgttctgtaaaggacaaccaaatcccttttccatttctcaattgacttaactgcactgatttctgtattaatctacctctaaagcaaatctgcagtgttccacacagactcagtgggtactggatcaagccgcctgtcccaggtacccacactctgaaatctccaacacagaggcttaaggcttgcgccacacaaggcatacttttctgtggtcttcttggactgcacctgtctgtcccttgcccttcaccatagacactcagaccaccctcacaaacacagtagtctataagtaggcattcaacctcggatctgaacattcaaacgcacagctttggaaacaagagctgggtggcttaaaaccttaaaatatgactgccgctg

SEQ ID NO: 642726 - DNA, 579 bp, Homo sapiens
  misc_feature (347)..(347): n is a, c, g, or t
tggtttttgggtgatgtggcttaaatgcaaaagttcctttttggggacatatttctgccaattaaagactagaaggggcacaactttttttttaattaccatagagaagatacattaaaaaaaatcttctgatgttttggtagccataactaaattatgggtaaaaatgtgcactatggtgaaaagggagcaacgtagtttggggttttaggtggtattggtttggttatggctttggttcttttaacagagattaaaatggttcctgggataagggattaagctttctcagaagtggctccatcattctggtggtaagaagcttaaattattgtaatggtaaccanaactcccagttattaaaaatctctcatggtggtttcctttatacaaagcaagataaagggcgtttataacactggccattacttgggcaaattggttggctaccttagtttaaaaaacaattctcaaacaaaagatctggcttcagggtgtttctaaatagcagtgattcagaattttttttaatgaaggtataatggcactaaccttcttcctgaggtctgattctgcatg

SEQ ID NO: 642727 - DNA, 216 bp, Homo sapiens
tggtatgataatgggagcaaccaagatggcttttggcagaggaaacaaagaattcattgttttcaacaatgatgaatggacattttctttaactttgcaaactggtcttcctgatggcacatactgtaatgtcatttatggagatacaattaatggcaattgcacaggcattaaaatctacgtttatgatggaacgaaaagctcatttttcattag

SEQ ID NO: 642728 - DNA, 117 bp, Homo sapiens
  misc_feature (65)..(65): n is a, c, g, or t
ttgactctacagtgatctttcatggccaggattccttctcccctgtgttttttgatgtgatcccntgtgtgtacttcttgatgacttggccatgtgatgatgtgtgattgtgttgtg

SEQ ID NO: 642729 - DNA, 174 bp, Homo sapiens
gcccaatgagctatgggacagtgtgcatttgccagggcaatttctattctcaattaacccattcagcaaatgctacgcatctgctgagtccgtatagaagcatttgctgctggacgataggatggggcccgagctcgtcgtactcctgcttgctaatccacatctgctggaagg

SEQ ID NO: 642730 - DNA, 250 bp, Homo sapiens
ctataaattcagcgaggtgaagaacctgaaccttggttggtgtccagaaagtgtcagtccttttgcaggtggtttgcttttgtctgttatgactctcagttgaaacaggagattgctagcactggtaatacctcttactttttttttcttcattttcttctttcttcctttcgtttttcttttgagacaagtgcccgctttcttctgacaggctggagtgcagtggtgtgatcctgaatcattgcggccg

SEQ ID NO: 642731 - DNA, 1131 bp, Homo sapiens
tagtgaacactgtttcaaattagttctaatggacttaactgtttgaaaaagccagtaaaatagagagtggtaatactacctagatacacttacttaacaatctgacacaggcttaagcttatcaagtagcttctatagtacagacgatgttttctgacggagactgtgcatccgacgtgagaccagaggtaggaacagtttagtatacattggttttcatttctccatgttaacactatgacaataacaaaaggctgtagcgtgtgtacttattacattgtcacaaacagtacagtgggacgccattacctttacacacaatggtactggtaacctggggaaattaggttcctggttatagaggtctattcttggacattgcccattcccagtgaaaactggctagttcaccgagaaaagcaaacaacgtattttttcaccagtgactgtcaaaagggtacccactagcttactgcatgggcgcatgtggcctagcacaactcggaactcagcgtaagatataaaataagactaaattaaagtatttctacagtgtctacttgcaacacacacacggagtccaatgctcgggacttaaggcaggcctaatgggtattacaacaaagtggacaggccaattacatatccacagttctagtgtccgtaaaatttgtgcgtcacttggcacattctaggcttgccaggcgagcactgtatgccccccaattaactcccagcagggtccaacaggtccagtgtttaaactaacacattcttcagggcaactccttgttaactttgtctccaaaccgtgactgttaccccacaggcgttcctcaaggcggcttcgcactttcttaccctttcaacttggccctcccccgttttttaagccaacccggggttcgcttatccctttagcgactttttgtagttcgcaacccccaacggtaaaatctttgtcaaaaacaaccttttgggggggcaacctgtggttaacaccccaaacgttgcgcattaataacttctcaattcggggtacttgcgcggggcgcttaagccaacaggtgtgctaaaccccttatccgtggccaacaattatttgtcagtttcacgctatagacaccggcg

SEQ ID NO: 642732 - DNA, 472 bp, Homo sapiens
cccaaatttttcccgaaaaaaattgaaattaaagtcctttggggaccccagggggggttttttttctaccccaactgtttttttcccaaaaaaaagccaatggttttttattattgaaaaaaaaaaaatgagggctttaaaccattttttaaaaggggccctttaaaacttgtcaaaggtgccccaaattaaatgggattttggttttggtttttggaggggatgtttaaataacccctttttccggggggccattaaaaatggttttttgttgatttaaaaagaatattttggaaaaaaccttttagggggcaaaacccccctggggccccctggaaaaaaatgcccaataagtttttttggtttttctttggcccttgccaattggggtaagaaccaaagtgggtttgtttaaaccccctttttttggatcctttccaggtaaacccccaaaaaaaggttccctttggta

SEQ ID NO: 642733 - DNA, 353 bp, Homo sapiens
gaaaagttatttgctgggaaagtgtccaaaagcctgttttttaaacccaaactgggcttttggtagtgcctcatcccaacccatgaaggctgttcatgtttcaccccttttcttccttcaacaaaggccagggtatggagcagggcccctgaatttgctgtaatttggaaatgcttttttctttccaccataaacggtaaaaacaaaggaaagggtgaagggagtttgggcaaacaaaacataaaaatggtggggtggtggtggggtttaaaaaacttgttggtataattgtcataggacttgcctaaaaaattattaaaattacgggagtggactcagcttttagcctagga

SEQ ID NO: 642734 - DNA, 404 bp, Homo sapiens
  misc_feature (9)..(9): n is a, c, g, or t
  misc_feature (18)..(18): n is a, c, g, or t
  misc_feature (293)..(293): n is a, c, g, or t
aacaaaaancccatcccntggcccaaaatgggtgaaacaacgtctctacttaaaaataccgaaaatttagcctaggttgtggtggtgcacccccctgtagtccccagctacttgggaggctgaggcaggagaattgcttgaacccgggaggtagaggttgcagtgagccaagatcatgccagtgcactcccaggctgggtgacacagccagactctgtctcaaaaaaaaaaagagagacagaagagaagacacagagacacgtggaagagaatgccttattggcccagcacangtgcacgcctggcctgtaatcccagcactttgggagggcgaggtgggtggatcgcgtgaggtcaggagttcgagaccagcctggccaacatagtaaaaccctgtctctact

SEQ ID NO: 642735 - DNA, 444 bp, Homo sapiens
aatctttaagtctaaatttatatgtgaaagttaactttttttaaaaacctaaataaaattattttcctatcaaaaaaaaaaattaggataaatcacagtaaagtttattccggagcatcacagattgaacatcagttagagaagagtccttggggtctggaggcaattaaagactaccaaaagaaaatagtggagagtttaggactattgtcattgatgttttccatgatcccaaaccagctgtaggctgaatatatatgtaaaaagtagagttttatttatgaaaagtattgttctaagatggaaaaacccttcagggccatgctgtatcctttttacccttctatatgacatgtctgtttatgtcctttgtggtttcttcagattttctatactagcgtgggaactaatcagggaacctgcctggggtataaaatttgtgta

SEQ ID NO: 642736 - DNA, 952 bp, Homo sapiens
gacttccggcgtgtgcgtctgggtccgcgcgctgacaatggcggctctgaagaattggtgtcgcgccgggaacttcatcttcaggtacagacagttgtttgtgtgtccctgtgtgtggctaaattaagaagcggggtcctcagaatgggataagaccatggcacaaaaatgtgaacgactgggtggggagtaaccccgggtgtggcggtcccctattgtgcacagaaatcagagcctcaattccctttcagtaggtggacacgcatttgatgcagggcagagcagtgtctttgggggtaacccaggattaggcaccctcataaccttttctctcttcaggaccaatatatggcggttggatggaaggctaattagtgaaataatacgtaaacgggcgtgttaatacacttaaactttctctttgaacggaaaagtaataccagtgtttaacttgtgggaaaacagtgaattccaagagggaggaaggactgacgtgtgggcaggtgtgatacatagggagccaagaggtgaaggagtgacttcaaaaaaacgacagaggtgttacttgaggggtggacaacccatggggattgagtggaggtggggtctttcaaagaagaatgggagggagacgtgggactatcaagagggggggaagatcagggcctctaatacgcggcagggaacaccatcaaggttggggcaacctgccggggaacacggtgacaagggcctcccggaaagcgaaaccacggtggagaggccagattagagagtccggcacaaaccggaggaagggggccgctaggcggaccggcgccaccggggaggatgggctggacatggcggcccatcagggagcggcaggtccccgccggtgtatgtgccgcaagggagcggaaggcgcggtagggacgggcagggaggacacgggacggaacccgggtctaca

SEQ ID NO: 642737 - DNA, 713 bp, Homo sapiens
acgcgccttgcgctcgaccctgtggagatcctgcacgagcgcgagtacagtttgcaggctcgcatcgcacaccggggcaggagcttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcacgcgccagtccctgcgcgaggcccgcatcactgacaagctggagaagcagcacaagatccagcaggagcccaagccccggcaaaagcaccacgaatacctcaataccattctcccagcatgccaaggatctcccggaatatcacacatccctccccggccaaatcaccaaaactgcccaacccaatccgcaaataccatgccaacaccggcccgccaacgacagaacaagaacaagccggtcgagcacgacgccatgacaagggtcacaacatcaaaaaagagaaggacaacgcacgccaaaccacgcgcccaaaacaccaggccacaggacagcccaaaaccacaaacccgccaagcacagagaccgacaccccgaccgccacacgagcaaacaggagcacacggcaagacgcccaccagaccccagcgcggtccagaaccgacacaacaacct

SEQ ID NO: 642738 - DNA, 354 bp, Homo sapiens
tcccccccccccccgggtaatttttgtttttttagtaaccccggggtttccccctgttggcaaaactggttcccaattcctggccccaagtgttttgcccccttccccccccccaagggttgggatttccggggtgagcccctgcgcccggcctttttaaacctttaaattcccttttaaagggaaatggcctgccccggggttggggctttttctttccaaaacccctcccttttctgtggacgggggcggaaatatcccccccctaggggtttcctaaaaaaaaattgggataatgtttggaatgtttccccgggctttcccgccctttttataaatagtggctttttgtta

SEQ ID NO: 642739 - DNA, 154 bp, Homo sapiens
gcattgaatgcagtatttacatatgcatcaatgcacatgcaaaaggtagtcttgatcctatggtaaagccattcaggttaacgtgacagacctttacacttcttatatttctaaaaattaatagtatatccacatgcttgcaagcagtgggagg

SEQ ID NO: 642740 - DNA, 156 bp, Homo sapiens
atcatcggcgccgacggcaagctgaacgagcagaccaccctcggtctggcctacagatacgccaccagcgatgtcgactccgacgacggcaacagcaccgatgtgaagagccaggctctgatcgcctacggcagctggaagcaaggtccggtctgc

SEQ ID NO: 642741 - DNA, 206 bp, Homo sapiens
ctcttagaggatccccgcgccagcaccttcggggcattccctgagagcccgccaccctgtctctccacggtggctcccgctggcccttccactttccttcccgagcccccagatacttgtacagcaagatcgtgcgtgtgtacttctcggaatgggcctgatccccagcactgccctcgtgcgtggtaccgcagctcaatccttcg

SEQ ID NO: 642742 - DNA, 1713 bp, Homo sapiens
  misc_feature (125)..(125): n is a, c, g, or t
  misc_feature (468)..(468): n is a, c, g, or t
  misc_feature (923)..(923): n is a, c, g, or t
acaccagcgatgagatcttaggtggagaatcggggcccagaacgaggtcccaccatcgagtgtcgcaagattcacgtgcacgaggttcgagttcatcacacactgcgtaacttgtgcctggcgtnactgtagagcttgcacgtatcgtggagagttgacgccctgcgcatatactgtggccgtactcaccctcggggcatcaccctccggcggcattaccgctgacccgggtctactgagactcgagatggaatgaggctcagtgcgaacgtggacagctcagatctgatggggatcctcaggtatgactgggtgctctccggtatgagcccttggtccatactcgtgcagtggcccattaccattgcatactcaagtccagacccaaagatatccaatggcccacactagatcgggggcccgtcgaggggggccccctctgaatgtgcacagcaaaccagtgcattnccacagcaagcacaatcgtgtacactcagcatgataacgcgcacttttccctgcataagggcacccgtggactctccaccaagaacccttgtgctctgcacagatgggcaagtagccttgatactcgttgcttggatcacatgtataccctccgcgggtgcgcaatctctagcgaccccgggggtgtaattcctagggcactgcgacgtgcgacttaccacggccgtgcatgcgtgtcgctctgtggagccgttgctttcacttgtctggagtgatggagagctggggcagttgagtgagcgtggggtgtgtgcactcggggacgctagctggctagccctagtcgaggcagcggccaaaaaaaaaacgttgatacgtgaaccggcagagaaaaaccttgtgatttaaacgggcacaatttaagttgggggttggcacgtgggccattaaatggngcgtggggccgccggctcacccggcaccgggcacactggccctggggagcctataggggagaacctggggggggccaaccgggggaacgaggcgcaggaaaatcccctggagacacccacgcaggggggccccaggcaaccccaacggctgcccgcggggtatgagaagcaccttcaccgcgagggtggcccaaccacgggtgcggggggaacacacccccgtcgggggggcaggaccaccaacctaacgccacgggacaccccctaggaacgagcgagcaaacatcccaaggaagagacccacatccccacacagcagtcgcgggtgccagaaaacgggactcgaccaggtcgaaccgactcacacactcggtcagtatcccacagatgggggcacccaccaaggggaggaggcatccaccctcggtgccgcactcgatcgtatataacaaccatggaaaaaggagcagccacccacataggttgatctcgcactataataacaggccgcaccctacgcacgccgaagcctacgaccgccagtacactccccacggccaccaactagcgcgcagacacgaccagacctcgactcactgagacctcacgactgtgaaacacatcgtagcatctcatactgcatacgatgctaggaaccgaccccgactgcgctacgtagcacgggaccaagcatgcagtcaagaaatagacaccaccctgactatagctgtctgccctcgtttgtttttttgctttcccttgtcgttctgccgccgtactcccaacacac

SEQ ID NO: 642743 - DNA, 902 bp, Homo sapiens
agcggggcaaccctcttgggtccccttccacaccgtggaagctttgttctttcgctctttgcaataaatcttgctactgctcactcttcgggtccacgctgcttttatgagctgtaacactcacggcgaagatctgcagcttcactcctgagcccagcaagaccatgagcccaccgggaggaatgaacaactccagacgtgctaccttaagagctgtaacactcactgtgaaggtctgcagcttcactcctgagccagcgagaccacgaacccaccagaaggaagaaactcccaacacatctgaacatcagaagggacagactccagacgcgccaccttaagagctgttaacactcaccgtgagggtctgcggcttcattcttgaagtcagtgagagcaagaacccagcaattccggacacaccctgtttcccccagccctctttggtaccaaagacacgtgagtcataaacatctagaatgtttcgtaacaagaaccaggccaggctgggcagggtggctcatgcctgtaatctcagcattttaggaggctgaggtgggcggatcatttgaggctaggagtttgaggccagcctgggcaacacgctgagacccatccctataaatgacaccacacaaggccggtgtggtgtaagcattcctgtagtcacagctacttgggaggctgaggcacaaggatccacttgcccacaggttccagggctgcagtgagcttggggccactgcagatccagccgtgggcagaaaccgggtttcaagaagagacacacagggggcacactattaggcacagctcagaaaagctctaaacaaacatctgggcgccaacggaaacgggccgcccatccgaaggggatacaaacacaaaggaacaataagcca

SEQ ID NO: 642744 - DNA, 926 bp, Homo sapiens
cgcagtgactcatgcctataatcccagaactttgggaggtggaggtgggcggatcacctgaggtcgggagttcgagaccagcctggccaacatggtgaagccccatctctaccaaaaatacaaaaattagctgggcggggtacgtgcctgtagtcccagttactcaggaggctgaggcaggagaattgcttgaacccgggaggtggaggttgcagtgagccgaggtcacaccattgcactccagcctggacaacagaatgagactgtgtctcaaaaaaaaaaaaaaaaaaaggtaaaatttttcaaatgggggcttcccagttcccggggggcagggccttcaaaattaacccttagggcatctcccggggattggtcaggtaattggaagggttgggggacaaaaaaatttatcaagatggtcaggtaattggacgggttgggggaaaaaaaatttttcagaaaggaagttttgggccctttttaacacagtgggtggagcgcccttgcgaatcaactttcaaggtccccgggggcgacaccagcgcccaggggtcttggacacctaagagggccatatcggaaggaacgttttgacaaaggccccccatttaacagggttctaagcccctgggcgcggcgcaaattcgcgacatccggacacgcaaaatttcttccacatcgcaatctcaatacagcgttcccattggggggacagttaatcgcacaagcggggataagcctcgggggacacaaaaggggccgggaccacatccaagagtgtgttctcggaaatggctaggggatagacggcaatactccagggaagccctaaaggtcgggcaaatcgcgagaaaccccacacattggacaacgcgcggtacacaaacacttaactcacaccacaaggggccccacatttaaca

SEQ ID NO: 642745 - DNA, 125 bp, Homo sapiens
tccacgtgcgaatatatatttatttaggaatgcacactaacagcatgacgataaactgtcattcacaaacccgtaccatgaagcacgtaatcttttaaaaatgtgttgtttttcacaaggtaatt

SEQ ID NO: 642746 - DNA, 446 bp, Homo sapiens
ggccattatggccggaatcaggtaaatggaaggttgatgattgaatatcaaatagggaattggatatgaaatctaagagtgtgagtcacttgcatatgtaaggcttggggttttggcatatttccttaggccacagggccaggtttctgagttgttccctttttcaggcctctggaaggccagtgccagcagcaggcctgggtttaaccttcttcccatgtgagctggaaaaactttggcatcttaattagcctggaatcatccacctgatccccaaccattgcctgttctcaatgaaccatgcttgggaaatggaagggcctcagaaggtcgaaatcccaggacctccaagccaaaggtgttaggttttagtgaaattggtgccaggtttaaccatacctgttgggcccagaattattatcacagcctttctgacccaaactttc

SEQ ID NO: 642747 - DNA, 1772 bp, Homo sapiens
  misc_feature (162)..(162): n is a, c, g, or t
  misc_feature (247)..(247): n is a, c, g, or t
  misc_feature (258)..(258): n is a, c, g, or t
  misc_feature (466)..(466): n is a, c, g, or t
  misc_feature (644)..(644): n is a, c, g, or t
  misc_feature (849)..(849): n is a, c, g, or t
ggtcctcggtgtgagagagcagtcgtggttgtctcctttcttcggccatggctgtgtgctccgccattgttatcagggtgatacaccagggacagagggtgaagatcattcataggctacaatacacttgtcacgattctgtcctagccttatttgtcaatngagttcctctcatatcagatgctatgcaatatgttggtgagaacgctatttagctatcatcgatcgcgagcctctctagacgcanagaattgctanagcagactacgcgccactagtcgccttgtccaacggtgagacatgtagcgtagtgtggttagctctagagatcgtagcgatagcatagaagctcatttgagtgtgctagcataggggcacgaatgcctggtgggggctaccgatagtgtaccacacgaaagttccagaccgtgctggggaggaagaaccttcagacctcgggccttcntatgactccccggggggtggggatactttgttgggggagaatcctcatgggtgggttccagcttcgagactggggcccggacacttgcttatttgcgaacgcaatacacacgaagagaacaccctttgtgtgcgcgcttcggctctaagagctaatacggttagccacagtcgaagcntatgcaaccgccgaaactagagatgactcagtcgtgcccactcctagtgtgttgctagagcctctagcgtgctgagccctgcagccacctataaccattgcgatctcgtgcgtgcgatgcctcgctagaaaaggatcctttccggttttattgcacgaggacagtttctcctgtaatacatatccccatttttagagatatacgntcccgagagggatcaacccggtttttgcgaaacggagtctccatcgcaagtaagaactagctgggccagtgccaatagccattcgctaaagggaagattggcgccattgtacaagaccaggtcgtgtgccacgcacgcaccgtcttgggaaaagattcggactgattttgcactagaaagaggttcttgcaattcgcccacgtcactttcattgcccgcacacctttgactcaccgtttttgtggggagacattgggcttccaatacccaggagcagaaaaaggctccggtgtttccggcaaccgaaaattgtcgcaaagggcgagatttacttaggccagaacccccccgcgttggcaaaattgcgcttaggtcctttacgtacatacatttcgcacggcagagcaaagagggaaggaggagcattctccttagtgctaatatgtgcgggtccgcggtgtttttagcaatagggaaagtgcggcgtggtgtcccccgacggttaatctgtgcttttgggcccatggactggttgcttttgggtgcctaggcgcgaggattaggagagtgtttaccgccgcaacggctttgggttggcgccttgtgatgagttaggccccgctagttgtcgttaatcagactattcaaactgcggggttttcagcgcaaccctgagaagatcctctgggggcgaccgtcgggcaacggtctggagagacacgaggattgtcaaccgcggtacgccagagtgtggttgacagagcaggtgccacacgcggacggacttaggggagagagaccaatcaacgacggaggagggacgtgttgtgcccctcatgttttgtttgcacacacattgaaagggcctcggtgttgaggtaagcgccctcagaaacgtctcatcaacgcaacaagcgcgatca

SEQ ID NO: 642748 - DNA, 729 bp, Homo sapiens
ccgatctctaggagtatgctgcctgattgccactgatgatgatacatactctctctagaggagctggactcccttaagtacaccgacctgctcagcttagtcaagagtatggtgcttcggtccaacctctggacatccaagttgatataagccttgacaggctacattaatcatgcacgcgcgggaactcagaatcatgatgtaagccaagcttctgcataactcttggagatgagactgagatacggaacagcatccagcaagaagcagtgagacaggcactgggccatgtcaccataacaaggagatggtgcgagactcgctgcgaggaccctgactcacagaatcatgtaaagcaggaaagtctggatctgatatctactgcacaagttccttctacatcagacgtgctccaggaagctgctagtgctgtatcctcctgttccacatgatacatgcgtccttcagaaggaaagatatatctctacacagatgaatactatcaacttgtataacatgccagaacatgcttcactgatccagactgtaggaagcttcatgtacctacttgtcagggaagacatgcatgatctgtagcagcgacacatcataagaggtggcgtaggactacagtgactccagaggaagatctctgtgctttttactcctcagcaacgaccttggcgtcttgtgccctgtgcatatacttggcctgatgggcctcggcct

SEQ ID NO: 642749 - DNA, 292 bp, Homo sapiens
aggcatgcaggcttggtgatagcttggtgtccagagatagaagtcttagttcaactttaaatttgcccacatgaacccttctaaatcccctgtgtgaatttagtctgtcagaaaaagaggaacagctctttggacactaggaaaaaaccttgtagagagagtaaaaaatttaacacccatagtaggcctaaaagcagccaccaattaagaaagcgttcaagctcaacacccactacctaaaaaaatcccaaacatataactgaactcctcacacccaattggaccaagcttg

SEQ ID NO: 642750 - DNA, 288 bp, Homo sapiens
ggaccgaggacctgcacgtcagtacccgcgactcctcaccttcgcctcccagctacaaggctggcaagggcctgcccattgtaggttctgtcatccaggtgagcttcttggaaagctatggcgaggctcacggccgccgagcagcacatcacaaacatgatggaacttgagaaggtgaagtgctcctgccaggtggtggtggccagaaaggtgcgggaggtggctgaaccacctcatccagtcctgtggcctgagcggcatgcgtgcataactccgtgatgctgggct

SEQ ID NO: 642751 - DNA, 517 bp, Homo sapiens
tctcctgattttgtacaatatctaggtgaccttctcttctttccattttcaaacgcttgatcattgatgctcccttttctcttctctctcctcctggaaaagagaaggaccaacatccccctttcccttcttcctgtgctgccctcaccctctgagctccgtcttaaccaataagtcgttccataatctgcagcagcgtcctaagacgatcagtgccttttgctctcaaagttcccccattagtgaactgtttaagtcagtttgtgaccaccggtgtccaatggatcacaccagtagcctctcttctcagatggctttaaggtctctcctaacgctccccgtgttcccccgtcgagcaagtgaaggggctcccggttcccttgatcaccctcagaaacctctctcgttcccctttggatggcatcgcccgtccccagcaccaatattggccaaagcctccttttctattcttagcgggggccccttctggccaggtaactaaatgtaagaagcattc

SEQ ID NO: 642752 - DNA, 189 bp, Homo sapiens
ttttttttttttgagacagagtcttgctctgtctcccaggctggagcgtagtaatgcaatcccagctcaatgcagcctcaacctcctcggcttaagcaatcatcctgcctcagccggtaagtagccaggaccacaggtgcttaccatcacacccagctaattgttacattctgtagagaccggggtctc

SEQ ID NO: 642753 - DNA, 306 bp, Homo sapiens
caaaaatttaaaaaaacccctccctttttattcagcatcagctattgaaaagggattttccttttttattcccgttggacatagccccacgccctgcctccgggtttgtcctttggacagagccccctgtcccctttggtggtccgggccctttttttgcagcagctcaaccccccgactccctcagatccccagggctgcagccggggcccggggttccttttttacccttttggatgcttccaagggggggcccttccaactaccaggattattaagattattaataaagatttcttttttcca

SEQ ID NO: 642754 - DNA, 409 bp, Homo sapiens
  misc_feature (264)..(264): n is a, c, g, or t
  misc_feature (409)..(409): n is a, c, g, or t
ggcacgagtccaggtcttatagagccacggacacgactaccttgttgtcaacacgctgagccgcgctgacattcacctggtggaacttctctactacgtggaagagcttgactctagccttatttccagcttccctctgctgaaggtgacccatttcacagtcttcagagaggcagacccacatctcccatcttgtgatcttgtatctgtgccctgtgactgagcatgtggtgaccccagccttctctcaggcctatggtgccncaaggtctccacaatgagctttcaggctccaattctgaggtgagtacactattgttatggagaggagatttgtagtgcatgctaccccgcacagagtattatgcctcctattatggggacacagggcccagcatgtctcccctcn

SEQ ID NO: 642755 - DNA, 108 bp, Homo sapiens
gttctagaggatcccgtcatagtcaacagtaaagctaaatttctagatataacaatattaaattgaacaagcatataaatgcatacattctcatggttacagtcactc

SEQ ID NO: 642756 - DNA, 111 bp, Homo sapiens
ttcgtatattctggaaggcaggaactgttcacatatgttaaattaagtagctgccagtattgcatgtagaaaatgatgaatttaacttgacaaatgacctccatccaattc

SEQ ID NO: 642757 - DNA, 316 bp, Homo sapiens
  misc_feature (16)..(16): n is a, c, g, or t
gcaggatccccccagntcttatgcattagtatgaacatggtgagactttcggttttatatttctcgtatttcacatgggtgaacgccggagcttttatttggaataataattttcctcctaaagcaaaacacattgcagtttaagtctctgactcttgcctttccacctgcgtttctccttgggccctgcttagctctgcttgaatggaaccagtgctgattctggagcctgctgttccaacagaacagggcgctagcatttcatcttgacacactagactacagctcagaagcccgatggagcagaggatgtcac

SEQ ID NO: 642758 - DNA, 512 bp, Homo sapiens
agcagctaatgaagagagccataagggctgggatcccaggcaccttaggaacagctagtcttttttattttgcctctccaaaaaaaatgttaaaggggacggtgtctcctgtcacccaggcgggagtgcagtggaacgatcgtggctcatggcagcctctaactccggggctcgggcaatcctcccacctcagcctaccgagtagctgtgaccacagtgtgcccctcaccaggctaagcataattttttaaattagatagtacataaacgtcccaagattagaagataaaaagacatgagggactccatccataatggtgttgggagtgtaagggtccagctccattcttcggcacagtggatatccagtttttacacaacactgtgattgtaatgaatgccactgaatcatacactcaaaaatagctaaaagggcaaatggtcggtaatctcttttaacccaccattttggaaatttatttataccaaaaacccatggaatagttaatgcg

SEQ ID NO: 642759 - DNA, 824 bp, Homo sapiens
tgggcgaagaggtaacagtgtcccaaatataatggcctaagtaacctaggaaatggttgacataacacagggttcaggggtgtcattaaagacacactttttgccttgacctcagttggtttgttgccttaggctatccacctctcgatcacaagagctgctgtataacttccagttttacatctttgtaaattgtatctcaaaggcagaaaaggccatttcgtctctcatttgttttatccatgaggaagatttttaacaaaagcctccagaagatttcccctcagtttccattgacttagatcaggttacagagaaaggcaagtgtctgacatttgggtctcgtgtaagaagtagacgtctgtggaaacagacaagaagctaaagctaaggtgtgaacgaatggaatcggcagcccagtgcccttcccaataagaacaggttgaccataatttactcactttttcttgtgtagaccattttgattatctgcagggtatacgtacagcaggtgccagagtgaatgttccttgtacattcttgagttacatgcttaatatgttccttgagaaagttctaaaagtggatgatagttgactggtcatagggcttacttatcaatttacccctctattagaccatatgatttgaaattcctcccctgcagattatcttggcaattgacattctatcgtaagtaggccagatcacaacaggctgtcgttcaaatgtttcgcttaaatactgagtagatgattaggaagaacaaacacgggcagacggtccaagaagacaagtaaatatcaggactcaacattttgttg

SEQ ID NO: 642760 - DNA, 103 bp, Homo sapiens
gcgttgtgttactaacggaagccactgctgtagtaggcacactgggcaccaaatgtgcaatgtgcaggtggtgatccccgttcctgacagagtcgtacagttc

SEQ ID NO: 642761 - DNA, 108 bp, Homo sapiens
ttttccttccataaaatattttttacttctatataacttctttttttatttttttgagatggagccttgctctgtggcccaggttggagtgcagtggcgcgatctcag

SEQ ID NO: 642762 - DNA, 303 bp, Homo sapiens
tgcagctctctctgatgcgtgctagcattccacatagatgtgacttgctcttccttgcttcgtgcatgatcgtgaggctccccgggcatgtggaacttgtaagtccaagaaatctctttctttggtaaattgcccagtcacgagtatgtcttaatcagcgggatgaaaagagactaataccaataacgtaacaagaacaagaatgaactaattgacatgaaggactcacctgaacaattacaccaaaagagcatcttcttctttctctaatctacacaaggcccgtccacaacaggccaattc

SEQ ID NO: 642763 - DNA, 820 bp, Homo sapiens
agtttctatttgaatacaggacgttttaaatggcagtatttcatttctgtcaattatgtgggtactttccacaaatctataaagaaggataaatggtaccatcatgtttattataatcctcaagagaaaatgtgtaatgtcaaaagattgaatgtgtagttagaaacacattatgtatcttaagttacatttctatcagtacttttattaatattgtgaaagaagagcagctgaatagtagttagcttaagtagtgttctccaagtactttgtgctatcaatgagttcttctcgaaaaaataattagttaggccaggcacaatggctcacacctgtaatgccagcccttgggaggccgagtgggcagatcacttgaggtcaggagttgagaccagcctcgccaacatggtgagaccctgtctctactaaaacgataaagaaaccaaaaaaaatattggccaggtcttgggggcacacgcctgtaatccccagtacccaaaatggcagaggcgagagagaccatttgaagccggggagggcaagggctggaggcagcgaggatctggccagggacccagctgaaagagggagactcgtggtcagaaatataattaacagggctcagttcaacgcctgagggtgggagccactccgtgtaccctagagggcgaccctctcaatatggggctctccccctgagtccaaattcagcggaagcacaaacaccgcttaaacgcggggggatggtaataacacccgaggtggacgggcacagctccgtcagactcacaggcgccggggggcgccaccgggggtctca

SEQ ID NO: 642764 - DNA, 134 bp, Homo sapiens
  misc_feature (89)..(89): n is a, c, g, or t
aaattaagaatatctgtttgtatacaaacagatgctacaagagcctgcttcagatacttacatagttttgggagcagatcgagattatnagcagccaactagcagctgctgagatagtcagtgagctgtatcag

SEQ ID NO: 642765 - DNA, 225 bp, Homo sapiens
acctcacagacaacacagacgtcagaacgaaaagcagactcgacagggatttactgacttcagcggggtctcccagtgggtgcaagataagccattagtgatgggaaatgactcctccggcgccacctacagtgtctacattgaaatgcaccccaggctccaagtccccacgaggctggagacgccttcccccgatgtcctcgcacccgcgccgtcgcctacgca

SEQ ID NO: 642766 - DNA, 1847 bp, Homo sapiens
  misc_feature (1537)..(1537): n is a, c, g, or t
  misc_feature (1539)..(1539): n is a, c, g, or t
aagcactagctctcccctcttcccgagagggaaaaagctctctgctgctcccttctagttggcagcaaggaagaaaacgagcaaccactcagtgtgggcagaagaagacactactctacctactagggagggagcactcccctcgggggataaaagaccaaccccaccaccccgcgcccttctgctgaagagagagaatactctcctcgctctcactcagcactaagtaatcttatcccactcaggcgggagggatagtttctctgatgcgcctcacttttctgtgctgtgtccgtgtctagacacaaacacaaagagaagaaagcgccacttcctccttcctccctcctgaggtagttcactaccaggcaggagaaaaaatcatctgcttggctgtcgcacgcacaccacaaaataaagaagtggggggcacaccacaacaagggctcgtcctcacgccaccactctcttcttggtgtggcagacacacgcccttgtgcgcccacccccacacctgctgtgggatgagtgtcatactacctgtctaggcagcagaagagaaacacgcacggagggaaggacaaacacggtggtctttttccggagcggcaccccaccgtagaggagatgacgaccctcccccccctcccccttcgcgttcttcaccacgagcggcgctcctctcttctgtggaggagcgtcctcctcccccccccccccccccccctcttaatattctccttcctcctcccccagcagagcgcaagccaccaccactcgtcggctgtagtcctccccctcctccgaggtgtggagaggagtggcgccaacaacacccctcgggtcgtcatcatcagacactgccgctgagaagagacaaacacaaaagagttgaggagggagcagccaacaacacgagagatagtactaacacacaactcctcttgtcttctaaaaaaacaacacgtcctcacacacaactctctctccccacaccctcctcttctctcccctctctctgcagagcgtcgggttgtggtcatcacacacaacaacacaacaaggaaggtgtcgtcctctcgacaacacacagaggagacgacacacaacttctctcatcatcacaacacccccccctcatagagagtgtctctcagagatttctctcacacagcagcagaggtatactctcttctccacttctcttctctctccctctctcctcctctgcagagagagagtgtcgtctctccacaccacaaacatgtgtttccaacacacgctgtctctcttctctcctctcacacagcagagtgcgggcatcgaacacaacacacaacactctctgtgctcgcaacacaacacactgtcaacaccacactctctctctctctctctctctcacacgcggtgacacacacacacacatatctctcttcgcgcacactctcttctcctctctgagagagatacgcgagatgatcatacacacactctctccacacacactctctctctatataataattctcacaanancctctctctctctcgggagagagaccacactctctccctctctcttctggctctcctctgccccacctctgtgggtctctctcccacaccacacacacaccggctctctctctcctccttgctccacagacccccacctcacaaggtgttataacacacacaagaaaaagtctcggagagagagatctctcgaacagaaaaattagagagtttctctctctctctttaaaactccccccacaaacccccccccctcccccccctctttttctcacaaaaaaaaaaataaaaccttctctctctcttta

SEQ ID NO: 642767 - DNA, 222 bp, Homo sapiens
tctcagcctgacctctgaatagatgggattataggtgccgtgtgactcaactggctaatttttgttttttttttagtaggggggtgggggggtctcaccatgttggcctgggactggtcttgaactcctgacctcaggtgatcagcatgccttggcttcccgaagttctgggtttgaaggtgtaggccaccgatgcttgcccgtgccaagcgtgctacttca

SEQ ID NO: 642768 - DNA, 406 bp, Homo sapiens
  misc_feature (54)..(54): n is a, c, g, or t
  misc_feature (60)..(61): n is a, c, g, or t
  misc_feature (88)..(89): n is a, c, g, or t
  misc_feature (116)..(116): n is a, c, g, or t
taggatccccgcacgctatccggttcaataaatgatgtggggatagctgacagncatagnnagaagaataaaattggacccctatctnncaccatatacaaaaattgactcaaatngattaaagaattaaatgtaagaccttaagtataagaatcctagaagaaaacctaggaaacaccattctagacattggtcttgggaaaaaaattatgactaagtcttcaaaagcaattgcaacaaaaacaaaaattgacaagtgggacctaattaaagagcttctggacagcaaaagaaaccatcaacagagtaaacagacaacctacaaaatattcacaaatgatgcatccaatcaaggtcgaatatccagaatctgtaaggaatttaaacaattgaaccggatagcttg

SEQ ID NO: 642769 - DNA, 1254 bp, Homo sapiens
gttatatgtgtagcttcagaaactaagttacaacaggccaggcaaggtggctcacgcccgatagtcccagcatctctgggaggctgaagcggctggactagcatgaggatcaggagcttcgagaccagcctggccaccactggacgaaacccgtgtcgtctacaaaaacaaaaacaacaaaaaacacaaacaaaacaacagaggggacggcgcgacccagggcaccccgagaaagaggacactaacgacaatataggacgcgggcggagggaggagccccactccacgcaacaggagagaaagcgcggacaaaacgcgcgatacaccacgagaaggaacccggggggccaagaggcaaccgcgcgcggagaggtgacctccacacacccgtaaacacacagaccggccgaccgagcggccgaaaacagcagaagcaggcgaccgacaacaaatgcgacaacacaaaccagccagacgcacacagcgagagaacaaacaaagaagagcgaacatacaaacacaaagaagcggggctgaatcgcgcagcgcgtccgcaccacaacgcacatcactaacacgaacgcacaccacgcgcgaccgcgagggagaagccaaatacaacggcgacaagaagacgacagcgaccggaagagaacgaaggggacacgagccggcggggacggcgcggcagcacagccgcgtgcaccaggagcacggcagcagcacacacggcagacggcggggggcacagcaggagcacacacaaaccgagacggcggaggcgacggcacagagcggcacgacggcccacacgaaacggcgcggggaccacatgacgagtggagaggcagcgctacagcctgaacgacggggaaacaacaaacgctggggacaggggaagagcacgaagagagaggggaaagagtaggacagaacaggagaaaacagcaagcacacccagacagggcatgcggggcgagggacaccggaggacagagagagcgaagacgaacgagaacaagcaagcagcggccggcccagacgaacaccaaccgacgagaggaagcgagagagagcccagcaccgccgagaacgggcgggatgaggggagcgagagcaaacacgaacacgcccggagagcgggagggtgaaggggagcacgaggacagaagacaagaagaaccgaagagagaggacagcggcacagcaagaccgccgacacgggatgaggaagggcacagaggacagcagaag

SEQ ID NO: 642770 - DNA, 1538 bp, Homo sapiens
  misc_feature (1537)..(1538): n is a, c, g, or t
tggactaaaaagccaaggtctttaattaaagggtcccgaaggggtttccccatggttatttccatgccagccagggctccagggaacagcctctctctcggggaggttaccgggtgtggctgtgggcctgtggggcccggttagcacaggggcttataagggtattcgtgccgtgcctccactctccagcggggccaggaggcaccagcaggaagtgccgccccgaacttcggctctctgtggggggggccccttggtgggcctgtgcccttctcctttatagcctccagtgtgtgtgtgcccggggaaattccccaggttaatttcccggtgtggcgcagctctcgcggagcccgtgggcaaacttatagaaaatcttccctctccaaggttgttcacacctccgaaggaagaaagaaagcgcggtcctccttgagagagagggggaagcgagagaaccagaggggtgtccagaagtgtggtggcaagacagaggtgtgtacacaaagagagtggtgtcctctcccaagccgtggtgggggctctctctcctctcgtgtggtccctctgaaacggtgtgggtttctcgggtggtaactaacactaagtgtcagccgagggctctccccccaaaagataccccacgcggccttgtgtctcccgtgtgtggtataggaggaagaaaaaaactactgagagaactataatcaagaacacggtgtgtgagggctcccccaagagggtgtgcgtggtgctccctacaacaccacaaagacgggggaaaacaacactctgggtgggaggagaatcaccagaagggggggggagaaacacacaatatttaaataaaaaaaacctactagggaggaaaaattctaaagcgcaaaaagacctccaacacagagtgtcgccgaggagaaaagaaacagaagagagggaggaggggagagactaacagacacaaaaaaaacccatttttaatgtaacaaccaacaaaaaaccgaggggtgtcgggtcgggggaaaacaacacacacgacaaaaggagggagacgactttgatgatgtcgccaaagatatattaaaaaagacccccctgcggaggattagcaacccacggaaaagagggacaagcaaaacaaatacataccagcggcaaaaaatggtgagtcacaaaaggagcgaccacacggagaagaattgtagggagcaccaaaagtgggcaccaaagggaaaaaagaacggccccggaggaggggatttcatgaaaaaccaaaacttgtgtgccacacatatataatctctcctgaggaagagaaacaaacaacaattctttaggtcggacacccacggaaggagaacaccacaagattcaccccggaagaagagagacaccctcgcaaatgaagagaaatcaatgatttgaggggagagcctcctgatgagcccccaagaatcaataaaaaaagcgggtgcagcaaaagagcgaagagctagcagatcaatcagatgacaacacagccgcccaaataatatgnn

SEQ ID NO: 642771 - DNA, 779 bp, Homo sapiens
ggggggagtacctattttccatgagggggatgaaatactggagctgttgtagaagaaaaacttctgatttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgacacaacagattgggtgggagatggaaggaaggctattacattatttccgaattttaatactgtgtgaagtggtggcttgctgcgtgaatcttttggtttggtggtggggtactgagatggggcttttaaaggttaacattagggttcttaaaagccaaaaggaggttggcttttttgggcccctcatctttcttttggggtatggaagaatgattattcatttttcccttctgggaggaacataagtggggcctatactgaaaaaggtgggaagaggccataacatattggcggattttttgttttttctggtaacgttggactttttt

SEQ ID NO: 642772 - DNA, 260 bp, Homo sapiens
gaggagacccattctataccaacacctattctagatttttcggtcaccctggaagtttatattcttatcctaccaggcttcggaataatctcccatatgtaacttactactccggacacgaagaaccattaggatacgtaggtatggtctgagctagtgatatcaataggcttgctagggtagatcgtgttgagctgcagccatatatttacagacagaagtagatagtcgatcgcacgagcatcttttatctccagcag

SEQ ID NO: 642773 - DNA, 657 bp, Homo sapiens
  misc_feature (28)..(28): n is a, c, g, or t
  misc_feature (77)..(77): n is a, c, g, or t
  misc_feature (117)..(117): n is a, c, g, or t
  misc_feature (122)..(122): n is a, c, g, or t
  misc_feature (145)..(145): n is a, c, g, or t
  misc_feature (162)..(162): n is a, c, g, or t
  misc_feature (179)..(179): n is a, c, g, or t
  misc_feature (196)..(197): n is a, c, g, or t
  misc_feature (214)..(214): n is a, c, g, or t
  misc_feature (230)..(230): n is a, c, g, or t
  misc_feature (235)..(235): n is a, c, g, or t
  misc_feature (305)..(305): n is a, c, g, or t
  misc_feature (309)..(309): n is a, c, g, or t
  misc_feature (321)..(321): n is a, c, g, or t
  misc_feature (339)..(339): n is a, c, g, or t
  misc_feature (385)..(385): n is a, c, g, or t
  misc_feature (394)..(394): n is a, c, g, or t
  misc_feature (457)..(457): n is a, c, g, or t
  misc_feature (493)..(493): n is a, c, g, or t
  misc_feature (495)..(495): n is a, c, g, or t
  misc_feature (643)..(643): n is a, c, g, or t
catacatatatatatatatatgtatgtntaaaatttcacagggatatgcttttttttttaaagactgaatgtgttcnccatttagcctgtagatttatttccattttccaaaccccngcacncagagaccccagcccccaggagnagggtgtttggggaccncccaatggaaaattttngaggcccggatgaactnngccaaagggggagaggntacagagggagggganatttncagctaaaaaaaaaaacggggggagtttggactgatcaacttgagatttaaaaactgctattccttttgntctncctagcatcccnccccaccctctgagagcncctcaggcttagatagtgaagtgaacaaatgccaggggcattttgnacttaagtnccaaagtaggaacattttatacttttttctgtattgtaataggtagttttgtatgaaatcttncccccccccccggtgtactgcattcttcccagcatngngcattttccctgggcttatttgaaaattttactgttttatacaagctcgtttagtacatttttctatgttttaccacaagttacaatttgaaaagaaaactattttttttaaatattccattgttaactgaatgttactgtttccacnccagcaactacatg

SEQ ID NO: 642774 - DNA, 126 bp, Homo sapiens
gctagaatgaccgtgtgaagctagccctccggctccaagaaggttatctcctcagccaacagagctgtggttgagtgtggtggctggatgtgtggccgaattgacaaacccgtcttgcgggggctg

SEQ ID NO: 642775 - DNA, 544 bp, Homo sapiens
ggtcgcccttttttttttgttttgggtcaaaattagtaaactttatttaaacttcaaaaaaataaaataacagacaaaaggcagttaagcttggttctccccgaggatcagtgtaaccactcacagaggaactacccctaagttaaaataccctttacccgccccgcattcaagccacaggcaaggaaggatctctcaatttgggggacaggcagggggtgtggggtggggtaggagtgagaacaccatggggccagtgagttctaccagcacaaggtggagaacaagacaagaatctgcatcagaaacgggactccagaagttcaccgggagctcgtgccacaaggctatttatgtacaacgggagctggggctggggggtagacgccccgtgagggaggcaagaactggcacggcagcacggggcaagctggcccggggccctagcccgttgccgcaccccaggtgccctcagttctcctcgtcactggtcatccggggctggatagccgggctggtgagactggtaggtggggctaggtgg

SEQ ID NO: 642776 - DNA, 127 bp, Homo sapiens
tctagaggatccctttagcaactggttgagactgagctatagttaatctgttgtgacattctggatgtactgcacaaacacctcattccagcagctaacactggcgagctccaaggttttcctatat

SEQ ID NO: 642777 - DNA, 1248 bp, Homo sapiens
  misc_feature (280)..(280): n is a, c, g, or t
  misc_feature (894)..(894): n is a, c, g, or t
gcagcgttccagcccgggttcgtgtcgccatggagtgcacgatcagacgtgagccagtgatgcggccaactgcagcaggcgactggcgtccggcctgcagatgagtgcacgttcacggtacggcggaggctgcaccgcgctcggaagttgcgcgtcccacacgaccccactcgcgggacctctccgtgctactttagcaggggtggagtgaacgttggtgcgctgccagggctgggccatctgcgcggagccaggcgcggtcacgagcccacttgaaggngttgcttgtgtgcagctggcggcgctgggaccccctcgacgggtccgccgggcggcctgcgaaacgcgatgcgcacgcttgtccttgcatgaaagctcccacaaggcttagactttccctcctctgggaatgagcgctcctagtcggaggaccccgactgggccgccccccgcattccccctccgagtgtaccccatatcgtcgtcgtgagtgcgcaccgcgaaggggtccgctcaatggatgggcacgaaggtcggtctacggtctgcacaccgcgttgagcaaacagcaaagggggctgagcatttcagggtcccccccccggttgtgggactgtgtctcaaggggaagttatgcagacgccgttgctcccccaggaagggcccccctcggaaagggttcgcgcagccggggtccttcgcagtggctctcgaaaggcgaacttccgttgcggtacgtaaaacgttcgtttcgcaacccttttgtgcgccgcgctttccgcgcaattttgggacccgaaaaccgttgggtgtctccatcgcgccatggcggcctaccgggactttgccattgccactcctttgagcggccattgtggttgttggtgctcagangaggcgaaaagttgggagcttggccatttcccaatttggaaccacggccatcggttgtgccgcgcctttcaaaggacgccaccattttgctttcggaattttcccatggcgggaagagaatccctggttccgccttgatggcgggaaaggagaactggggacttgccatggttgaggccaaagttttggtcctaggctaggaattgcggccgccggtccacagttagaaataattgggccgaggccccaaaaaaggcgtcgtgcgaacgctgtggggcacactgcggtgacaacatccaattcaaaacacctagaggcgcgtctggttgctccccaatgtgtggcttacccctt

SEQ ID NO: 642778 - DNA, 534 bp, Homo sapiens
ggccaacttaatatatatatcatcttcatatataccagaaaaataggtggccattactaaggtggtattccatcccaaggtatgtagaagatgtcattgttggaatgacggtgttcagatagcactttgtagcagatagggtaggttacttgtatgtggtggggtgtgaaatcataattcaggtatttacaaaaagaaaaagtattcccaagttacgtacattgtaatgttttttaaaacttatttgtaaagtataaacttgcccagtgtattgcattgaactttatcttcaaaatcaaatagaaaatagaaactgagtggaatgtaggagcttttccatggctagtcatagtaaaggccacatccagctgtacaatatgggaataacaaggctttaaaagctatctggggagagaaagggcaatgggaatgaaagaataatttagtgttgtgttgttgtaatgtctctcctctaagtcttcaatttaaagagaattctgtattctaatttgagacatggtcagaggaagttaa

SEQ ID NO: 642779 - DNA, 112 bp, Homo sapiens
ttttcggcgcttctctggtcgtggagccgggcgttgcatgctagtgcctagtgggccacttttggttacgtcagtaactgtgctgctgcgcggatgaagccgagatcgcctg

SEQ ID NO: 642780 - DNA, 107 bp, Homo sapiens
ccaatttaaagttgaactaagatctatcttgtgagaacagctatcaccagacgagctacatatgacggtgtgctcttttagctgtccttaggtagctcgtctggtta

SEQ ID NO: 642781 - DNA, 731 bp, Homo sapiens
  misc_feature (570)..(570): n is a, c, g, or t
tagcaagctagaggggctcgattggccgcacccggtagcgggcggagagcggcatcttagatgcgtgcatacataaaggctctggcgggattggctgccgcgttgtgggctggtccgcatgcatctgccagcgtacctaggggtcgagagtccaggaagctccttcgcccgacgggggcggggaacctcacaagacgaaccggacgtcgctgtctccgagtctgcaaggaagacagttaaattctggtaaatagcgacgtcaagtactcgatggccagcagtcttaaatgaagatcgagaaggagagcagaagtcacgtgtcatgtgacaggagacctttttgcatgcccgagaaaacgagacgtctgttagacccactgatatcagtgaggattgtcgcactgggcgctgggataggctgtcctctttacgacgaaattcggaggggtgcaagaacttgtacatcaacgatgggatgtggtcttgatcgtctgcaatcgggccacatgtactctgcgatgatcgaggaggtatggaggtacgagacttcaagactggattgtgtacagnactcgtgaacgcagatgcaccaatcctaggcatgtggcccgccgttctcgttgtcgttcatctctaacggtggccgatatcgagctcgcgtaaagctagcttttagactagtgccagagggcaaagttacatggagcagggagtgttgtgtagacaagaca

SEQ ID NO: 642782 - DNA, 1334 bp, Homo sapiens
ctgagtatcttccttgcgctcgctggtgttgcctcctcacgtgtgcgctttgtcttttcctcgtggtgcgtcctcttgtcactgccctctctggtgctgggtggttggtctgtggttactgtggcccttgtttttctgacttgggactgtgctctctgcacttcgagtgcgcgcgcgggtacttgtccctccggcctgttggtcaatttctgggggatcccctgtggcctcgggtattgcttgctctcgtcacttttgtagtgtgcgtcggttccgtggtcgcgcttctctcctggactattgaagcttgcttctctatgtgactgatcgtgtgattcctcactgggctgcgttgtcgctgagttctttgtggtatcacatgtaaaactgcgcagttctctggtttacacgccatcgtcctaccatgcctaatgcggctggaagattcgccttagtgtgcctctacgtgtttctggcggtatggtactgctgggcagccccaaatgtgcggagcatattcagttccgccaagcttgtttgccccaatgtccccggtgacaccgctgactgtcccttgcacacgcaattgtgataaccgctctgtgcttgcactctactgttcatctgcctgcaggtactgctggagcatggacagtacaaccgatccacagctactatggctaacgccaacggtttcttgcgccatggcctgagggacctcggtccgtcccaatgttccgacggtcaatgtgcgtctcatgtcctcttgcacgcagattagggctccatcctcggacgtacaggcacccttgcagactgaacgtcaagcccatccgtagacgaagctgacccaggaccaggtatcgatcggaccgttcaaatactcttgcccaggatggctctgactgttctgtctctcgcctgatgctggaagaagcgagcaatacatctggccatcatggtgatccatccctccaacccccacaaggtccctcttttggcgagatcaactggggggccttttggctgtcacgtccctgtgcattggtctgacccccaggcccctatcccccagcactggttcctcctctccccagcctagggaacgatgtctcactagtccaccttccctatcgggtctaggggagcaaggggttggaccaggacagtgaccttgggaggaaggggactactcgcgcccacgatcagggagagatgtgagcatcccgggtcactggatcctgctgctgtaatgggaacccctacccaccatttacttctccacctcccgtcctccccatcattggtttttttttgtaatctcaactgtgccg

SEQ ID NO: 642783 - DNA, 1291 bp, Homo sapiens; identical to SEQ ID NO: 634055
  misc_feature (708)..(708): n is a, c, g, or t

SEQ ID NO: 642784 - DNA, 355 bp, Homo sapiens
tgtggagcccccagcccggggggtattccggtcctctattaattccttaagggagcctgtcctaaaaactatggctttaatgcagccaggcctgcttatctccccgagggagtttttccaaaggggcataaaaaagccaaagaattttagaagatgaatccgtcccccccatttttctgggaagtttgcccgggtagtgaaagggccaccgtaaatgctgaaaccggccctaaaatgctggctttgattaagggattataggccggcccccttggaagcttttagttggcttttgcccaaggggggtaattccgacccccttatggtttaataaaccttttttttttaaaatgga

SEQ ID NO: 642785 - DNA, 463 bp, Homo sapiens
gggctgcaggaattcggcacgagcaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacaca

SEQ ID NO: 642786 - DNA, 1622 bp, Homo sapiens; identical to SEQ ID NO: 634014
  misc_feature (708)..(708): n is a, c, g, or t

SEQ ID NO: 642787 - DNA, 529 bp, Homo sapiens
cagtacatcatacacttggtttatttggagacagcttggctcggtcgcccaggagggagggcgggggggtgattcagactcacggcaacctccacctcgggggttcgggcaattctcaggcttcagcctccggagtagcggggataacgggcccatctcaataaaatttaaagaagtaagctgaatattccggccggtagtcctagctactggggaggcggaggtgaagggatccctggagcccatgagttggaggcggcagggagcggggagggtgccaccacactccagcaggggtgacagaacaagatcttatctcttaaaaaaagaaaattactactaataacggcatgggtagtataaaatataacataataggaaatatctaaaagggtataacacacatactcaaataatctaaaaaactccactcttaattccagtaagtataggcatgaatatattccatccatcagtccatctatgggccggtccattctgttattctgggccagcattcccaaagggt

SEQ ID NO: 642788 - DNA, 1107 bp, Homo sapiens
  misc_feature (1107)..(1107): n is a, c, g, or t
tttgaagagagagttcaagagggcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaatcaaaaaaaaaaaaaaaaaaaaaaaaaaaaaaaaaacacccgggggccctctattgggggggggggaaaagggggcaagaaaggggccacgggcccaaaggggttccgggacccagattctgggcacacacgcgcgaacaccgcggcggccaccaaaagggagccgccaaaaacccgaaaccacgcgtaccgcgataagaccgcgcacaccccacgcgcacccccccggcacgccgcgcatccacctcgcgggaccaacgcctgcaaccaacaaccagcgggcacgagagacccctccacaccgcccgaactaacaccaccctaccggcgccggcagacgcccagggcgccacaaaagcagaacgacgacggcacacgcggccacgcagaagcaagcgaccgcgcgaggagagggcggcacaagagaaaagaggaagacggaaccacccagacgcgcaacgcccacgcaaggctcgcacaggcggataatcggcacagcggagacaacaaccagccgaacgacgcgacacatccggcgcgcctcaccaacgagcacaacacctgacgacggcgccacgcacacgcacagacggcgacccgaaccatgcgacgccagccagaacgagcacacgcgcagcgttccatcn

SEQ ID NO: 642789 - DNA, 827 bp, Homo sapiens
taactaatgctaaggagttatttagattaacataggtgattctgaccaccaactcttccttcctgaatctcctatagaatctgacagtctcagagagctgtcatagcacatattagactaatatgttgacactttgagagatgaaaacttgcaaggagagaaagtagcctacggcacagttatgtttatcatcagtaggtggcatcctcatttcctcaggtagccccccattttcacatgatgtgtttgaaggttaaatgccaccaagaagtgctgagtcagctataaaactaagtccctgaattccatggcccttttaaatatgtaatcagttcaagattgaaaataaaaaattaagcattttcgttaggtagagctagtgcgtatttgagacggagtgtgcactcttgttggccaggctgagtgcaatggcgccatctcagctcactgcaacctctgcactcccggattcaagcaattctccttcagccctccaagtagctggggttacaggtgcccggcacatggccagcctagttgttagaatcgacagtagagatgaggtttcaccatgtgggcaggctgttcttgaatctcctggaacctcgtgatcacccccaacctcggactatccaaaggtgctggagttacagggcgtgagcccacggtgcccgagcttggccgtactaaaaataccggattattccaaaagaaggaccctggaaaagaagtgctcgcagggaaacacgggaagataaggcccacattgggggagaaccccaacaaaaaacaggcatacagggcgacaaacagcaacgggaaaaacg

SEQ ID NO: 642790 - DNA, 621 bp, Homo sapiens
  misc_feature (23)..(23): n is a, c, g, or t
  misc_feature (25)..(25): n is a, c, g, or t
  misc_feature (621)..(621): n is a, c, g, or t
ccgcccacgcgtccgcggacgcntnggcgccaccgaggtcgcacgcgtgagacttctccgccgcacgccgcccctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaactcgagtttttttctttttttttttcatattaaatataaatatatatttttatgtatttggtaatacatgcatatatgctcatttttggctttgaatacagggtacttactacactttn

SEQ ID NO: 642791 - DNA, 781 bp, Homo sapiens
ggggctctaaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggtggaggaggcaggaaccgcgatggcgcctcagaaagcacggcggtagggggagggggcgagctcggaggcccagcagcggggtcctgggggaggctggcttcagagaggttacggcaggaagtgtggcggctgtgcgacggcttcgggcggcaaatccaggcaggcgggagctgtggagggggtggcagttactcggacctcctcctcctcctaccgcggactggcagatgtgcagggggctgcgtgatgttaccggatgaaagaagccgaaaatggagcacgtccaggctgaccacgagactttatcctccaggccttgtgagaagccaacacagatctatagatatcttcgaactcggaagtctcatagcaccaatattttggcacagaactcattacttacatgtctcatctgaaactccagaacaaacatcaaaaggacaacatttaaagttgatgatactgttactcaaaagtagcagaacattgaaggagagcaagaatctcatagctagtcagctcatttgagataacgtaaatggtactccacaaaattgtagccatcccaactcgaaatgaacaatcgtaccggaactgctga

SEQ ID NO: 642792 - DNA, 469 bp, Homo sapiens
  misc_feature (29)..(29): n is a, c, g, or t
cttcgaggccaaagaaattcggccaaccnaagtgtcgccaccgaggtcgcacgcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacaca

SEQ ID NO: 642793 - DNA, 469 bp, Homo sapiens
  misc_feature (18)..(18): n is a, c, g, or t
  misc_feature (24)..(25): n is a, c, g, or t
  misc_feature (33)..(33): n is a, c, g, or t
taagcttacggctaggtncgggcnnggtgttantcgccacgcgaggtcgcacgcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacaca

SEQ ID NO: 642794 - DNA, 450 bp, Homo sapiens
cacaagtggggcatgcttgtgattttcatcttgattacacagatacactttttcaccaagacggggctgagtaaaactagtgccactccgagtaagtagtatctagcagttgtccacctaccgtgtgtcttccctctgcaggagtccagggtgtagatggtggccagccccccggacaggattccgaggatctaggtgtcctcgctttcaccagtttcgactggtctcctgagcctccgtattttgattcctggatcccacggttgccacaacactcccgtaagacagaagcgcccacacgtttggggttgtgaagcccattcgcaagaatacacgtttgtcactctccgaggagcttcgtgtgttttgatacaaatataggttctagcttgggctacaatcatacaggaacttactttgtggttgtttacgacgtcccagacagcccca

SEQ ID NO: 642795 - DNA, 710 bp, Homo sapiens
  misc_feature (90)..(90): n is a, c, g, or t
  misc_feature (270)..(270): n is a, c, g, or t
tcgtttaaggagaactgaagttttttgtcatctgctgtggctgttctatgaaccaccttcttctttctgcgagcagttcctgtgcccacncaatgcgcacttgtgcctgcagtttggcgagtttttcctggttcatgattgtttctttcattctttgttcgggagcgaaaattatacgggtggcccgcgtcgggggactagggttggtgctcaaggggtctcgcggtggaccaccgtgagattatggcgcacacacgcggggacgcaagncaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacaca

SEQ ID NO: 642796 - DNA, 354 bp, Homo sapiens
  misc_feature (317)..(317): n is a, c, g, or t
  misc_feature (325)..(325): n is a, c, g, or t
tcaaaagcagttcatgatgtggagaaattggagcctccatacagtgttggtgggaatgtaaaatggtacagctgatttggaaaacagtctggcagctcctcaaaagcttaaacagttattatataacccagcaattccacgcctgggtatataccaaaaaaacctgaaaacatgtccacacaaaaacttgtatacaaatgttcacagaagcattatacataatctccaaaagtaggaacgaacccaaacatccatcagttgaaggaatggaataaatattgtctgtctaggacagtaaattacttttccaacaatanaaaggggntggaaggtactggattttggtgtggacca

SEQ ID NO: 642797 - DNA, 621 bp, Homo sapiens
atcagtcgaaggacttcgccacagcgtgggtgggccttacctaatcagtcgaaggcctttgctacagtgtgggtgggccttacccaatcagtcgaaggacttcgccacagcgtgggtgggccttacccaatcagtcgaaggcctttgctacagtgtgggtgggcattacccaatcagtcgaaggccttcgccacagcgtgagtgggccttacccaatcagtcgaaggcctttgccacagcgtgggtgggccttacccaatcagtcgaaggctttttgccacagcgtgggtgggccttacgcaatcagttgaaggcttattgccacagcgtgggtgggccttacccagtcaaaggcctttgcccacagcgtgggtgggccttacccaatcagtcaaaggccttagacacagcgtgggtgggccttgcccaatcagtcgaagtccttcgccacagtgtggatgggccttacccaatcagtcgaagtcctatcgacacagtgtcgggtgggaccttacccaatcagtcgaaggacaacgacacaggcgtgggtgggccctaaccccaagtcagtcgaagggccaacaagagcagaagatctaagatctctctaagggaagaggc

SEQ ID NO: 642798 - DNA, 206 bp, Homo sapiens
cccgtctcttaaaaaaaaaattggccgggtgtggtgatgtgtgcctgtagccccagctacttgggaggcttaaggcaggaggattggcttgaccccaggagttagaacaatcctgtaacccctaaaagttttcgaagcccgtttgttcatccttgtctcttgtcccgaccccagcaaccactgatctataggagtggtgggggatc

SEQ ID NO: 642799 - DNA, 623 bp, Homo sapiens
  misc_feature (18)..(18): n is a, c, g, or t
  misc_feature (24)..(25): n is a, c, g, or t
  misc_feature (33)..(33): n is a, c, g, or t
taagcttacggctaggtncgggcnnggtgttantcgccacgcgaggtcgcacgcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatcaaaaaaaaaaaaaaaaaaaaaaaaaaaaaaaaaattcgagactagttctctctccgggggcggcgcggaaagacgcaggggaggtttccgggttttcggaccccaggggccggattggtgaaatcctccctgaaggggattcctcaatacgc

SEQ ID NO: 642800 - DNA, 915 bp, Homo sapiens
  misc_feature (90)..(90): n is a, c, g, or t
  misc_feature (270)..(270): n is a, c, g, or t
tcgtttaaggagaactgaagttttttgtcatctgctgtggctgttctatgaaccaccttcttctttctgcgagcagttcctgtgcccacncaatgcgcacttgtgcctgcagtttggcgagtttttcctggttcatgattgtttctttcattctttgttcgggagcgaaaattatacgggtggcccgcgtcgggggactagggttggtgctcaaggggtctcgcggtggaccaccgtgagattatggcgcacacacgcggggacgcaagncaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacaaaaaaaaaaaaaaaaaattgggggaaattaaggtagggggggggaaaagggggtaaggaaagggcacagggccaaagcaggtacctggacccagagtaccatggtaccaaagggggaaaatctggccgggaccaccaataacgggaagccgaataaattccagataagcgccagggtaacccggcattaagggactcgggaaaga

SEQ ID NO: 642801 - DNA, 109 bp, Homo sapiens
ctcgggggtctcatattcaggtaaagctctaagactcctgagccatcttttatgtaactggcttacctaggctgggggcttgaatacaatgtaacgcaagccaaaggca

SEQ ID NO: 642802 - DNA, 146 bp, Homo sapiens
gagcatggggctttagccagtgctgcatctgaccgcctcatgccttcccgtaacgttctggtgcatttacaggtctatcatgcccacagttgcccggtctgcttaatacaacattttcttgtgacgcgaaacataagtgctctcca

SEQ ID NO: 642803 - DNA, 115 bp, Homo sapiens
ccaccatctttacaccatgtttaacttctctcactcatgtgttcatttaatatttcagatctccgacacaagactttaataggttcatttagccagtccacaacgcaattatatc

SEQ ID NO: 642804 - DNA, 116 bp, Homo sapiens
cgccacagcttctcagcttctcccggagtgggcagctcgcaactttcgcgggtgggcgtggtgcgagtgtgctcatctgctgagggctatgcgtgccatggtgaggtcatcacgcg

SEQ ID NO: 642805 - DNA, 132 bp, Homo sapiens
gctcttgtcactggccttggttccacaccagcctgagctctccagtggcagctccacttgcaggcaagggggaattaatgcgtacatcatcttgtttgaagtcaatttaaaactttttcaggataagtcgca

SEQ ID NO: 642806 - DNA, 100 bp, Homo sapiens
tgacgagccggccctaatggacttcttccaaaggagtatctgcagcttggtgaaatttgtactgtttctatcataaataagttatggcttctgttggatg

SEQ ID NO: 642807 - DNA, 317 bp, Homo sapiens
  misc_feature (238)..(238): n is a, c, g, or t
  misc_feature (242)..(242): n is a, c, g, or t
  misc_feature (244)..(244): n is a, c, g, or t
  misc_feature (293)..(293): n is a, c, g, or t
cttggtgccgcagcacgggttctcggccagccacagcaaccgcagacgcggcagccccttcaggtagaagagctcagccaggctggggatcggttcctccgcaggtacagctcactcaggcgctggcaccggctcacaggctccagggtggagatgctgttgacactgagcgtgatcacctccaggctgggcatctcctggcaaatggagatatctgtgaggcggtgccccagcagtntgantntgcgacgctgtgcagctccgaggccttggctcgggtcagaaccatcttnccgcgtcagcttcatggcggtcgc

SEQ ID NO: 642808 - DNA, 264 bp, Homo sapiens
cgcgcagaggaacaccctgccgaccaaagagaccattgagcaggacaagcggagatgaaatttccttaagatcctggaggatttcctacccccgtctcttcgagaccccagtctctgatttggagaaagatccagctgcaagatggacacgagccacaagctgcactgtgaacctgggcactccgcgccgattccaccggtctgtgggtctctgaagggacccccccccaatcggactgccaaattctccgcgatcgaagtgtg

SEQ ID NO: 642809 - DNA, 712 bp, Homo sapiens
  misc_feature (53)..(53): n is a, c, g, or t
  misc_feature (76)..(76): n is a, c, g, or t
  misc_feature (93)..(93): n is a, c, g, or t
  misc_feature (111)..(111): n is a, c, g, or t
  misc_feature (114)..(115): n is a, c, g, or t
  misc_feature (119)..(119): n is a, c, g, or t
  misc_feature (121)..(121): n is a, c, g, or t
  misc_feature (135)..(135): n is a, c, g, or t
  misc_feature (213)..(213): n is a, c, g, or t
  misc_feature (224)..(225): n is a, c, g, or t
  misc_feature (229)..(229): n is a, c, g, or t
  misc_feature (234)..(235): n is a, c, g, or t
  misc_feature (238)..(238): n is a, c, g, or t
  misc_feature (256)..(256): n is a, c, g, or t
  misc_feature (271)..(272): n is a, c, g, or t
  misc_feature (279)..(279): n is a, c, g, or t
  misc_feature (319)..(319): n is a, c, g, or t
gagcgctgtgcacgtggagaagagcggggactcggcgaccctgccctcccgancctcatgttcgaagagcctagtnggccgaggcggcccagntagccgcgggccttgggnccnnaatntnacgacctccgcctncggcctcctgcaaaacaaggcctcatccattctctttagggcccactgtcatccccgatttgcctctcagggctccangcgccgccagnntctnggcannatnacgggccctagaggcagnatctctttcccaganntcccccnagcctatgtataagtgactctgaggaggaggaggaggaanggaagaagaaatcccccttaggcgtcatttggcaaagcctctgccggaagtaggggccgacggggaacgacgaacctgtcaaagaagcgtggggcccagccttgcgagtgactctgaggacacgaagtagccaaggaagaacgaaactgccaccaacacaggctcttgtggcacgtgactctgctgaagatgagacacagaaagaggaactgccagacaatcatgcccgcctatcaaattcagcgcgatgtctccttgttccgatttccaaaagactgggcccctctggtagggccaaggctcagctttcaggcctgcagcttcccgcccatgtctctcacaagcgcaggtgagctctggatcttccttgcgacggggaggcacgatctcaca

SEQ ID NO: 642810 - DNA, 661 bp, Homo sapiens
  misc_feature (53)..(53): n is a, c, g, or t
  misc_feature (76)..(76): n is a, c, g, or t
  misc_feature (93)..(93): n is a, c, g, or t
  misc_feature (111)..(111): n is a, c, g, or t
  misc_feature (114)..(115): n is a, c, g, or t
  misc_feature (119)..(119): n is a, c, g, or t
  misc_feature (121)..(121): n is a, c, g, or t
  misc_feature (135)..(135): n is a, c, g, or t
  misc_feature (162)..(162): n is a, c, g, or t
  misc_feature (173)..(174): n is a, c, g, or t
  misc_feature (178)..(178): n is a, c, g, or t
  misc_feature (183)..(184): n is a, c, g, or t
  misc_feature (187)..(187): n is a, c, g, or t
  misc_feature (205)..(205): n is a, c, g, or t
  misc_feature (220)..(221): n is a, c, g, or t
  misc_feature (228)..(228): n is a, c, g, or t
  misc_feature (268)..(268): n is a, c, g, or t
gagcgctgtgcacgtggagaagagcggggactcggcgaccctgccctcccgancctcatgttcgaagagcctagtnggccgaggcggcccagntagccgcgggccttgggnccnnaatntnacgacctccgcctncggcctcctgcaaaaccagggctccangcgccgccagnntctnggcannatnacgggccctagaggcagnatctctttcccaganntcccccnagcctatgtataagtgactctgaggaggaggaggaggaanggaagaagaaatcccccttaggcgtcatttggcaaagcctctgccggaagtaggggccgacggggaacgacgaacctgtcaaagaagcgtggggcccagccttgcgagtgactctgaggacacgaagtagccaaggaagaacgaaactgccaccaacacaggctcttgtggcacgtgactctgctgaagatgagacacagaaagaggaactgccagacaatcatgcccgcctatcaaattcagcgcgatgtctccttgttccgatttccaaaagactgggcccctctggtagggccaaggctcagctttcaggcctgcagcttcccgcccatgtctctcacaagcgcaggtgagctctggatcttccttgcgacggggaggcacgatctcaca

SEQ ID NO: 642811 - DNA, 790 bp, Homo sapiens
  misc_feature (476)..(476): n is a, c, g, or t
  misc_feature (604)..(604): n is a, c, g, or t
  misc_feature (639)..(639): n is a, c, g, or t
  misc_feature (672)..(672): n is a, c, g, or t
tgtaatcccggcactttgggaggctgaggtgagcggatcatgatgtcagtagttcgagaccagcctgaccaacatgatgaaacaccagtctttaataaaaatacaaaaattagccgggcgtggtggtgcgcacctgtaatcccagctacccgggaggctgaggcaggagaatcacttgaacctgggaggcggatgttgcagtgagctgagatcatgccattgtactccaccctgggcaacagagcgagactccgtctcaaaaaaaaaagacatgagaataaaacagtttactgcatataccaaggcatatcagatgtttaggaattgcatacaattttggaacacatatcaatacaactgtgactcaaagaaagctgaacactatttcttgtctgacagagctttccatgtgtgaaatttgatttgggggaactgtatcagatatcaaaggtttaaaacactatatatggccgggncgtggtggctgacacctgtaatcccagcactttgggaggctgaggcaggcagatcacctgaggtcaggggttcgagaccagcctatctacatggtgaaacccctatctctaaaagtcaaaaaaatagncgggcgtggggcatgcacctgatgtgagctcttgngaggctgaggcagagatcacttgacccagaganggagttgcagtggccagataccccagtgcgctcacatgggcacagagagggctccatctataataataatgtgattaacagttcagaaagggttgatgctcacgttagtacaggcatg

SEQ ID NO: 642812 - DNA, 275 bp, Homo sapiens
  misc_feature (76)..(78): n is a, c, g, or t
ggtggctgggctgcgcttgggtccgtcgctgcttcggtgtccctgtcgggcttccaagcagaggcctagcggaaannngtaaaagatgtctgaatatattcgggtaaccaaggatgagaccgatgagcccattgaaataccatccggaagacgatgggaccggttcctgctctccacggttacagcccagtttccaggggcgtgtggccttcgtacaggaatccagtgtctaagtgtatgagagtgccggctggtagaggaattcttcatcccca

SEQ ID NO: 642813 - DNA, 2488 bp, Homo sapiens
  misc_feature (16)..(16): n is a, c, g, or t
  misc_feature (81)..(81): n is a, c, g, or t
ggcgaggacgcgggcnggggctggggcgggggcgggcccgctgcggggcgcctgcgcctccatcttgccgtacggcgcggncgccgcgggccggcccacgtcccgagccgtgtcgccgccgcgctccctccctcggggcggtccgcgggcgggcgggcggctagggccggggcctggctgcgcggctgggccaaggcccgcgatggtgatctgctgtgcggccgtgaactgctccaaccggcagggaaagggcgagaagcgcgccgtctccttccacaggttccccctaaaggactcaaaacgtctaatccaatggttaaaagctgttcagagggataactggactcccactaagtattcatttctctgtagtgagcatttcaccaaagacagcttctccaagaggctggaggaccagcatcgcctgctgaagcccacggccgtgccatccatcttccacctgaccgagaagaagaggggggctggaggccatggccgcacccggagaaaagatgccagcaaggccacagggggtgtgaggggacactcgagtgccgccaccagcagaggagctgcaggttggtcaccgtcctcgagtggaaacccgatggccaagccagagtcccgcaggttgaagcaagctgctctgcaaggtgaagccacacccagggcggcccaggaggccgccagccaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctctaagcacacccgagaaaggccatctgtcccccgagagcccattgaccgcaagaggctgaagaaagatgtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttatttttaaaaaaaaaaaaaaaaaaaaaaaaagaaaagagaaaaaaaaaaaaaaaaaaaaagaaaaaaaaaaagaaaaaaaaaaaaaaaaaaaaaaaaggggggggccgcgcgccaggaaaaaaaacaccccgcggggagcggcccatataagagacgcgcccaccaaatgagtgttgggcgacaagagaggggacgcccccaccagaagagagggggcgacgcattagataaagacagagagggacgagcgagcggcgccgagtgtaaaacacccgcgcggcgtggaggggggaaacacgacgacgcgggggggaaactcataggggagaccgccacacacccacggggggggggcaggaagccagcggggggagacacc

SEQ ID NO: 642814 - DNA, 2349 bp, Homo sapiens
  misc_feature (16)..(16): n is a, c, g, or t
  misc_feature (81)..(81): n is a, c, g, or t
ggcgaggacgcgggcnggggctggggcgggggcgggcccgctgcggggcgcctgcgcctccatcttgccgtacggcgcggncgccgcgggccggcccacgtcccgagccgtgtcgccgccgcgctccctccctcggggcggtccgcgggcgggcgggcggctagggccggggcctggctgcgcggctgggccaaggcccgcgatggtgatctgctgtgcggccgtgaactgctccaaccggcagggaaagggcgagaagcgcgccgtctccttccacaggttccccctaaaggactcaaaacgtctaatccaatggttaaaagctgttcagagggataactggactcccactaagtattcatttctctgtagtgagcatttcaccaaagacagcttctccaagaggctggaggaccagcatcgcctgctgaagcccacggccgtgccatccatcttccacctgaccgagaagaagaggggggctggaggccatggccgcacccggagaaaagatgccagcaaggccacagggggtgtgaggggacactcgagtgccgccaccagcagaggagctgcaggttggtcaccgtcctcgagtggaaacccgatggccaagccagagtcccgcaggttgaagcaagctgctctgcaaggtgaagccacacccagggcggcccaggaggccgccagccaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctctaagcacacccgagaaaggccatctgtcccccgagagcccattgaccgcaagaggctgaagaaagatgtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttatttttaagaaaaaatcgaacaacaaaaccattttttcgcggcggccggccctcaggaaaaaggttctcacaacccaatctgtgtgggcggggggcccaataggttaatggacactcggccaaagctggccaaggaaacccgggcccgatgggtgggcttcccccataaaaaagcgcgggggaccggggttggaaccaccatagggtcgggcgccgggcccccggccaggccataccccga

SEQ ID NO: 642815 - DNA, 220 bp, Homo sapiens
ggcaaaaaagatatatatatgatatatatatatatatagataatatagaacacacaatacatatacaagaacaaggagaaaattggaaaacagcacaaaatacaattgaggtataagctcagagcacagtatgtcatgttcaataaatataatcaaattgtaactaggtgaccagatacatgagtcttatagtaacaaaaattataccgtagtagagatc

SEQ ID NO: 642816 - DNA, 1964 bp, Homo sapiens
  misc_feature (16)..(16): n is a, c, g, or t
  misc_feature (81)..(81): n is a, c, g, or t
ggcgaggacgcgggcnggggctggggcgggggcgggcccgctgcggggcgcctgcgcctccatcttgccgtacggcgcggncgccgcgggccggcccacgtcccgagccgtgtcgccgccgcgctccctccctcggggcggtccgcgggcgggcgggcggctagggccggggcctggctgcgcggctgggccaaggcccgcgatggtgatctgctgtgcggccgtgaactgctccaaccggcagggaaagggcgagaagcgcgccgtctccttccacaggttccccctaaaggactcaaaacgtctaatccaatggttaaaagctgttcagagggataactggactcccactaagtattcatttctctgtagtgagcatttcaccaaagacagcttctccaagaggctggaggaccagcatcgcctgctgaagcccacggccgtgccatccatcttccacctgaccgagaagaagaggggggctggaggccatggccgcacccggagaaaagatgccagcaaggccacagggggtgtgaggggacactcgagtgccgccaccagcagaggagctgcaggttggtcaccgtcctcgagtggaaacccgatggccaagccagagtcccgcaggttgaagcaagctgctctgcaaggtgaagccacacccagggcggcccaggaggccgccagccaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctctaagcacacccgagaaaggccatctgtcccccgagagcccattgaccgcaagaggctgaagaaagatgtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttattttta

SEQ ID NO: 642817 - DNA, 829 bp, Homo sapiens
cttgcgtaacccttgagtaattagtttctcccctttggcgcataccttggacgaagtgattgtgccgcccaacctgtagggccggttggctctccttgctatgatgttgtcctgttctgagtagtgctttgtgcacctatttttcgcccttgtatactggatcctgctggactctggacacaggttagacgcttccccatttcctgcttagggggctttctgtccaaccttacggcgggcattcggatgtagcacgcagaggtttacatggggcgctttgccgattagcttgcattgttgcccccccatctggcgtgtccgatttttgcttgaggcgccttcttccaggcatctggcatgtcgatttggacacatgagtctcaagtggaaagtacattgagccaattgcgggggtacgggagataggctagtagataaaacgtatcgctaagccgcctaagagtcgtgcaggatgacgagattgtggcacatcgcactataatagcgatattgtgtatgcatgaaattggagtagattgtttattttgtttctttttgttttttttttttgttttttaagttgaattatgacagaaatctttaatataaaatgtgtctttcagtaatatgtttagcattcaagtatactatcacaatacatatgtacactctttggacacacactacatggattgctgccatcagtgtaaccaatccattaaaactataaagagggaggggaggggaggggaaactaacggcaaacttatcatgttttatctggtaagaaattgtgaatttctctactttcggggccataacccacttt

SEQ ID NO: 642818 - DNA, 479 bp, Homo sapiens
tccgccctagaaagttcatgcccacccgcctcttcagaggaaaccaatggtcattgatgtccttcacccgggaaaggcgccagtgcctaagccagaaattcgggaaaaactagcccaaatgtccaagccccccccggatgtcatctttggatttggattcaaaaccccttttggggggggccaaacccctggctttggcatgattttttattccctgggttatgcaaaaaaaaatgaaccccaacatagccttgccagacctggcctgttttagaaaaaaaagccccccaaaaagccccgaaagggaccccagacccgaattaaaaaagtccggggggctcccaaggcccatgttggggctggccaaaaaaagtgagctggggattgggtccccccccaaggggtaaaggggctcccattatgttaactggggcccctgtgggttttttcccagacccttaataaactaaaaacttcca

SEQ ID NO: 642819 - DNA, 2272 bp, Homo sapiens
  misc_feature (16)..(16): n is a, c, g, or t
  misc_feature (81)..(81): n is a, c, g, or t
ggcgaggacgcgggcnggggctggggcgggggcgggcccgctgcggggcgcctgcgcctccatcttgccgtacggcgcggncgccgcgggccggcccacgtcccgagccgtgtcgccgccgcgctccctccctcggggcggtccgcgggcgggcgggcggctagggccggggcctggctgcgcggctgggccaaggcccgcgatggtgatctgctgtgcggccgtgaactgctccaaccggcagggaaagggcgagaagcgcgccgtctccttccacaggttccccctaaaggactcaaaacgtctaatccaatggttaaaagctgttcagagggataactggactcccactaagtattcatttctctgtagtgagcatttcaccaaagacagcttctccaagaggctggaggaccagcatcgcctgctgaagcccacggccgtgccatccatcttccacctgaccgagaagaagaggggggctggaggccatggccgcacccggagaaaagatgccagcaaggccacagggggtgtgaggggacactcgagtgccgccaccagcagaggagctgcaggttggtcaccgtcctcgagtggaaacccgatggccaagccagagtcccgcaggttgaagcaagctgctctgcaaggtgaagccacacccagggcggcccaggaggccgccagccaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctctaagcacacccgagaaaggccatctgtcccccgagagcccattgaccgcaagaggctgaagaaagatgtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacacttcgtgggcagcgctgccccgaagtgatgctgtgctaggcttcaagggcagggcctattctgggcagagggatgctacagtcagggcccaggagcaggacagtgctgttgtcattggagcggaaggggagcgtcaggagctgatacagggaaggaagaaggtcacacagaggcagcagctccctggctggtgacaccacagtgaacacggaaagaaatcctgcaggtctgctgcattcagatgtctgtttgaaacgtgatacttt

SEQ ID NO: 642820 - DNA, 1182 bp, Homo sapiens
gtggataatgtactgtacagggaaaaacccagtggattaagtagagttttgcctaaagcaaaagactatcaactctttggaagatattcctgattccagcccagggcccagggtgggttcacaggagctaacggagaacctggccttggatggagacgctcagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttattttta

SEQ ID NO: 642821 - DNA, 415 bp, Homo sapiens
actgtagttgcctgggtactgatccctattctttcttttttagagacaggctctcactctaccacccaggctagcagtgcagtgtcaccatcttggctcattgcaacctccgtctcccaggttcaagcgattctcctgtctcatcctcccaagtagctgggattacaggcacgtgctgccactacgcctggctaatttgtgtattttttgtagagacaggctttcaccatgttggctggtcttgaactgctgacctcaagtgaccctccgtgccttgatctcccaaagtgctgggattacggagcgtgagccagtgtgtccctcggtcgatggaagtaataagaaatactttcaaagaatgcttagtagtatattaggtttccagttttccatacagacaggtgcagcgtagaat

SEQ ID NO: 642822 - DNA, 1744 bp, Homo sapiens
  misc_feature (16)..(16): n is a, c, g, or t
  misc_feature (81)..(81): n is a, c, g, or t
ggcgaggacgcgggcnggggctggggcgggggcgggcccgctgcggggcgcctgcgcctccatcttgccgtacggcgcggncgccgcgggccggcccacgtcccgagccgtgtcgccgccgcgctccctccctcggggcggtccgcgggcgggcgggcggctagggccggggcctggctgcgcggctgggccaaggcccgcgatggtgatctgctgtgcggccgtgaactgctccaaccggcagggaaagggcgagaagcgcgccgtctccttccacaggttccccctaaaggactcaaaacgtctaatccaatggttaaaagctgttcagagggataactggactcccactaagtattcatttctctgtagtgagcatttcaccaaagacagcttctccaagaggctggaggaccagcatcgcctgctgaagcccacggccgtgccatccatcttccacctgaccgagaagaagaggggggctggaggccatggccgcacccggagaaaagatgccagcaaggccacagggggtgtgaggggacactcgagtgccgccaccagcagaggagctgcaggttggtcaccgtcctcgagtggaaacccgatggccaagccagagtcccgcaggttgaagcaagctgctctgcaaggtgaagccacacccagggcggcccaggaggccgccagccaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctctaagcacacccgagaaaggccatctgtcccccgagagcccattgaccgcaagaggctgaagaaagatgtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactcctttaaacagaacccacgcaagggcggggaacaacaagagggaattaaaaacgcaataagggcaaaaagcaaaaaaagaggcccatggcaaggacccaagaaaacaaacgttggcgggaaaacccaccaaggg

SEQ ID NO: 642823 - DNA, 1198 bp, Homo sapiens
  misc_feature (16)..(16): n is a, c, g, or t
  misc_feature (81)..(81): n is a, c, g, or t
ggcgaggacgcgggcnggggctggggcgggggcgggcccgctgcggggcgcctgcgcctccatcttgccgtacggcgcggncgccgcgggccggcccacgtcccgagccgtgtcgccgccgcgctccctccctcggggcggtccgcgggcgggcgggcggctagggccggggcctggctgcgcggctgggccaaggcccgcgatggtgatctgctgtgcggccgtgaactgctccaaccggcagggaaagggcgagaagcgcgccgtctccttccacaggttccccctaaaggactcaaaacgtctaatccaatggttaaaagctgttcagagggataactggactcccactaagtattcatttctctgtagtgagcatttcaccaaagacagcttctccaagaggctggaggaccagcatcgcctgctgaagcccacggccgtgccatccatcttccacctgaccgagaagaagaggggggctggaggccatggccgcacccggagaaaagatgccagcaaggccacagggggtgtgaggggacactcgagtgccgccaccagcagaggagctgcaggttggtcaccgtcctcgagtggaaacccgatggccaagccagagtcccgcaggttgaagcaagctgctctgcaaggtgaagccacacccagggcggcccaggaggccgccagccaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctctaagcacacccgagaaaggccatctgtcccccgagagcccattgaccgcaagaggctgaagaaagatgtggaaccaagctgcagtgggagcagcctgggacccgacaagggcctggcagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttattttta

SEQ ID NO: 642824 - DNA, 166 bp, Homo sapiens
  misc_feature (55)..(55): n is a, c, g, or t
  misc_feature (57)..(57): n is a, c, g, or t
  misc_feature (77)..(77): n is a, c, g, or t
aaccaaatcaagcacatggagaagttcgtggagaacattcggcagctcggcatcntngtcagtgacttccagcccancagccaggccgggcgcaaccaaaagctgaattttattgttactggcttacaggatattgacaagtgcagacagcagcttcatgttggtt

SEQ ID NO: 642825 - DNA, 271 bp, Homo sapiens
ccattcgataccgtgccttgccattccattccattcgttcccataccatgtgatttcattccattccagtccattatattcgaggtccactccaatccattcgtattacattcaattcctttgagtccgttccatagcactccattcctttcgattccatttcttgcctgtgttcttccattttattccattccgttcgattccattacattcgattgcattccattcgaatgtaatggcttcgaacggactggctcagtcgaacggactg

SEQ ID NO: 642826 - DNA, 845 bp, Homo sapiens
  misc_feature (16)..(16): n is a, c, g, or t
  misc_feature (81)..(81): n is a, c, g, or t
ggcgaggacgcgggcnggggctggggcgggggcgggcccgctgcggggcgcctgcgcctccatcttgccgtacggcgcggncgccgcgggccggcccacgtcccgagccgtgtcgccgccgcgctccctccctcggggcggtccgcgggcgggcgggcggctagggccggggcctggctgcgcggctgggccaaggcccgcgatggtgatctgctgtgcggccgtgaactgctccaaccggcagggaaagggcgagaagcgcgccgtctccttccacaggttccccctaaaggactcaaaacgtctaatccaatggttaaaagctgttcagagggataactggactcccactaagtattcatttctctgtagtgagcatttcaccaaagacagcttctccaagaggctggaggaccagcatcgcctgctgaagcccacggccgtgccatccatcttccacctgaccgagaagaagaggggggctggaggccatggccgcacccggagaaaagatgccagcaaggccacagggggtgtgaggggacactcgagtgccgccaccagcagaggagctgcaggttggtcaccgtcctcgagtggaaacccgatggccaagccagagtcccgcaggttgaagcaagctgctctgcaaggtgaagccacacccagggcggcccaggaggccgccagcagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttattttta

SEQ ID NO: 642827 - DNA, 393 bp, Homo sapiens
tgaacgattcggctcggacccctccataatgtgtgcccatcacagcatcatacagagtgcttccactgccctaaaacaccctgtgctcttcctattcatccctctcttcaaccccagcaaccactgatccttttaccatctccatggttttgcctttcccagaatgtcatattgttggaatcatacactatgtagcctttgcaaatgggcttctttcactgagcaatgtgcattgaaggtgcctctatgtcttttcaagggttgacagctcattcctttttattgctaaataatattccattgtctgaatgtaccacattttgtttatccattcacctactgaaggacatcttgattgcttccaagtttgggcacacattatggagggggatc

SEQ ID NO: 642828 - DNA, 1841 bp, Homo sapiens
  misc_feature (1841)..(1841): n is a, c, g, or t
caatgcagtgctggctgagctgcctcgtgagccctgcgggagagcgctgcggtggtgtgaccctgtgtctgagtgctgtgctgtgctgtgctgacagtggtgcttgctgtgctgtgtgccctgcaggctgtcgtgtgctgtgtgctggcatgtccggtgcattgtggcgtgacagatgctgctgtggctggcgatgggctgactgtggacgcactctactgtcggggaaacctttcctagacctgagccgtagctgctgaggaacggcacttgagagacgaccatgtattctagcaaggtacgtggccgcagtcctgctgatgatcggagacctcaaggacaccaggacagctgtgcctctgtgaccctatcgagctatacagatagcagctttcgagggaacccccgcgatgaatgcaggaaggattgacatagttttagttgagacacgaaacatgtcgttattgagtatactagagcccagatgatcaggagctttacggatgcatgggagtatccacacaagagagctttaattgagagagtcagagaggatggaggtgagagcaccgatgtgatgaggacgatgaaattgtggacattcgcagtaccaacaggacacggaactcttggatacatcccgtgcacatttcgtactgtgttagaccacgggaacgtttctcctcgcgagtcaggtgccaggacgtgggcgcagagaaagccgtgaaagaggaatcatacaaatttgtcgtgaagaacacgcgacgggcgcgacttggtcgtgatataattggctggcaattgttgccagcgaaacgggtctatggagagtggtgggggaatgtgaatgcggaagataagatgattcgaggaagacagagggagagtcacggtttgtggcaaattagttgcgcgcgttggacggttagaagacgtgtggggtagaaagatggccagacatataccgcattcgttcacaatggagaggggatggaagaacgattttcgtaagcgataccggaaagggtaagtagattggcgtcgacagcaggcacagcgaagacagggtataatcggagcatagcatgcaacggggaacgactcaggcaccgcatgatgcgagccaaaaggggggggaccgacgatgagaagatcctaacacaagaatcccacaaaaggcacggaggatggatatatccgccgacaacacataacgaagcaacacggcttatcacagagacgcctcaaccaattgagagaacacggtgactactggagcacaactcgcgacgcagaacgacggaagggaggaaaggatgagagagaggcgagtgtgccatgacgacggtcacagcagcgcaggaggacaggcagaagagactggtaaaggacagaagagagacagagtcgtaggcggagtacgcgagacggcgaggacgaagtaagctagcagcggcgcgagatactcagcggtagcgatgtgcagggaggagcgaggtgcgagaggcacgcaagcggcggtactagcgcacgaagaggagaagagacgaaggggaggcatatagaagaagtgacagctgcgggaataataatatggcaacaggatacgagggacggtaggtcaggacctcccacgcaattccagtatataaggagaacggagaggaacgacgtaagagaggagacgagaagagcgggcaggagaagggatggagagtggaggagagggagggaagagagaacgaggacggagagggacgagacaaggagtgagagcaggaggagcagggaggacgaaaggagagagagagggaagagagggaggggagaggagagaggan

SEQ ID NO: 642829 - DNA, 103 bp, Homo sapiens
  misc_feature (49)..(49): n is a, c, g, or t
aattcaaagcttcctaaccgatgtacgggcgacaatgtaaataaatacnattgttctaaagtctttttcattaaaaatttaaaactttaagaaaaaaaaaaaa

SEQ ID NO: 642830 - DNA, 107 bp, Homo sapiens
ggccagtacggatgtgcgggcggacggatgtgctacatcttgtgggctgctgaaaagtaggtaacgaatggctttatgcactttttcgttcttaggaaacaggggag

SEQ ID NO: 642831 - DNA, 194 bp, Homo sapiens
ctatttaaccggataaattttgattactattctcaaggaatagtaattccttaagattactatccttaaggaaagtcaaaacaatatggggctgggggcagtggctcacgcctgtaatctcagcactttgggaggcagaggcaggtggatcacgaggtcaggagttcaagaccagcctggcctagatggtgaaa

SEQ ID NO: 642832 - DNA, 437 bp, Homo sapiens
caattctgtttctctcaggatgactaagaggagaagaggtgtacctcattatgtctgaacactaagaagaggtatcaaatacaggaaggggtacattttgagaatcaatatacttggaatcaactagagaccaatttaggggtttacatgtacttcaccgaagttcttaaggttgtgtcgactcttaaacgccgcttgaccaatttttttaacctcagttctgatcttgactctttataggtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgc

SEQ ID NO: 642833 - DNA, 392 bp, Homo sapiens
  misc_feature (355)..(355): n is a, c, g, or t
  misc_feature (366)..(366): n is a, c, g, or t
  misc_feature (390)..(390): n is a, c, g, or t
ttcatgtattttactattctaaggagatcccaggaagagtttgcctggttaatagtgaaattataacctttcaagttatttaactttcaggaacatctcaaatagcacttcatgtttgttgaacctcttctaaaataagggatttccattgattttccaaggagatgtaatgggatgactttagtttgagagtgaacattctgaagattagatacaagatatatcactaaagaaatatagatttaaaaggaactttcaagatcatctagtccaaactcctatctagcaaagaagaaatctaagagttcaaaaggtcaaattgcacaggatcatttataggaaaccatatgtatgntccaattttcnttagagtatcatctggttaattanag

SEQ ID NO: 642834 - DNA, 396 bp, Homo sapiens
  misc_feature (363)..(363): n is a, c, g, or t
  misc_feature (391)..(391): n is a, c, g, or t
accactgcactccagccatggtgacagtgcgagaccctgtgtcaaaaaacaaacaaacaaacaaaaattatgtcctgcttttaggcaaatatggagggcaggcagagaagttttcttgtatctgcatctgcttctgatacggacaggggacagggaaaatactggttagaagagggtggatccctggcaaagacctcaccttcaagcctgaagacctgcggccctaaatgaggacaggcattcctgttttcaagacaaagaggttgccttttgtccctccacaccctctatcctgcccccacgtaaacccgcaaaccccaagctccacagcagagacgcaggtgagtagaggaggataccagnagatggacggtggaacagcacagcaggnagaga

SEQ ID NO: 642835 - DNA, 127 bp, Homo sapiens
tctcatggaagcacacacatacccccattattcaatttggggatggcccccttatttccatggggaggagagtgaaggacgctcagcagtggtgcagggcccaagggatccctcctgcagcaggggg

SEQ ID NO: 642836 - DNA, 150 bp, Homo sapiens
ttcaaatgggggtattacaacattctcgtagtccagtggctgaccatcatctccccatgtcatctgaacaggaccgctacgatgtcacttagtcccacctggatcctttacttccaccaccaaaattccatcatgacagaggctcagaca

SEQ ID NO: 642837 - DNA, 1560 bp, Homo sapiens
cgtatgtgtgtagtagtgtgtgtggtggcgtttttttgctttcaatcgatcgcgtggcggctctggtttgggtgtggcgtcgtatctaaggtcgagggggggtcgtcctcgccgcgggtgtgtggttgttgttgtaagttgaggcaggcttgttggtgctactacgtactggggccgggggagaggctgcggggggatgtgatatttgttgtggttccgtcctcctcgttgttgtgtctgtctggccaatcgtgtcgctcgcccagtctgagttaaagtatagtgtgctgttcgccgttggggggtgctgacaagaattcttcttcgcttgctgtgtgaagggatggttggttcgtgtcttgtttttgtggtgtggttgtttattgggttgggtttttttttgtgggtggggtttgtgttgttgtggggtgggggggacaattcagggggggggggtgtttgatgacttctctgtcgttgtgtgttttggtcggccgacgccgacggggggggtatgagtgtggagggtggctgcctacccctatgtggtgggtgggtcggctaccatccgacgcgacgggctgcgttctgttgctgtggtgggcggcggctgctggtggatcgccgcccttttgttggggtgagaggtttctattaaggggtgggggtgttctcgtgtgcttgtgttgcgttctcaaggggtttgtgtcgcgacacagttagtgtccggggggggttcttactctattcgcgcgcgatgggagggcggctcgcggctcgtcacactctctcggggcgctgctgtttactctcgcgccggggagattgtgtctctactgtgtgagagaggttttttgtgtgtgtgtttgtgtgagagaagagacactctctctgcagaggccctgtgctgagagagcgcgcagcagcgtgtggtgggtgtgttgtggtgacacatgcagcggtggggtcgtgtcatctctctctgtgttgttgttatgagatttgttggcccacccccagcatagtatgtgtgggtctctctctctctgcgggggggtctctcacagcagtagtagtgtcactctgctcttttatttttgtgtgctgctgtggacacacttctggtggtgtcggcacacactgcggtgtgtgttgtgtgtctcttctcctcttctcagagaataagcgcgcgctcttctctcacacacagaggtgcgcctccgcgctggagagagtgtgtgggcgcgacacacacacagagaggcgctctggggaaggcgcgctccacacggcgggtgggcgagagggcgcccctctcgccccagctgtgtgtggagaaagagaagggacacagaggcccgccccacaaccgtggagaagggcccaagggtgggtgagagtgcgccacacacacacacgcaacgcgggagatattattctctcccacaacacacaagaggggccccgggtggggcacacaccggggagagagaggggtgggcccgggggcccggggggttttttttttttcaaaaaaagggtcctttttttcccccaaca

SEQ ID NO: 642838 - DNA, 541 bp, Homo sapiens
  misc_feature (302)..(302): n is a, c, g, or t
  misc_feature (386)..(386): n is a, c, g, or t
gtgcatgtgtattcctattcctaaaatattagctggttagatcttggaataaccagttgactctccggagtacacatcagcttgggcattttctctggacagtctcattctcactcacagttcaagtggttctgtctccggggacatctggtgtggtctgttctgacttctctgctagtgtcattaccacatcagcatctgattccaaggcatacggtcggggtttttattcctttccctgcagaaggatgacacattagacatggacttctcccaggggccagaaatacccatcaaaaggngcggtgcgggcctcagaccctaccctactctggcgggtttggctccccacactgaagccatgtagcctctgacagcctcacggnccaacaccatattctgataccggtggagctatttttgtgtttttctctctttttttttttttttttgggaaagggagtttggctctggcgcccgggggggagtgcgggagacaatctcgggtcgtggaaccttggctcccgggtaaggtgatctc

SEQ ID NO: 642839 - DNA, 262 bp, Homo sapiens
aatttctttgctgaccatctgtctccccacgtggaattgtcatgttctttctttaaataatgcaaatatcctcatattgttactttcttagttttgatattttgggggcttttcttcaaggagactctgtttttctttgatctgagatataataataatttgatagtttaactctttatatatttttttattttcaagttactggaagaggcacccatactcacccggtcttattttcttacttgccctcttgattctcctg

SEQ ID NO: 642840 - DNA, 521 bp, Homo sapiens
tcagtccagcttacgactgggagagatctactgtccgtgggggagtatggagccgcacatgatctggaacaaaaagctctgactcttgctcaagttcgcattttcgtcatgataattagttttgactaaaaacaccctggcgtagtgggccctcgatctagatcatgatgtgccagtttctgagacatctttttaaggctcttactgcagctcccctccccaccctcctcttctttgcaaagcagacccaagcagggcaggctcagaccactcgcttctttcagatctttcttgcaattatgataacatgagatttgctgttgtgctttgaggagaaccgtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaat

SEQ ID NO: 642841 - DNA, 381 bp, Homo sapiens
  misc_feature (12)..(12): n is a, c, g, or t
  misc_feature (73)..(73): n is a, c, g, or t
  misc_feature (83)..(83): n is a, c, g, or t
  misc_feature (190)..(190): n is a, c, g, or t
  misc_feature (255)..(255): n is a, c, g, or t
  misc_feature (323)..(323): n is a, c, g, or t
  misc_feature (333)..(333): n is a, c, g, or t
  misc_feature (368)..(368): n is a, c, g, or t
agtgatgtggtntagctgtgtccccacccaaatctcatcttgaattcctacgtgttgtgggagggacccagtngtaggtaatngaatcatggcggcaggtctttcccttgctattctcgtgatcatgaataagtctcatgagatctgatgattttaaatactggagtttcccctgcacaagctctctctntgcctgctgccagccatgtaaggacatgacttgctccttcttgccttccatcatgattgtgaggncttcccagccacgtgggaactgtaagtccattaaacctctttttttttataaattgggccaagtcttnaaatatggtnttttattcaggcaggcgtggaaatggggacttagntacggggtaaatt

SEQ ID NO: 642842 - DNA, 1046 bp, Homo sapiens
agaggatcgtggtactggatatggcggaatcatcggaatcctgtcaccatgggcatccagcccggggctggcgtcggcgaggcaatgatcctctcacctaccagccctgtgccgaagctcccggcgtactgatgccctcacctccagccctgtgccgtgaccttccaccatttgaggatgagtccgaggggctcctaggcacagatggggcccctggcacggaacaagaggatggagaggacgctccatttggagatggctctggagaagggactaccgcgcctgtcccagagctggacgcctatgccgtgcccgggggaactggtcgtctggcatgatgaggacgtagacggagtctgagcggctcagttcccgtagggggtggcgcgcctgagcgggccttgcggcagtcgtgtagcctgggaggttggccgggggctgggccgctgcgctcgcgcgctcctgttgactgccgctgacagagtccgtgtgacgcgctctgcccgctggcgctggcggggggggcgggcccggggagggcggcgtggtgtctggcgacggaggatgttcgcgcccgtggaggtgctggccggatcgcagtgggccacctcgtgtccgcgagatgggtggagcatgtcgggccgccggtgggcaatcctcccaccggttttcctaactgcctgggcccatcaacctgaggggacaacggccggcaacttttctgggagccgcttggcgggcctctttttggggataacccgggagagcttggtggttgaacaatgaggatgggatccaaggagcgaatagcaggccacatcgtgctggcactggccagtaatggaacatggtaccggagcctgagggggtgggcctatgccaagatacgtcgaacacttaatgccgatcccccccccgagaaagagcctctgtgctcccactcctccaatacatgtggtatagagacgcacatagagtacagcgagagatggcgatgccactcagacacaagaagcgcaagaagagacataaaaccgaggggcaac

SEQ ID NO: 642843 - DNA, 650 bp, Homo sapiens
aagatggcggtcttggctacctctaattgctctcgtgtattccgtgccgcgactttcacgatggctcgcccaatcttactaccttctgtcggccctgctctctgctgccttcctagctcgtgaggaaactgccgtcgctctgtcatcggatctgtcccacccaaacgcgaagacggttaacccgtgtgactttgactggagagaagtggagatcctgatgtttctcagttgccattgtgatgatgaagaaccggagatccatgtacctgatgacagtgacaattacccacgccgcatatatattgggcctctgagtatatgcatagctacttacaaatgagtaagaaccattgatgaggaactagcaacgggacatgagtggtcgcttggattgtggagttctttgcacgactggtctagttgactgtctctcatttgtcccctatctatgtcttgatccttctcccttaccatacatagtgtacagggctaaattgttgggaagagtggatgtgtggacgctatactgatgtaagtacgcgtgtacaaatgtgaccgcacatcacccctccaacaagataactccctagcctgatcctgtaccaccggtggaatgatggcaatgcggaaggcacagattgaccagatag

SEQ ID NO: 642844 - DNA, 116 bp, Homo sapiens
aaagcgttccggaacgctgtccagcatttgctggattccacacacgcagtactccatcaccatatacgttgggcgctggggacaaacagctcaggggggggcccctggctcggggg

SEQ ID NO: 642845 - DNA, 1199 bp, Homo sapiens
  misc_feature (64)..(64): n is a, c, g, or t
  misc_feature (79)..(79): n is a, c, g, or t
  misc_feature (91)..(91): n is a, c, g, or t
  misc_feature (111)..(111): n is a, c, g, or t
  misc_feature (123)..(123): n is a, c, g, or t
  misc_feature (138)..(138): n is a, c, g, or t
  misc_feature (416)..(416): n is a, c, g, or t
  misc_feature (421)..(421): n is a, c, g, or t
  misc_feature (1053)..(1053): n is a, c, g, or t
aagaacacacaattataatgacttatataatcaacacgtgtagaaaagagtacgagtaaagtangttccaggtagacgnacaacgaatgtnccacgtattgctcagaattncatagcgacagnaacattaggatgctngggcatctcagagactagatacaattagtatataacaagagaattccgacaatcgccacacgcctatgcagccagtgctacacgttgctatgttctacgtatcgttagagtagtaaacaagtagcaacacttcatgaccggttactcgtgtatatcatcgccgcatcaacagagtacatactaacccgcatcgacaggtgccgaaaccgctacacgtctcgctgtgacacactatgaactgcagaggtgacacgagaaactggaagagcgactgcgcnactcnccgctacacggcgctcacaagatgtaatcccgtccggtcaccgatcactgacgcccaagatccgtatgtatatatcgcctgagcatagcacgcaaacatacagcgatgtaacctacactgctcatacatgctgattgcctggtgtccatatcaccggagatctctatacctcacgcgattaccgcaacgtcaccgtaccgcaccagactccgtatacatagatggcttcgcgctcgaccggcatgacgttcacacgcttatctgatcttacatttgcgccgctcgccacgtacctatcgatcctcgcgtgcgtcataataataccttcttcacacccgcgcacagcaatgtcaaccgaacaaacataatcgtctcagttccgtctttgtcgcggcgtggccacagtaaagtcagtataggtagtatctcatacgagcctaatccgaggataatgactcaccgctcgacttaaatcacaccagcctaagtccgaccgaatcaccgccgagagcacggtctacgcgcatcaagattaccactaatcactaatgatagcacacctaaacacccgcactgaccaccgctccggtccttggttcaaaggatgggcatactgcacggaccgccatagnaacagttcgtgaccgcgcctcaaactacgcactgctgccactgcgcgtccactcatgtgcgtacatagtgatttaggtagagtccaaatccgcagtcaaacgccactctctataagagacccgatcgaactccacgtctggcgtgt

SEQ ID NO: 642846 - DNA, 304 bp, Homo sapiens
cttgatacaaacgaacaggcagtcgtagaggtacacagggcaacgtccagaagagtcccagtgacagaaaacagatcaatgtcaccggccgctggaactcctagggagtactcactgcaaaggagcccttctggagtgatgaaggagcccttctggagtgatgaagatgttctctctcgattgtggtggtcgtggcatgggtacagaacacttgtcaaaaggcatggaattactcaagatgggagcatttttactgtatgttaattataactcaataaaattgattttttaaaattctaaaacg

SEQ ID NO: 642847 - DNA, 300 bp, Homo sapiens
acggcctactggagagacgcaccggagcgctcgacttgccgttgcctccaagcccatgaggatgacggcgaccacaatgaacaagttgctgtgctgagcgctcgtgtttctggacatgtacattaagaggaccacccaggaaacgcgtcctccaaagtaccttcattatgacgaagaaacctctaatcagctgccgtgcgacatatgaccgcctggcacctacctaaaacaacactgtacagcaaagtggaagaccgtgtgcgccccttgccctgaccactactacacagacagctggca

SEQ ID NO: 642848 - DNA, 139 bp, Homo sapiens
gtcattatgtcaataaaaaaatttttaatatttgctgctaaaaaataacccaatgcccaaatcatgtattctttttaaaacagatttttagaaatttgttgacctccttttttgaataaattatccttgttaacagcca

SEQ ID NO: 642849 - DNA, 164 bp, Homo sapiens
tcacaaatttaggactcggacgggccttggggatctacctgggtccttcgggtctcgcgcttttcctcaggaccccagggaatctggtgggtggggatcgcgtcaacgcactcttcggctccgcactattctattctaccttccaaggagggtttccactcgga

SEQ ID NO: 642850 - DNA, 214 bp, Homo sapiens
ctttttttttaggtttgagggggaatgcgggagattgtaatgggtatgggagccataccttttaggtattcctagggtgggtggtaggaggtttttccttggaggtgtatgagttggtcgtagcggaatcgggggtatgctgttcgaattcataagaacagggaggttagaagtagggtcttggtgacaaaatatgttgtgtagagtgtcgacg

SEQ ID NO: 642851 - DNA, 175 bp, Homo sapiens
  misc_feature (157)..(157): n is a, c, g, or t
aggatccccctgtcttgtaccggggagggaacacaggtcagtgtggggataggggtcacggtggacacgggggtgggctgtctctccacctcatcacattatgctaacaggaacgcagacgcattcagatgcctttgcagaaagagatgccagaggntcttgcccggtacatgca

SEQ ID NO: 642852 - DNA, 242 bp, Homo sapiens
cacaagaatcctgaaacagatgttctcagaacatattgaggatgagaagaatacagaatctcaagagaggttcattctcacaacagatgatgccagtctggaccgagatgataagcagaatcaaaattgcaatgcacgctcgaaagaggaccaccgtcaatagaatagtagcagcacaagaaatatcaaagggtccgagagagaatatttgcccgagagactggccagaacggatatctaaa

SEQ ID NO: 642853 - DNA, 252 bp, Homo sapiens
ggcaagaaggcattttttttttttaaaggaaacaaactttcaaatcatgaagtgatataaaagcggcatatgcctacaaagttttgaattcaggtcccagttgttgtcacaaaggagtgagtgaaactccccccccccccccttttttatataataaaagtgccttagcatgtgttgcagctgtccccactacagtaagttggtttacaaatgttttgcattgagcatcccaataaagagacccatgggcta

SEQ ID NO: 642854 - DNA, 220 bp, Homo sapiens
atagtggtaccagcgcgagcttcatcaaatgataattacgtttaaagtgtgcatttgtggttagaatctggtttgtttgcttccattattgagttcctcctaaggaaattgaggagagggactgaatagaagcccaaattcatataaaagttgcgtttaagttgtattaaaaatagatatataagaaaaaattctttcacttgatggaagcgtcgcgcat

SEQ ID NO: 642855 - DNA, 291 bp, Homo sapiens
cctcaccttgatcgtaaagttgctcttggatagtaactagcacttagtatctactttaaaatatgtggtttctcttcagggtcccgggccataaaacaacggagagctgtacttgctttgtcacttggaggaaccacatccttgagacaagctgctgtcttgtatgtcttcagtaggaaacttctgacacacacatatcagggaagttcctggccctgagaagtgttcccatagcttttcagtcgcaggttactttcacactacgtcagcttctctggtgagatcagggat

SEQ ID NO: 642856 - DNA, 310 bp, Homo sapiens
ccgtaacaggagaccaaccccagatatttgaggtatgctccttccgtgtccagatcatcgctcgagcgatggagaggggagccgtagcggttgtccgcaaggcctccacttcttccactgaaaaatcgttcgagactaccgctaaacctggctcagcgactgcctcgacgtctacgcctacaggatgtgggcttgtggcacagacaatccacttcccatcgtgcgacaagttgaacttaggaccatcgcagtttgctagtagcggcttcccgaaagcgttcttcgatacctctgactgtactggcacctt

SEQ ID NO: 642857 - DNA, 404 bp, Homo sapiens
  misc_feature (366)..(366): n is a, c, g, or t
cacaccacagtgacacagcagcttctcctgctgctaagtgtccttgccctgcagtgggcgcactgggattctgtggtcctggccacggccactcgtgggtcttgcagatggttcatgggcctcggtgggttacttggtaagtgagggtaatgtctgcctggcagcccctgaagtgtgcgtgacatgacacatgcatgctgcctgatgcccagccccatcccgccactgttccagtctgatgtgatgctgtggctgggatgtccttcaaacgcacgaggcagaggccacaggggccgcgtcttgcccaccactgtggaggaaacagcgacaggagggagtggggggacaggcacaagcacgtggcanaagagaaattaacaaaaacatcacggtaccgagctcga

SEQ ID NO: 642858 - DNA, 1093 bp, Homo sapiens
ggacgccgttgggacatcgtgggttggagttctggtgttcccttctgggttccgaggcccaagcgccttgtgagctgttgtgagtggaacgggaggttaagcataatcagtcgcgctaggtcaccatgcatgcctgtgccctcgttggagtcccgcgactgcgggctcctttatgagtcctcgctgttcctgcccgccgtctagtgtacgctccccggccttgcggtgcgactgcgggtcggcctagaccctgggcgttagggtcgcggggactggtgtgcggtcgctcgatggctggcggtggcggtgggatggacgcgcgtggcggagccggggactggcttgggcgcggactgctcactgctgctagccactgtggactggcgggacacgctctgacggtttgcacactcgctggttgtcgctccgggagggacctcgcggtcgagcacccggggcctgaatccatagtgtcaagattacgggcttgctctgtgaggacttgagcggtcgaggttcataagtaagccggcggaagatcgatagcttggcctggttgcattagcgatactcagggctacaagccaacgttgtgggagcgcattgctgtgtgcgtggagctgcggaaggctaagcgtgactgtactcccctagaagggcggaattgctacacgagggggcacgtaacggggtatatacccgggtggcggcccatgtgttgtcgcaaatttttcccgttacgtaggggacgcgaacctttccgaggctgcccattggcggggtatccatacctgttagccccataccgagaatggacttgtgaccattaccacggccttgtccaagctaagtgcaatatcagtaaggccggcgagtgatccgatcgcgtgggacactgggccgggaccggaccgataccgccaaaaccggtaatgtggaaggcgcagtgaaggtgcaagttgcaacggaataggtgtgtttctttgccattgattgcttaacgcatggtcgtcgcccgatggggttgtcgcctaaccttttagctcagaatatttggccgtgtgacaaccaagacctgtggaaacaacatttg

SEQ ID NO: 642859 - DNA, 365 bp, Homo sapiens
  misc_feature (9)..(9): n is a, c, g, or t
gattctagnaggatccctactactgtcgcattttcaagaaactatcactgtttgattcatttagcctttctattctttattcatccgataaagtaactgatgtcacaacatgtcttgtgatgaaattgaaatttatttttttatgttaaatataatttgattttgctgtttatttctaccaatgagatagactttggcgaatctaaagttgattattttatagaactcaccctttaacttattttctcctttaacagttgcttgcaatcctttatcagctgcttacaattaatttgatcgcattaagacctttaagtagaggtaggggagggaaagctgtaaaaaccttttcatggattaccata

SEQ ID NO: 642860 - DNA, 467 bp, Homo sapiens
  misc_feature (427)..(427): n is a, c, g, or t
ggataaactaacgaccgtggagagtgaagagcagccttggcttcaggcatgggatgaacactcatttcagagaacacggagctgggggagaacccagaggctgctgaagtgactcgaggcaggatgcaagtgagaacggggctgactaacacagaactgggaagggcaaactgctctatggagaatgtgactcaaaccagcagggcagaagcattgggatcccagctctgccactatcgacaaggcacagaagctctctgggctgagagtccttttataagacaagtggatattctctagaagtcctttcagttatttttgtttaaggaacgttaaatctttgtgtatctatagagaaggctgcaactgcagctgcagctcaggcaccagcacccaagttgaggagcagacgctcactgtgtgtggntgtgctctgcaagacaaccagcagacaccagcacgatcct

SEQ ID NO: 642861 - DNA, 521 bp, Homo sapiens
tgaggtaacggcaacttgaattgacgggtcgcttgaattgacgggctcgcgagctataggcttcaacacagcagtcaacactgagttcatcgtcttcttgtgaggtccattgttctagttcaaagtccagcctactgtagcctctgaggagcacttccgctgcaccagaggttttgtgttctcaacagtcccctgacacgagtaagcaaaaggttgtggtctatctcactcacacttaaactcgtgtttagcttctcgaatctgcgacctgcactagtgaaatgaaatattcaagactgtctctctccaaaaccccttagcgtgcacctttgtttacttgtcagaggttacatattcagtctactgggctgtatatgtagtttttatctgtagagaatgaggctccctggacctctagttcttcgagttcgattcgcacctagtagcccctacctggcgatcaaaccttctgccgaactgctgggtctgttcgcagagctcttgtctggcaaccggaccgt

SEQ ID NO: 642862 - DNA, 242 bp, Homo sapiens
atgcacccatgcagactggagccttcccgcagtatgttcctggtcatcgaaccactcaactggattacagtcatatcttctactctctgtttaataactgaaaagggtaaaaacctggaactgtttcctatgccccttgagaatctccaagtgggagccacatggccacttttatctccactggattcactctaaagacacagattggccaggcatggtgggtcatgcctgtaattccagca

SEQ ID NO: 642863 - DNA, 791 bp, Homo sapiens
  misc_feature (449)..(449): n is a, c, g, or t
gagccgagcgctgaatcgcggtgttggtgggccccgggggtcggcatgcggttgggcctgctatcagctcatactgtgtgggcttgccagcagcgttcatcccttgtgcgagcgctcgcgaatctggggccagccctgtcacgtctgagaaaagactagatcagcactctgctgcacgacgccgattagagacttgtgtgccattcgcgaggcgagaaggccgaacctccgtcgccacgggctggctacggcttcgcgcggcagtgagccgcctcggggaaattgcgcgaacgctccgaggcaggtcgcctggttcgaaattcgagttggcatcgaccccgtgcaagttcggtgttcctgcagtgggcactggattcgattcgttggtcgataggcatcgcatgcgcggatgcgaggagctgatgtgatgcggaaggccagagcagtgntcttggagggcagcaaggggtggtcgagagcagtacgcattcgctggcgcaaagatcccctcacggtcggaactcaagctccttggcggacgcgcaggggcctgtcgcaccggaccgtggcgcgatgccttaagcggcttgacctatggcacgcaagtacggagaccggattgtgacccggggaagcggtcgggggccttggccttggggcgaagtttggaacacaaagcgatccgggtacccaacgcgggtacttagggggccgttgcgcgttacggggggactccgggcaatagctggaaagtgctcccccaaccccgttgttggcgttgtgtccatggg

SEQ ID NO: 642864 - DNA, 200 bp, Homo sapiens
gccctttttaaataattaaaaggggtatacttggggtgtttggaacccaaaaaataaatgcttggggggatggataccccttttaccctgatgggattattatgccttacatgcctggatccaaatattacatggacccccttaatatataccttttctatgggccccccaaaatttaaaatttaaaaatttttttccca

SEQ ID NO: 642865 - DNA, 390 bp, Homo sapiens
gttgggccaaaggaaggaaggccaaaatgtgtaacttcccagcatttgggagatgctgtctcttgcccccctgagtgttccttttttttgctttcatgtccttccctgagaacaatgaattttgggacaggctaaacatcatgatgaagttttttaaacagccttttttagtggaaatccctttagatctgggtgtgctctatggggagtgctgacgtcaaaaagcaaatgtctataaggggcccttttaaaatgaaccttttcccccttgagcaagctgggattttttaatgtagaaatcaagccctctttataatttcccttcaaatgtttatgtttttgttttttttgtttccaatgatggtaaaaataaaaactacgcctttctta

SEQ ID NO: 642866 - DNA, 1113 bp, Homo sapiens
ccaaggggaggaagttctctagttgcaagttctaacaggacatacatgacagtctgttctaagtaagagagaagacaatagcaaactcttatagcatttgtaataccatggtcagcttgtgccttccaagacactagcatggtggcgcctagtaatatgcgattaatgtttatggcaaagctgctatacgaggaacttgtgaagcagcagccacgcagtctgccatgagaggttaggaccataatagaagctaggattcttgggactgttggcagaacaaatagagcatagaagagctgtagattggatgacatagttctgacaacgaaacgatagatgcgtgacattgttatgctcgatcagttggacgcgtggaccccccagcaccgtcacggattactgggggcaaccctgagcttgggacgggaagggcacgtcggctatctagacagagcactttcgcaatcgcgtagcactctgaatcgtagggcatatcggggtccatttcgtcgaaaccacgcgactgccgacggcaagttgggccctgcgaccacgtgcacattgtgcaccacaactagacgcgcgcacaattggccagaggttatcaccttcggcaagcaaaccaaaactctccggtgtggcggccacctgcgagcatacatataaaccggcctactctgcaccacgcgccttgtgccccaagcatagacacgaagcaccggctaacctcgccgcggtcggagcaacatcagttctgcacctctcccaatggtggaatgttacccacgatttcacaggcgcacgcacacaccactccgttacctaccaactcccgacggacatggcccggaagggtgcgaataccccctaagcggggacaagaggtggcgcacgaagaagagcattcaccaggaccgtttttccgcccgtgggctcgtgcgagaacggaagttgcaagttacaccttgtgcgctcacattctccggaaggcaaaaccaaactttctcggctgggcactgttccacggaaagcgccggttattaggttacgccggggacaaaggaccaccaccaatgtgagaacacaaagccccactagttatacgactggcat

SEQ ID NO: 642867 - DNA, 145 bp, Homo sapiens
  misc_feature (1)..(1): n is a, c, g, or t
nactctgtaggatccccgcctcatttagttccaatacatatagtccaccatttactaggcatagtgtattttggcgagatggtcttaaaatgcatcacgttgaagcaaaatccaggctgtgtctccgatagtacatatgattggt

SEQ ID NO: 642868 - DNA, 925 bp, Homo sapiens
  misc_feature (667)..(667): n is a, c, g, or t
gcgggtgggcaagagcgcgctgaccatccagttcatccagtcctacttcgtgtctgacttaacagaccccactatgtgaggagctcctacacgaagatctgcagtgtggatggcatcccagcccggctggacatcctggacaccgcgggccaggacgagttcggggccatgagagagcagtacatgcgtgctggccacggcttcctggctggtgttcgccatgtaatgagccggcagagttttcaaacgaggtgggcaagctcttcagcgcaggattctgcgggtcaaggaccgcgacgacttccccgtaagtgattggtcgggaacataagggcaagatctggagtcacagcgccaggtcccccgactcagagagcctctgcctgtcgagcgcctcccaccatcgtggcctacttgtgaggcctcggtcaaactgcagtctcattccgtggacgaggctttcgagcagctggtgcgggctgtcctggaaagtaccaggaactaagagctcccactcgagccctcccagtgcccccaggaaacgagagggcggggctgccgctgcgtctctcctgtagccaggcaagagagaaagcaagcaccagaagctctctggtgactagctgccttcggaccttggtgtgtcgatcctgagagccactcactngagacccgccaaatgttccttcatctggggtactcccaagggacaaaacttaccatatacatgcctttaatttccctgggcctcttcgtggggctacaggccactgttgtgccttctggcaaaagcctcctggtcccgaacctcacgcctggtgggggaaaacgcactcaagggtccaagcgggtaataacccctccccgagaataaaaaaggtccggcgcagaacaccaacaaaagggggcgccaaactaccaaagc

SEQ ID NO: 642869 - DNA, 379 bp, Homo sapiens
  misc_feature (74)..(74): n is a, c, g, or t
  misc_feature (118)..(118): n is a, c, g, or t
  misc_feature (134)..(134): n is a, c, g, or t
  misc_feature (160)..(160): n is a, c, g, or t
  misc_feature (208)..(208): n is a, c, g, or t
aaggtctttacctgttttccggggttgtccacaattttcctggaacttttaaaagtttctgtggggccccccgngggtggccctccccaggggcaacccccgctttcaaacccttttnattgagccttaaattnaaacccttttgttttaaggggcccantggggctagggggcccccccccccccgggtgtttggcagtttcaaggnttttttttcggggggggtttttttttttagggggttttcttttaacccccgagggggggaccccttttttttcaaaaaaaaccccccccaaatggggggtggttcttttttttcccgttttttcccaacccaggggggttttcccccttattaaggggcggggggtcgcca

SEQ ID NO: 642870 - DNA, 926 bp, Homo sapiens
  misc_feature (341)..(341): n is a, c, g, or t
gtattcccaggatgtactcctgtggctatatcgtaaaattcttcaaatggatgagtgaaggatttaatatcgagagaccaacatcagtctagcttatagatcgggtgaatgggtaatgtagatgctagcacgaattgttggtagacagatgtctcgaggtacaatggtggctaattattacataacacaatgatgcttaattagatggattgcttatcattatcttaaggatacattaggtggatacttttgacataataaggagaggatatagatggaagatagtgcaagctgacagtttagaatgctcattgcatctgaaatacttgattatgatgagnttttagagcagaacgagtacgataatcacatgtagccagagcttaaaatgttggaatgcgaacacatgcaaaattggctttggatgtagatggcgatctacgtataatcgtgcgtcgtgtggcaacgggcctcgtgcgtctgtggtacattccacgagtgtaagcgtcccgtaacccagtactatgaagtcagatggttaccagtgggaaggtaactggtcgtatctaaaaccggagaatattgaggtggtgcctatagggaatctatatgtaagcagttggaagaatgactacagtgagtatcatataaaaaacaagactttggcgacatagataaattcactggcattgccacatgaaaggtctttccatctgagggcgttcgagctgaattcttgaccggtggaacttctagtacagttcagaatactggaggtaggaggtgaccataatgggaggacaagtaatgtaccagtgggtggaaccagactggaatctttttaatctaaagatattctttgtggaaagcctttaattgcaattgacaggggtctgaggtataacttggggacagtttagtaggta

SEQ ID NO: 642871 - DNA, 325 bp, Homo sapiens
  misc_feature (1)..(1): n is a, c, g, or t
ntccaggttccctaacatgccagggcagaaattcctgggtccagccaggcacggtggctcacgcttgtaatcccagtaacttgggaggccgaggcgggtggatcacctgaggtcaggagttcgacatcagcctggccaatatggcgaaaccccatctttagtacaaatacaaaaattagctgggcgtggtggtgcatgcctgtaatcccagctacttgggaggctgagtcaggagaatcacttgcacccgggaggcggaggtggcagtgagccgaggttgtgccactgcactccagcctgggtgacagagcaagaccctgtttca

SEQ ID NO: 642872 - DNA, 123 bp, Homo sapiens
gtggaagccttgcgctcaggtgcgcaggaacgctttgttcaggcgttgatgcccgcttcggcacctgctcttccaggcgcaccagctcttcaatctgcaccaggaaccagcggtcgacgttgg

SEQ ID NO: 642873 - DNA, 114 bp, Homo sapiens
tgctctgttgtccaggtgagagtgtggtgctgtaatcttggctcacggcaacctccacctcccaggaccaaggaattccggtgccacagcctcctgagtagctgtaaaaagctt

SEQ ID NO: 642874 - DNA, 235 bp, Homo sapiens
cacacataaaaaaacacaaaagtcttacctcttcaggccacatagtcacagtcagattaaacattagaaggattatcaaatttatagatcaagggaacaaacattgcacaccaggatattgtctacaaatttcgtcaccatgctccattttgcagtgggtattagtcatacggtcactactatacgttctacaatttctagtgcccactttcacagggtaccgacgctcgaagtt

SEQ ID NO: 642875 - DNA, 1147 bp, Homo sapiens
ctcttggtacctcccacgcgccgagcggaggtgtggtttggtgtagttgttgggatcgggaggtagtatgcccacttcgatcaaaaatgcgtgtgtaggtatatactgtgctggggtgggtgtgggggcggtcatagaaacatcccatgtgtctccccctgaggagaagtggtgtgaccccccccagcagctataaatgggtggtcggtgtgtgggtgtgtgtgttggcgaccgcgctggttgtgtccctcccatcacgcccactgctggcagaccctacgcgcgtagcgggcgtgggttggtgttcgtcttctcttgtgtgggtggatggttggcgcacacggcatggggcttgcgccgatcgtagggcttttgttgttctgctcgcgcgctcgggcggcttcccccccccgtgggcggagtgggctcgctctcacgccccgcgtcgtggtggggggcccgtcacgcgccgcggcgggggtttttgtgtgggcgcgctccccgcgcttcggcgtctgtttttttttccctcgctcgtagcgggcgccccctctctctctgcggctgtttttggtgtgggactgccacagaggcgggggccccccgccccccgccctcgctctgtctggggagtgtgtgtcgctctcgctgcacggagggtcgcactccgctcctcttgtgcactcccgctcgcgtctcgctgggtggtgggcgcgtctcacacttgccgctcgcgccccccgcctgttctctcgctcacccgccccgcctgccctcgtctgcgtgtcgctgcgtggtgtcgccccacgcggcgcacccgccgctcctccgcaatatttgtgtgagagaatagaggaggggagagagaactctcttttttgtggggtgccttacaccacacaaaattatttactcgtcctccccccccacagaaggagaggccacacccccccgcgcgccctcctcttctggcgcgtggctgtgttgttgtgtgggcggcccctcttttttttttctgtgttgccccgcgcccccccgcgtgcgtgcgcgggttggtggtgcggtccccccttgtgctcccccccgcgtgagaggttttgtgtgtgcgcgggcggtctctcacacaaaaaaaaaaaagggcccccga

SEQ ID NO: 642876 - DNA, 566 bp, Homo sapiens
aagtcatcttgattactcctcccgttttgaaattgtgtcttcgatcagcatctccacatgctatactctttatttatttttgagacagagtctcgctctgtcgcccagactggaatgcagctggcgacatctccaggctcactgcgatctccacctcccaggttcaagcaattcccatgcctcagcctcccaagtatcctggaccacacacatgtgccatcatgccaggccaattttcgtatttttagtagagatgtggtttcgccatgttggccaggctcatcttgaactcttgtacctcaggtgatccacccaactcactctcccaaagtgctgggtttacaggtgtgattacactgtgcctggtaagaatacatgatttaaactcactcaattttaattgttttttaatccctaatcacccatcgctagtatgaccagaggttagtagaggggttcgatgccattctggttcttgagtgaagaccgggcaaggcactgagcatgggatgagggagccagtgaaaaatataaaaccaagggaaagggtccctccgcttgcatta

SEQ ID NO: 642877 - DNA, 894 bp, Homo sapiens
  misc_feature (271)..(271): n is a, c, g, or t
  misc_feature (503)..(503): n is a, c, g, or t
acggaggagattggcgcccacacagggcccggaattatggagaccactcatggggggggccccaagcacaacgaacaccattgggtggatacaacagggccacttgtaacaagtgcccgcacccatggaagactgggagagcaacaaacatactgacttccctgtgccgggcaacgaaccgcgttccatcacatcaccgacgccagtgttagtctcgccccccgccccattacggcacgtggaaactcttgcccactaacactgcatggcntgaagcagagtgcgtctcttcctcgcggcgtggtttctctagccgcccccggtggtcccacaagttctgttgcgccgccgcggccacctttcaagaaccaggtggggcccaaacaagggcccttcttattcttcttcggcgggggcacccacaacgccgaggatcttgggccgccgatccattccccgcaccgaggttctctcccgtgtgccttgtacccgctcccggttgntgtagaccccccgctcataactggtgaaagcctctcctcatccctgggaaatagtttatcccccgccaacacattgtttctctgcggcgcttccccttctggagggtgccacaagatttctaattctcactggcggtagccttacgggcgccgcccctggtgtgcctcaatgagcagacgcccacacagcaggttgttgttcacccgggatagttcagcggtggctcccccgagaggaccaacaccctggggttcacccaccaggtcgctacaacatatagtcgaattggtcattcgagcccccgcgttggctgccccgcacgattaataccccccccggttcttctcagtttcttaaacccaaaaaggaccccttttcccccacaaaaca

SEQ ID NO: 642878 - DNA, 869 bp, Homo sapiens
tcatcttggctcactgcaacctccgcctcctggttcaagggattctcctgcctcagcctccaactagctgggattacaggcacaagccacatgcctggtaaaattctttgtatttttactacagacggagtttccccgtgtttggccgggctggtctcgaactcctgacctcaggtgatccaccagcctcggctcccaaagttctgggattgaatgcgtgagccaccatgccggggcggtatggctcttttaaacttcatttgatgcctgggttataatatcatatgctggaggctcactgtggatgtagagtagggcaaatctgtgtgtgtatgtcattagaaaaattctaccatctttccttatacatctggtgtgggcgcactctacagtgacttcagtttgtcaagaacgaatgtggaggcggcgaaaatgatgctgccaaagtcccagtgaagttaggtgggtcaattagtgcattcctttctaaggtgtgttaagtggatctgccaaaaagaatcacagtcgtgattaggatgaaatatgactatttacactcaaaatatattcagcaagggtcatttagttggcccctcaatgcttcacagggtgccaaagaatctgggggaccctccgtgccaggtattccctcacaagcacacgggctagaggaaatccaaagatcagtggagaaataacgaaagggaacagcccaagggtgtggtggagcaaccggacactaacgggggaagcaaggtaacgactataggccaataaccgagggaaacacgcggggggggacactgccgacaggcaggggcagcacggaaaagaaaaacggggaacaggcggaaaaaaacagcagatga

SEQ ID NO: 642879 - DNA, 134 bp, Homo sapiens
  misc_feature (109)..(109): n is a, c, g, or t
  misc_feature (125)..(125): n is a, c, g, or t
gacgacattttacatgtattcttagacgtatcaatcaccattggtcaatctctaccatagtgaccatctttggttttagtttgactactctcacacaatgatgcctccngtctccaccataccangaatgagta

SEQ ID NO: 642880 - DNA, 223 bp, Homo sapiens
gccgagcaagaagaagaaggtacaacgcgcggtttcccgccggccgcgaatctcaagaagatcatgcagacggacgaagagatttggaaggtcgcgcgcgcgcggtgcctgttcaatcaatcttcccgggcgctctgagctcttccctagagtcgctgttgaagaaggcctgccaaggtgacccagtcgcgggaacggaaggaccatgaccacatacccacct

SEQ ID NO: 642881 - DNA, 156 bp, Homo sapiens
cagcatcgagcactgacgctcccacccttgggcaaggacgtcagtgcgcctgcgagcgtccctttgcgcggcagcccgttgcgggccctcaaggagaagcacaggccaggatggccccgggtcgcgcggtgaccgggctcctgtggctggcggccg

SEQ ID NO: 642882 - DNA, 113 bp, Homo sapiens
tacttacattgtgacctcattgtgattctggactccgtgttcctggtcttttccacctctgtgcatgaaaatgcgctgtgctgatgagctgaccccgtggaagttccacgtgt

SEQ ID NO: 642883 - DNA, 343 bp, Homo sapiens
cagaggcatgtatgatggagctgtgcctgtggtggttgtgtgaggcataggctcatctagcggagagtgccggtgaggtagggtatgggcctaaataggccattgtgagtcatgagcttggtctagtagaggctgatgaaaaaagttcggggcctggagaggctgctgggtggtaggagcataatgtaaaatcgagggggcgtgtaaagcttgttttccttgcaagttggatggtcccaggttttgtgtggcacccctctggaatccatttatatgaaaattccaaatattagtggggcatgggggcaagcacctgtagtctcagccacgtgggaggttggga

SEQ ID NO: 642884 - DNA, 111 bp, Homo sapiens
  misc_feature (77)..(77): n is a, c, g, or t
  misc_feature (111)..(111): n is a, c, g, or t
gcgcgccgtcaggtaccaaagacgttaccacgtaaagatcagcctcccagaacacctcatgacaatgacaccgggcngtaattaagggtgagcaagtcaccttttaccagn

SEQ ID NO: 642885 - DNA, 345 bp, Homo sapiens
ttagaattctctggctcttaaaataaaggcctgaaagagagtggagattcccctatatttccttgccctgtaaagctccaggagagagagatctggggggctccatagctgtcatcaactcctcttggcactaagttggcagtcagcaaaggaagtaaataggaggggaaaatagtttgccagggtttcctctccattttaattttcatcttcacagcagaattttcctttccacaaggggaatctgagaagtacaatgcttgcttggtataaacaaggccgggggaaattccactggcctcaggggctgatgatcgggtaagggatgctgtcgggtaccgagct

SEQ ID NO: 642886 - DNA, 237 bp, Homo sapiens
ccgtgcaaaggcttcaagatgataacttctctatgagccggcaaggtgcttgatctctcagcccagggccattcaacgcctccgggccattcaacgcctccggccattgagacgcctggcggccattcaacgcctcggaccattcaacgcctccggccattcaacgcctccgggcattcaacgccttcgggccattcaacgccttcgggccattcaacgcttcggggccattaaacg

SEQ ID NO: 642887 - DNA, 823 bp, Homo sapiens
aacggctaggtacgaggccggggttactctactaaaaatacaaaaattggccggtgtgttggtgcacgcctgtaatcacagctacttgggaggctgagacacgagaatcacttgaacccaggaggcggaggttgccgtgagcagagatcataccactacactccagcctgggcgacagagtgagactgtctcaaaaaaaaaaacaaaaaaaaaacagtggattgggactctctagagttgtccatgtgtagatgtccgcaccaaccttatgggcttgtcctaggaagcattggcagctaggatgctgctcgccttgagagccacatccttgtgacctgagccgatgccgcctccacctcccagctgctccggagtcacagtggcccacccgttatacttttgacttggcagttctcccgagcccgccccaacagccatgacccacaggggtagattttcttttttccactgattctataaagcacttttaactctaagttttttagagacagggtcttcctatgttgcccaggctggtctcaaacctactggtctcaagcaatcctcccatctcagcttcccaacgtgtcgggctttacggcttgagccaccaatgccctgttctgtcgggcctttttggagccataaattaattactttccacgcgcacgttttggtggcatcctgctctgttatccccagtacttgttcgggtgaggggggaggatccttgaccccgaagttcgaactgcctatactgtatccacaatggatcccttggccccggcggctctgtctgaaacatgaattccgtgtacgcgaa

SEQ ID NO: 642888 - DNA, 135 bp, Homo sapiens
tcgctatcatcggcacctcgctattcatcggcaccggggttggtgtaaaataggcgtagtagaagtagaggttaaggagggtgatggtggctattatagtgcggactaatagcgaggtgccgatgagtagcgagg

SEQ ID NO: 642889 - DNA, 4211 bp, Homo sapiens
gaggtttctgttagggaccgtctttgggagtgatctatctctgctctctgggggggatctttggtctggagcttttgggggggcttgtgtttggaagtttgccttcgggagatatctgtctgggacctcttagggtttctgtatctgagctttctcttttgtgtctgtcagtccaagggcagcaaaaagtatgtcctttctgaagcctttttttccgtaggtttcttcattcttttctctcttgtcttatgttcattttagccatagacttgactggagtttagagggaattgattgttgtccagatgagtcgtacaggaaagcagattgtctttttttgagacggagtcttgctctgccgcccaggctggagtgcagtggcatattcttggctcactgcaatctccgcctcctggattcaagcgattctcctgcctcagcctctcaagtagctgggattacaggcacccgccaccacgcctgactaattttttgtatgtttagtagagatgaggtttcactatgttggccagtctggtctcgaactcctgactttgtgatctgcccacctcggcctcccgaagtgctgagattacaggcgtgagccaccgtgccctgccccagattatcctttttatttgctcagtccccccagggagcagatggcttcagacagccacacaaaacactgttcctgcttaattctccatggggtcatggttaaagagaggaagctgggctgagctccctttactaattggtcctctacatcttgcgcacagaagggaacctggcccagtggccagtgactctcctctccctttatggcagcatttccaagcacctgccctgtgacagatactggctaggtactggggataacaaagacgaataaaataacagcttaccatccagtagtagacatggagacatccgtttcctctgactagcattgggatggtgctgaaaccctggaactatacattcagtttagaactatacattcagtttagaactctcagttatggacgttctgccttctgtttttttggtttttgtttttgtccaccagaaaacatctgctagtaactgccttctgtgttgatgctttctttcctcaccttacccagcgtgcttctgttcttcaaggttgaaaactaagcatggggaagagctgcaaggtggtcgtgtgtggccaggcgtctgtgggcaaaacttcaatcctggagcagcttctgtatgggaaccatgtagtgggtgagtgttgttggagggggaggaacagtggaagaagttgaaaaataaggaataggacttgatcacaacacacacaggctaaaagctgctcctggtggttttcccccctggaagaataaaacttacattgtaacagatcaactctacaacactgaacaaatccggagggagaaagccctatgtccaagataggaaagagaagctgtcatgtcacacttgtgcttagcatggaattagcataaaattaatgtccattggccgggtgcggtggatcacgcctgtaatccgagcactttgggaggctgaggcgggtggatcacctcaggtcgggagttcgagaccagcctaacgaacttggagaaaccctgtctctactaaaaatacaaaattagccgggtgtggtggcacatgcctgtaatcccagctattcgggaggccgaggcaggagaatcgcttgaactcgggaggtggaggttgcggtgagccgagattgcgccattgcactccagcctgggcaacgagagcaaaactccgtctcaaaaaaagaaagaaattaatgttcgttcccctaaacccaaatcatttcagtcctgccaggctgtcaattctctggcctcctcagccccctacattcctttctccccatttggtcagccttaagatgctctcatcactcacatttcccatctctctctccacttcagacagttttctcattttataccaggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaa

SEQ ID NO: 642890 - DNA, 403 bp, Homo sapiens
ctagaggactcactaacctaatcgctactatggcttgtcatatatgggatgcgtgtggaatattggatattccatgtgtgacaaaatggttgaaatggtgagctggcataagctggaccattatcagttttaattttggtgggcagtcccataaatgcaaaagttaaaatatgtttaatgacatatcgagttgactttccaggcagagcatgtgcactaattaagtgagtgttggggttctagtcctcaaaagttaatacctgtggaaggaggggatgtgcttgtgagctgacaatccaggcattgcaggataatttgtttagccagtctctgggtaagtcgaaatagtttagataaatttctccaatttaggtggacacaaatcgatgcgactagggtcagt

SEQ ID NO: 642891 - DNA, 801 bp, Homo sapiens
ccgggcgtggtggcaggcgcctgtaattccaggaggctgaggcacaagaatcgcttgaacccaggcagcagaggttgcagtgacctgaggtcacaccatagctctcaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaaaaagtttccctcccctccccctttttctggttctcccattggaaatgtctttaaaaaacaaaaaaaagatacagggggatactggcagggtcccatattgtggggtggggagggggcagtgctgcagtggaaaggagtttgtgacattgacattgacagcatgaaaatgggtcttgccagtgcatgtgagactgcctcccaacactcagcttcacagtggcaggggctggttgggagaagggaaagctgaatttagtgctaggaccagtttggagtgggaagctgtaggggaaagctcttcctttgggagctctgcggggggttcggtttttaagctgagtccatagtctgagggagacccacacccgccctccaagagttggggttcaggaagtcagagaaaggctaagaa

SEQ ID NO: 642892 - DNA, 103 bp, Homo sapiens
cctaccgtatcttagaagaggaagttctttctgtggatagtctgctgtgagctttttattggtaatcaatgttgagtccagttaaatgttttttttctccagt

SEQ ID NO: 642893 - DNA, 349 bp, Homo sapiens
catcatggggtctggacttggctggccgtgacctcacggactacctcatgaagatcctcacacgatagaggctattcctttgtgatcacagctcagatagaaattgtgcgagacatcaagggagaagcatgtgctatgtggccctggattttgagaatgaggatggccacaagcagcttcctcttacctccctgggaggaagagctatgaggctgcgcagatgggcttggttattacccgattggcaatgagacgcttccgctgtgcctgagtaccctacttccagaccttcctttatttggcatggatgtccgctgtgaattctatgagacaaatctacaatttccat

SEQ ID NO: 642894 - DNA, 2494 bp, Homo sapiens
agcgggacggaagctggggagcgggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaa

SEQ ID NO: 642895 - DNA, 2471 bp, Homo sapiens
  misc_feature (19)..(19): n is a, c, g, or t
  misc_feature (40)..(40): n is a, c, g, or t
  misc_feature (44)..(44): n is a, c, g, or t
ggcacaagtatcaccctgnggtggaaaacgtaagttggcnttcngaccacgcgtcggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaa

SEQ ID NO: 642896 - DNA, 2906 bp, Homo sapiens
agcgggacggaagctggggagcgggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaaaaagtttccctcccctccccctttttctggttctcccattggaaatgtctttaaaaaacaaaaaaaagatacagggggatactggcagggtcccatattgtggggtggggagggggcagtgctgcagtggaaaggagtttgtgacattgacattgacagcatgaaaatgggtcttgccagtgcatgtgagactgcctcccaacactcagcttcacagtggcaggggctggttgggagaagggaaagctgaatttagtgctaggaccagtttggagtgggaagctgtaggggaaagctcttcctttgggagctctgcggggggttcggtttttaagctgagtccatagtctgagggagacccacacccgccctccaagagttggggttcaggaagtcagagaaaggctaagaa

SEQ ID NO: 642897 - DNA, 2440 bp, Homo sapiens
agcgggacggaagctggggagcgggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacctgaggcaggagaattgcttgaactcagaaggcggaggctgcagtgagccgagatcgtgccactgcactccagcctggtcaacagagcaagactccatctcgaaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaa

SEQ ID NO: 642898 - DNA, 789 bp, Homo sapiens
  misc_feature (65)..(65): n is a, c, g, or t
  misc_feature (67)..(67): n is a, c, g, or t
  misc_feature (76)..(76): n is a, c, g, or t
  misc_feature (107)..(107): n is a, c, g, or t
  misc_feature (110)..(110): n is a, c, g, or t
  misc_feature (116)..(116): n is a, c, g, or t
  misc_feature (125)..(125): n is a, c, g, or t
  misc_feature (135)..(135): n is a, c, g, or t
ctactatccaacttggtaaagtcaatcttcaatatattgtgcatgggctcttctggataactttnantggaaccanggatgaccggggggggttaatctcttccacnttnattttnaaaacccanctagaccccnagtcccttacacatcgggcaagggatatgccaagatcatccgaaacaatgggcttgaagcacatctgtaggcaagatggctgagaaatacaggagagggggggggttttggaaaggaaatctgctttggggatgatctttcaggcaatgtcaacttacttctttaatcaacatttaatatcaatggatctgggattaaaagggctgaatatgtaatgcctcgtgaagtatttaataatggcctttatttgtatttggatcaatgagggttttaaaaaaaatgggagagaaaaccactaaccttgatttttgggtggcaaaatcagataaacctggaaacataaatggaagtgcttagacatttttctagaaaaaaatgcgaaggttataaagatgatgcaaccatgattggcaagctgggacaggaggacctggattataagcggacctgggggggaacttaatggtgctgattccataggctgggtttggtaagggggatccactggcatgggagccatagttgttgtacatgggagagcggaggtgaagggcacattgtagagggatgcatgcgttcgagcaaagtggggggaggggagtctacttggtgatatgatgcgggccatatttgtggggggagggcgagggcgtc

SEQ ID NO: 642899 - DNA, 466 bp, Homo sapiens
ctgtgaaagtggtgacacttcatgtatataatactgccagggaatgaagaattgtacataatgaatccaagttgccaaaggtacattttcaagtgttaggactttataattctgtcttagatgaaaaagcttctaaaacacacgatagacatcttttctctcaaattcagctgattgctcatggtttgatgttgatgcaatatttgggagattaatgccactgaggatatggctatgtgtttgtccaacataaaccatccaaggacacttccttcacaagttagacacttgttcctctttctgaatgctcttattttatctggctgcagactacagtagctctatttcctgatgaaatctaagttgagttttaatttttagtgtttgtaaaacagatcactaaaccggggaaagtaatatgcaaaatgtgtgcttacagtggataaagtcctttaggcctttctga

SEQ ID NO: 642900 - DNA, 3361 bp, Homo sapiens
  misc_feature (434)..(434): n is a, c, g, or t
  misc_feature (439)..(439): n is a, c, g, or t
  misc_feature (621)..(621): n is a, c, g, or t
  misc_feature (640)..(640): n is a, c, g, or t
  misc_feature (659)..(659): n is a, c, g, or t
  misc_feature (705)..(705): n is a, c, g, or t
agcgggctattccgactggcaatctcgaaccactgcggctgcttcggagtgccaacagcgcccaagcagttgccctcttccttggtgcttaacttaagaaagaacagtgctgggaaggataaagatcacccaggaaggacaggggaggaggagtctgacgtagagaacacgagataagcccctcgctcttcctttttttctctgtcatctttgacttctgggataaccgggggcaaccaggtcaattatggagacacacaatcacttcgaacccagactagtgatcgctggggtataattacaagggaaaacggggtgaggagagcaaaggtctggagacggaaagtgcagacaggcaacaatgcacagaagttaacaacgagaacgcgggggtcgggggcgatgtaaggaagtcgtcatcgacgccgcgccgnttccnccacctcgcaccagacctctgaaatgccctcggagactcggcctctcctataaggacgatcgtcctctcagctggagaacaaggccatgcctcagctcctacgccaggcggaagcgggagaggaaggccgacccccaagagcgcccttcagggggtccatccggccttgatctcagatgggngggtgttgcggagggcggngcatcgcctcacagctggnggctgcatcatggcaggaacgagtttcctgagccacggagctgcangtcgcctcctctactacctgctaccggttacctcttcgcctcttggtcgtcgagcagctccggctcggtcgccgccattaccacatcgcactccgcggcagccgccatcttaccgccgggaccagagagctgggtgggaggccggcggtgaagagcacttccggttggagcatagagcagctccgcggcgcctacgcccagaagggctccctcgggctcgtctaccagagagaggctccgcttggggccagagcggcactcccgacccccggatgtccacggtggtctccgcgccggggcgggagcccagggctgtgccaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaa

SEQ ID NO: 642901 - DNA, 987 bp, Homo sapiens
  misc_feature (112)..(112): n is a, c, g, or t
gaagaacacctcctgtgttccaggcgctgtgtaggcctcggagatgcgggggttcatagcaatcagctgaagtactgctgcactgagtctgtaacccttgaaccctctttgnatcgttaagatcaacttggatgctcttttaaatagtcctcctcagtatatacccccgattagacgacacgcaagtgaccgtgaaagcaaggtcgtatgcaaggtttatgaccctgtatgtgatgtgtatagatgcacggcttgcctcgtggtgactatgttccactatgggtcatacattatcattcagagctggcgcttgctcgtactggcctgtggagtcttcccctggatcttctgaatagcactttcgcgctagaatggttgacatctcacttgccatgacaactgattcctagaaataactgggcacttcttgcttggtattttgctttcctttaccagtggatgtttggggcttgggacctcgccctgtgagatttcgtcatttgctagtacttactcgcctaggtcatcctttctcctactgtcttggcgctggtgcacggcacttgattcgtttacctgatttcagccctcagtggactctatgccgtgcggccgttggctacctcttctgggagggatctccgcatgtccgccctgagctttgttgcttctgtcttgccctgggcgacatgtctctttggatccagttgggtgttcttctgaggccacctgtctgttggacgtgctgggcctgttttggctcccgtcctttttgctactccactcgttattgggaaggccgacctttgggatccacgcgcttttattcggcgccggcttggcccgcttagatcccgacactgctcgaaaccccggtgtccgggccgttacaggtccagagacacaagtgggcccccctcccttgttctctccccctgttttgcaccggcggtgttttttcaacccctcttggcgccgctgcgcacg

SEQ ID NO: 642902 - DNA, 1525 bp, Homo sapiens
tcggcgtgtgcgtgggcgttaggtgtgagttgtggtttgtgctggtggtgtggttggtggttgcgtggttggctgtgtgcttttgttggtttggtgttggttgcgtggtgcggctctgcgtggtgtgtgtttgcttgtcggtttcgtggctgtctgcttgcgtcagtatgtgtttgttcttctcgtgtatcgtgtgtgttttggtgttgtggtgtcgtcgggtgccgcgcggtgtggcgtggcgggggtgtgtgggttggtggtggtcggggtgctggttggtcggtggcgatgtgtggtcgttgtttttgtttgcggctggtgactgtcgttcgtggtcggggtgtgttgtgttgggtagttcgggtgctgatagcggtgtcgtgtggtgtttggcgtgtcgggtgtggtgtgtggggggggtgaggtggggtcgagtgtgtgtggttgggtgggtggggtgcggcgttgtgggtggttggtggtttcgtggtggtgggtttgttgtgggtttgtgtgtgttcgtttgtggttggctgggtggtgggttgttgctttgtgagtgggctgtggtctttgcgcttctggggtggtcgggtgtggttggtggtgtggttggtggtgggggcgcgggttggggggggtcgttgtgtgtttgttggtagtcggtgtgtcgcggggtgtgtggggttggtggtgtgggggagggtcgtggggggggggttgggtgtttggtggtgtttgtgtggtcgttggcggtggggggggtgttttgtcggtgggcgtggtgcgtgtgtgtggtttgtggggttgttgggtgtggggggcgcgcgctggggctcgtgcggttgctcgtcgcgcgcgcggtcgcggcggcgtcgtgctttcgtctcgcgtcggtggggggtggggtttttgtgtgtgtggttgttgtttgttggtcgggggtcggggcgcgtgggttgttgtgggtgtcgtgttttgtgttggttgtgtgtgggggagtggttggtgtcttcgctcttggtgtggcgtcgggttgtgtgcgtgtgtgtcgtgtgttgctgcttcggcgttttgggcttggctcgtcgcgcactgcgtgggggggtgtggggggggggggtttggtgttgggtggttggtgtgtgttttgtgtgttgttctgcgctccggctgggggtggggtggggtcggtgctgggggggtgagggagtgtgcttgctttctctcgtgggtgggtggggtcgagggcgccgccccgcgcgcctcccccccccccgctgttttcctcgcccccgcccctcgccctcgcggtgtggtgtgttgtgttttgtcgccctctctcttctctctcccccccccactattgatgtgttgtgccgcgcgcgcgcgcccttttgtgttttgttgtttttttctctccctcctctttcctacccccccccccccctctctctctttcttcttctcgtgcgccccccccccttctttttttatttagtatatacgccccccatgcaca

SEQ ID NO: 642903 - DNA, 2402 bp, Homo sapiens
agcgggacggaagctggggagcgggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaa

SEQ ID NO: 642904 - DNA, 235 bp, Homo sapiens
ttggaggacagaaataacaggtgggagagcaatctggtgtgagggaatgggtgtataaaggagccctaactcattgccactcatcttcttccaagaagtggcatcaacatacaagagtgcatgaactggatagactctgggggagttccgggctcctaaataagggaaagagaaggggcgacacagggccctgtggtttcctggtgtacgtaacgtgaactgtgctccagttacg

SEQ ID NO: 642905 - DNA, 2253 bp, Homo sapiens
tttctgttttaaatcccccaccactgtgtctgcccacttttaattaatgctatacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaa

SEQ ID NO: 642906 - DNA, 403 bp, Homo sapiens
aagacccagctctttctttggctccttttttgaagccatctttgtctgctctcctctgctgcccagaaagttccagagtgaagctcagctctagatgaacaaaaactggttgagtccagagatgcctgagttggagatgaaccttgcaaactttcctcattaccatactaaaaaccccacccaggaaggagcttatctgccatttcctacacatgtgacatatggagaagcatgatcagctacttcacagtctctgcctttactctgcctccgcatacaatgctcagccaactagcctaacgaaagctgttttcaccattgtttgggaggtactgctttgggaaactgccccagctgtcctccttacttgttgtaggtaataaaatccctttgttaaatctta

SEQ ID NO: 642907 - DNA, 635 bp, Homo sapiens
tcatgctggcgctgctggcctgatctacggtgatgttgtccagcgtcaccgtgcgtatgcccgttgccagctgctcgggctggcgtcgcctgcgggcggggcggcgggagcgctgtcctgtgcatgcgcgccgaatgcggtggccagcacgcaagcgatggtggtgtacaggatggccggaactggctgtgcggcgcaggcgccgactgggcgggtggccgctatggtgaacaggcatcggttgatcccttcccaggacaaagtgaccgaatacggtggtagctggtggtgcgggcatgcgcatggagcggggctggctgctgtccgcgcgggtgtggccagttggtgctgtgctgcgtgatcagtgtaggtcggtccggtgtgcgtgacgccgaaagcgcgctgcgtcgcgctgacgtccccctgtcttgcatgtgtccgcttcagggtagaagcgcaagccattccattccaatgaagcattgtgcgagagctatctcggcttggaatgctgcgctgcagcacctcgcgttttgcttgtaccctcgaaagtgacggcgtgatacggcaaacgctgcggcattggggcggtactgtgctacgtggccgatgggatggccaaagatgttgcgcac

SEQ ID NO: 642908 - DNA, 2375 bp, Homo sapiens
agcgggacggaagctggggagcgggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaa

SEQ ID NO: 642909 - DNA, 262 bp, Homo sapiens
tggtagagacagggttgccatgctatgttgcccatgctggtctcaaactcctgggctcaagcaatcctcccacctcagcctcccaaactgctgggattacaggcatgagccaccatgcctaccccaaattgtatgctttaaaatggtgagttttacgatatgtgaattatgtatcaacttttttaaatgtggaatgacatatgcccaaagatatacattggggaaaacatcaaagagtaggtcgacgcggccgcgaatttag

SEQ ID NO: 642910 - DNA, 120 bp, Homo sapiens
tttctattcatttggttttctcagctttcctgcagaaggtcttttcaccctccttggttcacatttcattcctcaggccattttcattcaattttgtgtgtcagcacacattgcacacgg

SEQ ID NO: 642911 - DNA, 1462 bp, Homo sapiens
  misc_feature (1099)..(1099): n is a, c, g, or t
ggcacgagctcgtaagcctccttattcgagccgagctgggccagccaggcaagcttctaggtaacgaccacatctacaccgttatcgtcacagcccatgcatttgtaataatcttcttcatagtaatacccatcataatcggaggctacggcaacgtgactagattccccgtaataatcggagccccgcgatatggcgttacaccacgcataaacagacataagcattctgacatcttacccccactctcatcctacatccatgcatcgcactctgcataatagatggaggcacggagcaaggaaacaaggtagcaacagaacatacaccatccacataaagcgcgggccaatacatacccacaccatgagagaccaacacgacaagcacacatacaccactacatatctaccatatacacactagaacaggatatcatcacgtcatacatcgttcaggggccatacaagtaacacatcacaaacaaaatgaatcaaatcactcaaaaccacaccatgaacaataaaacacaagtaacaaaaaacgccaccaatcatacgaacatggaatcctgatcacaacaatcacaagacacagatccaagatacaaatcatacgcatatacatgcataccacgagaatcacaataagcatgacatgggacaaatcaacatcatacgtacacgtaacaacagaaacacgagaagacatcaaaaaaacaacactatctaacagaacacacgacagagaaaacagcaggaagaacacaccaaaataacataataaccaaaaaaccatcagtatcatgtacataccaacgtgtcaacacacatgcaacgcataaccataatacgataaatcccataccgacagagaccaactggacacataaaagacacaccacataactcagagcacacatacagtaaacaccaggcacaaacaaaacagaaaccacgtcagggcaataccaatagcacataaaatgaacccatgaagccaaacagaaacaaaccaacagtgacacaaccataaagagaaaaacacacaggaagagacaaacaacgacacacaacatatcatcaacacacaacagacnaagcaacaagcatcacacacaaaaagcaaagccactacccacaccacccacaaacaaaacacaacacaacacacaacaccacagccggaaaagagaaacagacaacacaccacaaacacacacaagaaacaaaacaagaaaacaaacagacacagagacacgagcaaccaaggaacacacgcacaacaaaccacaagataactaacttcgaaaaagaccaccaacaacacctagaacaacagaaaaccaagcacccacgaagagacacaaaaaagaaacaacacgaaacaaacaaagaaaaactactaacacaaccaccacacacaccaacagaacaacaagacaaccacaaaaaacaaagcc

SEQ ID NO: 642912 - DNA, 112 bp, Homo sapiens
tatcttttaattttttaatccaattttggatgggatttccacgttctgaaaaactgtacttaaaaacggttaaaagggtaaattttatgtatatattacaatagaagaatgc

SEQ ID NO: 642913 - DNA, 224 bp, Homo sapiens
cagacagtctgcacttgacaatgcaacgttagcctacgtaattcgcactctatcatcgtatcactctggtaacgcttgtactaacaagggtataggatctaccaagtacacatgtatgagcctcagctgccaggtctgtaagacgtactcctcgtcgtacagtattgccaggcgtatcgtactgcggctaatctatcgcgtattcactccgcgcacagcgatcc

SEQ ID NO: 642914 - DNA, 413 bp, Homo sapiens
tgcactaggtcccgagaatatcagaaataagtaagcaataaaactaattctggcaggaatcagggtggcaataggactagcagcacgctggggtggctttgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaa

SEQ ID NO: 642915 - DNA, 223 bp, Homo sapiens
tggaggggaccgcggatagagggtcacagtccaggtcacgcatggcacagtacagtgtacgggagtcaatttcgtgatctgtgtgacagtaggaatgaggcaaaaacacaagggggcccgggaaggacttcactaagaactccccgggaaggggctcccggccagcagggtggcaggagagcagacagagccagtggcgagggaagaggcggtacagcacacg

SEQ ID NO: 642916 - DNA, 282 bp, Homo sapiens
  misc_feature (196)..(196): n is a, c, g, or t
  misc_feature (203)..(203): n is a, c, g, or t
tttaaatatcccatttcccttgctcttggtcctcctcctatccccctatggtatttctcctcctcttcctcaaggtccaggctttttgtgtaaaggcatttgtctcatctttgtcagtcgtggttcctgacgttcacctctgggtctgctggtagaggactgagagatgtgtggttttgtaggaagggggtgtgtntgggggntagtggggaatcccatttttttgcatcactgtgaggtagcttcaggccctttccctggagaaataattgcttcgcagaa

SEQ ID NO: 642917 - DNA, 350 bp, Homo sapiens
gtgtggggtaatctgggcgtattcagaaaagatatattgcagctaaagggggctgagagggtctttttttccctcagggttgctgaataaactgtgtgtttgtatgcctgcattttgtctgtgaattgtcacatgaggtcaggtgtggaaattcccacatgtggtgtcattttggtgctcagacatcagattttcagattagggatgcccaacctatatatgtgtaatttacttattatttatttatttattgaaatgaggtctcactctgtcacccaggctggagtgcagtggcgctatctcagctcactgcaacctccgcctcctgggttcaagcatttctcctgcct

SEQ ID NO: 642918 - DNA, 681 bp, Homo sapiens
caggaggcggaggttgcagtgagctgacatcgtgccactgcactctagtctgggtgacagagcaagactccatctcaaaaaaaaaaaaaaaaaaaatttttggtaaaccctagggggtttataaacaacagaaatcagttccagtttgggagggctggagaagcccaagatgaaaggcaccagtagatgcaaccctcttttggtaaggggtgaggggtcccatgatgagggcttgtgccccttgcccttgtgaccgggatgacctccaaaatgccccaccttaattaccatcccctttgcaggtgaggacttaacgcaggtgggtttgggggggacgttgctcaggccacagcaggcgtgcattgaagagccagttgagcctcatggagcccctcgggttcagccaggattctgacatttgacgcccacgctttgaagaatcaaagacagggggggccttgggagatgtgaagtggggttctgacgcggggccccaaagacctgtctccgacgtgagctgccttgaaggccctgtgggtaattcctcagttgcgtgcaaggcctcgtggctgtggagagcctccccgttgtgcacagttctctctttgtgccagggcaagcgttgtggggcagccaccaggttggggcagaggaggaaagcagaggaagacctccagaaag

SEQ ID NO: 642919 - DNA, 854 bp, Homo sapiens
  misc_feature (439)..(439): n is a, c, g, or t
agcgggggggaatccgaacgtgtttgcggaaaggagtcggggttccatcttgtacatcaccccagcgcagctttctggtagaaatggaatccgaggcatcataatgtggcacgcagaattgaccaatatgatgtagcatagatgaagctaatagctgagagcacattggaaagaataatgtttaacaagagtgaaggacgcttacatgatgaagataaggcgttagaatgaaaactttctcgctgaataatacagtataagcatcagggagaccatgttgaactcatgagttagtgactgatggggcaaacagaacaagcatggacgtaggtgtgtagtatagtgtgcatctaaatctagtacgaaaaatgcgagctggggttccaggctagagttgaatgccgtcagtcttctacaaataaacatgtggaggctggtntccgatataccagctcgagagtcaggaacttgaaatggcggcattacgcccccatggataacactgagtaggagcaagataatgaggcagtgtacgcgtagaaaaattcaatgctgagcatgtgggctggaagtgtgttaaacgcctaatgtcaaagagcgcgagatgaattgcaacggatgacttacctttatgcaaagtgggtccagggaggcaatacctggacaaggaagcatgtttgggagtgttgggttcactagtagtgctttgttggatgcaacgtgtatgtaaagcgtgttcagcgaaaggctaacatgcttcaaatggaccatgttaaaacaaaggaattcattcgataaataggccgtggtagcaaatgcggcttggaaggcaagaaaggcaaccttagaaaaag

SEQ ID NO: 642920 - DNA, 485 bp, Homo sapiens
ttccattgtgtgatgttgcagaagagcatgagtccagggtttaaaaatatgtacttttcatacaacatggtcatgaaagaaagtctacttcatctgggactcaaatgaagaatcaacgtattccaaagtcaattgtgctggacttaatgaaagagggcatatcgctctttaatgtagcacatatctaatagattttctggcacaattttgacaagacacaattttcatcttatgggctgactttagaacctaacttctcctctgattctagattcatcttcattgtagaagacaatggaaaagcaacagcatccttcaagttttcttggatataacctgcagtgctattgagatttaggactggaaaatagcagaaaccaactagagctagctgaagcataaagaaaagaagatactggttgggggtattttataaaaaactgtatctgtacatgcaggtgtgaggatgcaaaggaagcaatgac

SEQ ID NO: 642921 - DNA, 377 bp, Homo sapiens
aacagttgcgagtcataacctaatctagcatgaggcactgtctcatgcacattgcaactacagtttcttcacttcactggaatacgtccaggtagccgacttgcgagctgatcgactgctggaatgaccgtcgaaactgtccgggcctggtctagtccatgttggaggcgatggcgggtgatggagagagagcatcgaaggtggcgctgggctgtgcgtagggcgagggcgccgttgacgctgtcctgcggcgtggtctgtgtcatagggactaggtggccgaggagccgttctgaatctgctggggagccagggttgcaggttgaggaccgtgcagctggagaccctgtggggcgctgatgttcctgtttgagagc

SEQ ID NO: 642922 - DNA, 474 bp, Homo sapiens
cgatttagtacttgaaaagatcatctaaagcgtgatcgagaagagccttcacgactctttcaaaatgagtatagtggtcactataagaatatagagaataccgtgtaacgaactttcagattgtgagtcgtagatcaataatcctcctagtgggttataatgctcttgatcaccctcctcatcttggcactacaaagtcatcgatgttataagcatctccatcttcatcagattcataattatcctcttcttcctcctcatcaacttcatcactgctggggcaagattcctttgcagagtcctcaaaatctctaccactactgcgtctctgacgagatctttgtattgagagttctttgagcttctgaagttttgctcgctttagtgcagctaatgttttttcaggagtcttttgctccatttccactgaagaaccttcatcatcaaccactctacggggacgtttaacaccaa

SEQ ID NO: 642923 - DNA, 259 bp, Homo sapiens
cgactcaaggatcagctctaatttcttttgacttgcgggatattgttgatgtaaatcaggatgaattaatgagcattgttggcaatgatttaaggcggcgttgtgctggtttaaagcttgcttcccgtattgttggaattgcgacggcgaatagagttcagttggatgacgccggggtacttcaaagtatgtctgatttcatgcggagattatcggtattgaggcaagtagctttaacaacccttcagatcgataagga

SEQ ID NO: 642924 - DNA, 281 bp, Homo sapiens
gcacaacgtttaagaaggattggggaagaatcctccaccaggattgctcaaacactgaactacagacaaccactattttatttaaataaggcgccagcttcctaaaagaatacattctctaataaaaatagctaattattctgaatgattaaatggtttcctccacaatttacatcacaccatgtaaattttagcagtaccatctgatcctaccagcacatcatgctattcctttcatagagccttcagagattcattgctaaacaaattccctaagttgg

SEQ ID NO: 642925 - DNA, 877 bp, Homo sapiens
  misc_feature (695)..(695): n is a, c, g, or t
tctgctgagggggcaggcggagccttgaggaaaccgcagataagttattatctctttgacagatagagattaattacacactacttaaagaaatatagtcaataggtgactacgatattcgcttagacgttaagtcgttaagcgtaatatgaatagctttaagacttattaagagaataatatgagagatcattaaggcaatgatgataagtctatgagggtaaggaaatagatataaaaggtttactaaagacatgacgggaggttgagtatgaacgcttcgttcatggaagtaaacataatgtattataaagagtaaaaatagacgagacaaggtactatcgatgagcccacgaagttggaagtacacatatagtaagggtgcaagtgcgtattttagcacttaccagatgggcacaggtggaccttacatacgagcgttcacaagtattagtattcaaaaagttcgtaagtggtgatttaaaaggatcaacaatctgtgaacgcgctgcattcttatctcacacataaggagaatttaaacccgggaaggtgcattaaaaaggaccttgcaacatccgatgaccgcagggcagaatccgcggtcatttaagagctctagtttaacgcattctcactaaacgcgaccacgaagactgcgccaccgattaatggggaacggtggtaggataganaacaccttgtgggacgtaaagataagaccgtttgcatggtgggctagacgtggaactcacagaacgtacgggacgggggaagtacaccgaataggagacagacttgcggaaattaagaaagataaccaacaatactttttcgactggcaccaatgatcctgtttacaccctgaaaagtagga

SEQ ID NO: 642926 - DNA, 314 bp, Homo sapiens
ccggtatttagctttagaagaaatttacctcccatttagagctgcattcccaaacaactcgactcgtcgaaggagctacgtgcaaggtgccaaccggtcacatacgggattctcaccctctatgacgtcctgttccaagaaacttagaccggccgctgcctagaagcatcctctacaaattacaactcgggcttgcgccagatttcaaatttgagctgttgccgcttcactcgccgttactagggcaatccctgttggtttcttttcctccgcttattgatatgcttaagttcagcgggtatccctacccgatc

SEQ ID NO: 642927 - DNA, 324 bp, Homo sapiens
  misc_feature (1)..(1): n is a, c, g, or t
  misc_feature (61)..(61): n is a, c, g, or t
  misc_feature (77)..(77): n is a, c, g, or t
  misc_feature (79)..(79): n is a, c, g, or t
  misc_feature (83)..(84): n is a, c, g, or t
  misc_feature (91)..(91): n is a, c, g, or t
  misc_feature (94)..(94): n is a, c, g, or t
  misc_feature (108)..(108): n is a, c, g, or t
  misc_feature (131)..(131): n is a, c, g, or t
  misc_feature (133)..(133): n is a, c, g, or t
  misc_feature (145)..(145): n is a, c, g, or t
  misc_feature (155)..(155): n is a, c, g, or t
  misc_feature (171)..(172): n is a, c, g, or t
  misc_feature (191)..(191): n is a, c, g, or t
  misc_feature (195)..(195): n is a, c, g, or t
  misc_feature (208)..(208): n is a, c, g, or t
  misc_feature (217)..(217): n is a, c, g, or t
  misc_feature (221)..(221): n is a, c, g, or t
  misc_feature (225)..(225): n is a, c, g, or t
  misc_feature (238)..(238): n is a, c, g, or t
  misc_feature (244)..(244): n is a, c, g, or t
  misc_feature (273)..(273): n is a, c, g, or t
natttaaaaatattttattttttagaaaataaagcatttaaccatcccaaactgcagttanacctgccccagccctnantgannccacttnttntggccaaaggtttntgggctgtgctgggaccctagtntnagctccccgggnggccaggttnatgccaggcccctganncagcccccttaagccagcnaggnagggtccccgganaccctgggnacanagangagaagcaggganagcaanagggaagggtcaaaaaatgccagcccggnggccctcggacgctgcaagtgcgttcagctgccagccctcctgacctccca

SEQ ID NO: 642928 - DNA, 155 bp, Homo sapiens
tgcagaacttgacagttgggtactgtgcggcaaggcagatcatgcacccattcatggcttcgttccttggattcccatcttcttaattttgacccttgttgccattgcttttttgttcttatccatcatgtctaaaaacccttttccactggaga

SEQ ID NO: 642929 - DNA, 230 bp, Homo sapiens
taaaaagcagcattcccagggcccttggaaacagttggccctgtaaggggcttgctccccaaaacccatcctaaaaggggttgtaatggggaaaacgtcttccttttttattgcccctttttatttatgggaacaactgtttgtcttttttggtatcttttttaaactgtaaagttcaattgtgaaaatgaaaatcatgcaaataaattatgcgattttttttcaaagta

SEQ ID NO: 642930 - DNA, 165 bp, Homo sapiens
tgcagcatttgttttattttggtagtttggaactgaccccgcaatatccccaaagtatgcaaatagttgcaaaaatgtgttttttgccatagtaaatatgagtatttccaataaactatgatattacttttgtaaggaaatagaataaaatgtaaatatttttta

SEQ ID NO: 642931 - DNA, 127 bp, Homo sapiens
agagccactagtagcaggctgcaaacagagccatgtagcagtgaggcgttgctcttcttccctggtgtccccatctacctattaccgcatctagccgacagtctcagacctacctatttcacaatcg

SEQ ID NO: 642932 - DNA, 604 bp, Homo sapiens
ttaaattcagctatcccaagaaaaacccaatacatgaaatcattacaagtattttttagaatcagtcagcaaagatcattctggtcaaacacttcaaagttaaggtcactaagaaagcactaactcctcccttctgttaactaatcactgtaaagcagcccaactctcctttctacctacctcagattaatatttttctccatggacagatttccgtgctcagggatatataataggggagaaaaaaaaataccacacaagtgtcagtaagcaccaaaaagctaagtattcagcacagggagggaatccacatatgagaaaacatttgacagctcttgcctgccaaaagccatttaatctgcttcataaacataatctgcttcataaacattaccctgagcgagtggttcgatggatctcctacaccgagtcctaaccgggaaacacaatcaaccgaaccgtcccgactctttcaggcaatcaggaagaccgggagaattattagacgctgacgtccgcagggccaggagctgagaaaagggtaaacagtatactcgcaggtaggttgaaaaaaacaaaacaacaacatatacacacacacacg

SEQ ID NO: 642933 - DNA, 1045 bp, Homo sapiens
tatttatttcatcacaaatagcactttttattggccactatttgaagtctgaacttataaacagatcctgttggactggtggtctcatatccatcagctcgtccaacttatagcacctgtctcgtccccaggtggctttcccaaaactactgccttcaccatgaagctccatgagcttccccaattcaaactggggcttctacagcatttttactttctctaacagaagacattcatggagaggcatacatagatgggcaagcctttcctatgttctttcccaatgctgctcgggaaatcaattaatggaaccacttcttctcaaggtcattgtgtcgtgccacctctcgggtcatgaattcccatcaactcttactctccggaatatgtggccgggaccgtgtagagatgcttgagccataagaaggtctcccgatatctgaatgcgtggacgttattaagataaaaccaaccacagaaacagacgaaaggcaagttacaccatgcggatagatctgtgcactatccaacagttgagactctacaaatcatgtgtctctgaccattttttgtgaaccagtgtgtaacacaccactttgtgtgtcaccagcggtgtttaggacactcccagtgcccacgtgggaacaggtttgagtccgagagcaagctttttaacccccgtgtaataacactatttgacgcggtaaaagtccaggctttgtgcaaatatgtttccataccaatagtggagcactcttctgcagtccaatctcttggcaagcattccacagctgaaaaagatgctctccatgttctaaaacgcccgacgcagcaacccgccgtgtgagaaacccccgtactgatatgttgtccagtatgtggggggatacccccgtggggggtcccccgctgggcagtgaacgagaagcagatcctttgtccccaaaaacatttcgcgtagtaattctatgtgaacaccactaacgcatagggtatggtgttcacacccagttactaccaccaaagctctgcgtctttacgaaaa

SEQ ID NO: 642934 - DNA, 265 bp, Homo sapiens
cgatctgaggtctggaacgatcgagacaaggcgagacagttctaccatagtgcgggtacagagatagaggctaacaatgaaatatgaaagcattaaagaacaaaaataaaaaggcacaaacaactttaaattaacttagataactgtgcatatatatatatatacacacacacacacacacacaatatttacaatagtaaattttaaaacaatctggtcgtgttacaggacaaattcacgttgccacaaggctgtccagctctaa

SEQ ID NO: 642935 - DNA, 834 bp, Homo sapiens
tagagcattcgtatgacgacttgcgggcctacacagggtaattgaagttgctcgatagttgtcgcttgatggagatcctgttgcatgactagctgctttgggatgttcatcgacgcaagtaaacagatacgcctgggggcatagcagaggatgttgtagaaatattgtccaatttcgaagttcgtgcggtcatgattgtttgcctcatacccaaggagtcattgtgagcatcagaatcatattgcctcgcaccgctccgtgtgtggacttaaatacccagaaagctcctccgtcaagttagatttgttaacaaaatatcatatgaccggaataaataattccagtgggatggtggatgcccggagcattaccagtgttagcaaaatggcaaaatttcatatagcatttaaacgtttgtactttcaagagctaagacgtctacatgatgtccacaggaaaattattgaaggcttccacagccacccagaaggtccaaactatacaacaattaacttcagtgggatctcaaatttgtcttaaacatccaaccaatctttctacctcattgttacatgtcttgactaacttattcaccaattgctataattacacatttaggttaacaacgaatttccagcctggtaaaacattgacccttggacccattttgtcacgacctatattcaactatatgttacccccaatatattgtttgccaggtaaccgggcgggaaaaactgcagcacaatttttttagtcttggcaacggcctgtcttttaaacttaacctgggttcccgaagtgaattgcgttcacaacatgaagtctttggcg

SEQ ID NO: 642936 - DNA, 268 bp, Homo sapiens
  misc_feature (161)..(161): n is a, c, g, or t
  misc_feature (169)..(169): n is a, c, g, or t
  misc_feature (189)..(189): n is a, c, g, or t
  misc_feature (238)..(238): n is a, c, g, or t
  misc_feature (242)..(242): n is a, c, g, or t
aacctttaattttgaaaagattagcattgggctgggtgcagtggctcacacttataatcccctgcactttgggaggccaaggtggtcagctcacctgaggtcaagagttcaagaccagcctggccaacatggcgagcgaagccccatctctactaaagatnacaaattngccgggtgtggtggcgcacncctggtgatccgagctactcagtggtctgaggccggcgaatcacctgcncccnggaggcagaggctgtagtgagccaag

SEQ ID NO: 642937 - DNA, 123 bp, Homo sapiens
  misc_feature (2)..(2): n is a, c, g, or t
anatcgtggctgtagggtacaaaacggaacaagcaccctacagtcagacggacgcacgatgtggttaaggctcgtacgtatatatatgtgtagaggctcacacacgcgcacacgcacataagg

SEQ ID NO: 642938 - DNA, 326 bp, Homo sapiens
  misc_feature (20)..(20): n is a, c, g, or t
  misc_feature (149)..(149): n is a, c, g, or t
  misc_feature (169)..(169): n is a, c, g, or t
ggaatgggtgcaaccctcantgaattttggataccaaattaagtatggtggggtagtttttaaatacatttacctatatatatatattaatgaaaaattgtttccctaaactgtgaaaaggcttattaaagaaatttagaggctggatncggtgactcatgcctgtaantccagcattttgggaggctgagatgagcacatcacttgagcctaggagttcaagaccatcctgggcaacatggtgaaaccctgtctctgcaacaaataaaaaaattagccaggcgtggtgctcgtgcctgtaataccagctagttaggaggctgagg

SEQ ID NO: 642939 - DNA, 560 bp, Homo sapiens
tcttgctacccctgacatgtgagcaagtgctcagtgaaaagcggtaaagcagccagcttaggctataggagcgccaacgtccactctgaggtgaagataccaattacattcgagacttaggttcttacagttgattcctaacaaaagttcctgagtccagtatctacgatattacagcactagcaagatcagtgtctacgacatcatctattgctgctgtatcctcttcaccagtggggggagggcctgcactgtccatagagtgggctgataataggttgaacaatttcttccagttccttcttcttagctttgaagtctccaatgtcagcatcttggtgtgcttgccagccattcaatcttttcttctacagctgttaccatggtctccttatcttcagaggaaagtttacctcccagctgtgtcttatatctccaatctgatgcttcagagaataggcgtagctttccaactcattgctagtatcaatgcgctccttgagctgttggtcttcgtcagcaaacttctcagcatcatttaccatcctttcgaaggctac

SEQ ID NO: 642940 - DNA, 144 bp, Homo sapiens
  misc_feature (42)..(42): n is a, c, g, or t
  misc_feature (67)..(68): n is a, c, g, or t
ctcagggctcaacgagatcggatcgcgccgaggcaacagcgnttacctacagcgtcactgtcgatgnntgcacgagtcacaccggacctggggcaagacagtgattgaatacaagaccaccaagacctccgctgccatcatcga

SEQ ID NO: 642941 - DNA, 140 bp, Homo sapiens
  misc_feature (9)..(9): n is a, c, g, or t
tcgatctanaggatccccgcatcttgctcccatcaggtccacatgagagtacttcttcctgactgtacaatcaccccaaatcctctctactttgttgtccacatcctcatcgttactgatgggacaagactaggtaccac

SEQ ID NO: 642942 - DNA, 809 bp, Homo sapiens
gtctccggccgtttgaatgtgcgcttccgccatctttccagcctcagtcggacgggcgcggagacgcgttctggtaaggaacgcctgcgatgggtgcgcagggagtagcccccagggtccagtctacaaatgttgtttttggttgggtgatggtgggtactggggaacacaagtgagccttcgttgaaacaccgttcacgattggtgacctgggtgaacctttgtgaaggcaacggcaccggctacttgtttagggccaaccccttggggagttggttgagaacggggatttcaattccccccacattaagagtggttgtccccggaaataccaagaacacggaagggggaccgcgttattataagaacggttgtcccaagtctgttaattgggcggagcaccaagggccggggcccaagcgcgaagggacacacttcggccgcgcggggagaacctgtggacgacgggagttgcgggctttagtttagatattttccaaaatgtcgctcaaggttgggttgccccaattttcgatttaaacgttgtttgtagagcttgttttaacccattcgggagaaaggttaaccttttagcatagggacattggttgcccgttaaacagtgggcggatttaaggacggcattctggggttacggaaaggtgttgtgtggaaaaaatatatccccgcgcattagggggggtctcgtggttggggcgagaccaaaaagggtgtgggcacttattttacacgggacgccgggggaaaagaggttggaaagggcggaaagaattctcatgtttgttctt

SEQ ID NO: 642943 - DNA, 200 bp, Homo sapiens
  misc_feature (54)..(54): n is a, c, g, or t
  misc_feature (83)..(83): n is a, c, g, or t
  misc_feature (86)..(86): n is a, c, g, or t
  misc_feature (116)..(116): n is a, c, g, or t
  misc_feature (129)..(129): n is a, c, g, or t
  misc_feature (135)..(136): n is a, c, g, or t
  misc_feature (151)..(151): n is a, c, g, or t
  misc_feature (163)..(163): n is a, c, g, or t
  misc_feature (200)..(200): n is a, c, g, or t
tctgcgcgcgtgtggcgtgcgtgcgagcgatgcgcgcgcgcgagtgagagagantgcgtgtgtgtgtgttgggcgagtgtggntgnagagtgtttgtagggagagtgagagagggnatgaaattttttncgcgannttgaggcgagttggnatgcgcgaaacnttagcgtgcgagaggcgaggagaggagaggaatgacn

SEQ ID NO: 642944 - DNA, 173 bp, Homo sapiens
gactccaccttaccaccagacaaccttagccaaaccattttacccaaataaagtatagggcgatagaaattgaaacctgggcgcaattagatataggaccgcaagggaaaggttgaaaaattattacccagcccttatattaggcagggcttacccctataacctctcgcatt

SEQ ID NO: 642945 - DNA, 892 bp, Homo sapiens
gccttcttcctagcactcacaagcaaacctaactatagtactagacatcatcatggactgcatcagagaaactagaatactcgttgcgtgacactatcctgcccgaccatcagtcctaggtccatcatcgacccgtcccatccctacgcactccttataccatacacagcacgacggtcaacgcatcccgtccgcttatccagtcaagagtcaatgtgggccaccaatggctactgagaccgtacgcagtacagccgaactacggcggagctaagtgctgtcaatctcctatcatactttcccccatttattcctacgaagccagtgcgagcactgcgatctccttgacgttgacaatcgactactactcccgattagaatgcccccattcgtataataattacatcacgaagactgtcttgcatctcatgagactgtcccgcacgattaggcttaaaaacagatgcaattcccggacgtctaaaccaaaccactttcaccgctactcgaccgggggctatactacggtcaatgctctgaaatctgtggcagcaaaagcaacagatttcaatgccctatcgttcctcagcaatctaattccccctatcaaatctttgcaacatagggcccgtattttaccctactagcaacccctctctacccctctctagagtccaacaatcacgaaataatacaaccccggaggtgctcatttgtcgcgggcggatacacagggggtgccgacctgtgccagcatggttacactaggcgtctagacctcgagtccccatttacaagtcgccaaaactagtaccatgaacatctcggagaacccccttacatggacttatgctaatagattccctaacaaccatgttgaccccgcttgtta

SEQ ID NO: 642946 - DNA, 184 bp, Homo sapiens
ttacatagcactttagaaaaattcacaagtccccatccaaaaaaaaaaaaaaggaaaattatcaagggaataaaaatagacttggaacaaaagggaacatttggctgggcctggggggggcatctcaatttctatagcaccagtgattccctccccaccccaccagggagggctcacaggtgct

SEQ ID NO: 642947 - DNA, 119 bp, Homo sapiens
gactttatgctagtatacaaaattcgcacaggtaaaggcacggactctggggagactgggaagtgtcctgcagtcattcagtcgaccatgtggtagacgagctctatcatagtatgata

SEQ ID NO: 642948 - DNA, 308 bp, Homo sapiens
  misc_feature (17)..(17): n is a, c, g, or t
  misc_feature (67)..(67): n is a, c, g, or t
  misc_feature (140)..(140): n is a, c, g, or t
  misc_feature (156)..(156): n is a, c, g, or t
  misc_feature (158)..(158): n is a, c, g, or t
  misc_feature (164)..(165): n is a, c, g, or t
  misc_feature (188)..(188): n is a, c, g, or t
  misc_feature (216)..(216): n is a, c, g, or t
  misc_feature (241)..(241): n is a, c, g, or t
  misc_feature (255)..(255): n is a, c, g, or t
  misc_feature (258)..(258): n is a, c, g, or t
  misc_feature (274)..(274): n is a, c, g, or t
  misc_feature (277)..(277): n is a, c, g, or t
  misc_feature (285)..(286): n is a, c, g, or t
  misc_feature (300)..(300): n is a, c, g, or t
ggaacgtggagaccctnacgtgggctccctgcatttggttttcttttcaaaacttgggagcccccanggaggggctagtgttggtaggtcctaaacgtggttccctccagcctccccaaaatcaaccctggtgttgaaanaacgtccttttgtccntngtgggnnacaaccttggggagggtgcaaancttttcaaaaccatgggccaggtggggntgcctcagtcctgtccccttgggcncttaggaaaggggnccnttcccctttttcctanaangctgttgnnaataaacaaatggntccctgga

SEQ ID NO: 642949 - DNA, 220 bp, Homo sapiens
attgaagataaacactgcacacccacccagctctcagtgttacacatcaatatgtggaaccatctacgaaataataatgagagaaaaattctcataatataaaaaaaaattcatgtgacacaataaataatcacattataatgacaaacagaactagtgaaatccatacacctgattgtgatgcaatgatgtgggatcctcatatgactgtctgaacctt

SEQ ID NO: 642950 - DNA, 233 bp, Homo sapiens
  misc_feature (218)..(218): n is a, c, g, or t
ctgggcaatagagcaagaccctcacctcaaaaataaataaaaataaaagttatccttttggtggtgttctcactagttaactcaaagcatttgatgaaaaatatcagctctgttttagaaatagatgtttgtagcatatgtgacaactcatttgtaagagtagcgagtgaaatttggcttttggtaactgtgcctatgtacattcttatcttcagacnaagtatttgagcaga

SEQ ID NO: 642951 - DNA, 704 bp, Homo sapiens
caagttcaataaagattcttgggggtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacttggggggccgcttggcccaaggggtttttaacctgggcaaggtttttttttgggggggaatttggggctaattggcccattcccccttaggggggggggtttaaaaataaaggggcggggttttaaaacggggggggggggaaaacccggggggtccccaaattaaagggcttgggaaaaaacccccttttgccaggggggggaaaagggaaaggggcccccccggtgggcctttccaaaaggtggcccacctgaagggggaagggaaattggaaggggtaattttttggtaaaaatcggggtaaatttttggtaaaaaagcctattttttaacccaaggggccgaatggggaaaatccctttataattaaaaaaaataccccggataggggtggggggttttcccatttggaacaaggggccccttttaaaagaggggggcccccaccggaaagggggaaaaaccggttttatgggggggggcccccttcggggacccatcccctataaaaggtttttgggggcgggggggcccgaaggccctataatgggacccttaagggggcgcccccgatt

SEQ ID NO: 642952 - DNA, 252 bp, Homo sapiens
acatcgctaggtggagctcccggagaaactgagacaccttaagaacaccactggagaccatagtactggaaggtctttgagcagctggatgcaccatttggctcctgctttgagaatgcagcgggcactccttgcgatcaaaagcccaactgcacgctccacctgcacaagcagctcactggacacctggcaggaccctgtcttctggtgctggtgtgtgaccgagtcaggagtctggtgcccagatccccc

SEQ ID NO: 642953 - DNA, 419 bp, Homo sapiens
ggaagaagagcaaatctaccttagcttctccagagccattaagatcccccgtcttcaaagcctaacagattaagcagctctccagttcacaacctgcgcccaagtaaatgccaaagaaagtcctaaacccagccgaggccacgtctctgaaaaaactcgccaagaaaaaactaagaaattgactttacagaagtcaaaccacaccaggctaagtacaaataccttctagtactagtagacaccttctccagatagactaaggcatttgctaccgaaaacgaaaccaccaacacagtagttaagtttttactcaatgaaatcatcgttcagtataggctgcctgttgccataaactctgataatagagcagccttcacctcgcctatagctcagtcagtcagggtatgaacaacagtgca

SEQ ID NO: 642954 - DNA, 240 bp, Homo sapiens
aaccggttttttttttggcccaaaggtccccgcccccaaaaaaaggccttttggaggagggggaaaaggggaccggttttttttccccgggccccccccccccaaatggttccgggtttatttattttaaaatgggggggtttttggggaaattttgaaatgggggaaccccccctttccccccccaggttccccctaggtttccaaagggtggttttgcctaaaaggaatttttttttg

SEQ ID NO: 642955 - DNA, 364 bp, Homo sapiens
taaattaaatggcataaattaatttggcaaaagactctttataaggggctcattgtaggaaatcctgtccttcccctttgagcacaagtgttggatgaacaacagtttgctataagaaacatccagattagcccccttgcattatatttccttgggttaaaaacaactggaattttaaaccctgtagaatggataaaaattattttgtgtcataactctttgttaataaagtatttttcaccattccttgtcatcaaaaacatggttaaagtttaaaactaaaagcagcagaaaactagcttgtaaaatttatccaagtaaagggcagggtaggctgttttggggaaataaacattaaaactta

SEQ ID NO: 642956 - DNA, 287 bp, Homo sapiens
tatttaaaatcctatttaaaatatatcctattcagaattacaagaaaatgtaagaatggtttcctttttttgggactccgctcggccacccaggctggagtgcagtggcgcgatcttggctcactgcaacctctgcctcccaggctcaagcaattctcctgcctcatcctcccaagtagctgggattgcaggcgtgcaccaccgcacatagctaatttttgtaattttagaagagacagggtttcgccgcattggccaggctggtcttgaactcttgaccttaggtg

SEQ ID NO: 642957 - DNA, 149 bp, Homo sapiens
tccggctgctgcttcttcgtcatgagtggcacttccctttacgctatgtgtatcccagcacttggtgcagtgctgagtgtagtgaggattgcttgatgccccaggagttcataaccagcctgagtaacatagccatgagcccatctctg

SEQ ID NO: 642958 - DNA, 310 bp, Homo sapiens
  misc_feature (25)..(25): n is a, c, g, or t
  misc_feature (74)..(74): n is a, c, g, or t
  misc_feature (114)..(114): n is a, c, g, or t
  misc_feature (122)..(122): n is a, c, g, or t
tcgatgcgagaagacgacagaaggntggcactgcagcgcaatagtctacaagagctattccctatctagagagntatcactttctgatcagccctcataatcatttcctatcgntcctatcngtatgccctttcctaacactcacaacaaaactaactaatactaacatctcagacgcttcaggaaatagaaaccgtctgaactatctgcccgccatcatcctagccctcatcgccctcccatccctacgcatcctttacataacagacgagtcaacgatccctcccttaccatcaaatcattggccacc

SEQ ID NO: 642959 - DNA, 632 bp, Homo sapiens
ggggcacaacatgacatgtgcacacagactaggctgtccatgcaggcgacatgctgctcctgaagctcagacagcagttcccatggcagagtctagggtactgtggtgtctttcagctgagcgacaggattgccagcctccctcagcaggggcacttggtacccccataagggtggcatgccccagtccacttgttacagggcagggcagtaccacgagctagttagttgcttggaattaagaacagcctcccctagtgaggggtttcaggtgatgactgccccgtgacagtggctcagatggagacactacccatgggctcttgcttgaagcagcagatggcacgggccatggcaccgtggcccacacagccaagccagatgggttacctggctcctgcggcaggcctgcggtgacttggccagcactgcccgtgtgcgaggtggcagagcccctcctgtgcagcagcctgggcctactgcggtgcactagggaacttctccctggaacagaagaggagcaccagcctgtgcctggccgagccgagcttgtgctgtggcagctgcccttcccaagacagacgtgctgcctctcaccgcggcaggggcctttgagtccccccactttccctg

SEQ ID NO: 642960 - DNA, 167 bp, Homo sapiens
ctgagcatacgcacccagcctagagacattacttgctttcttttcgactgcgtctgacactgagtttggctcttgacgccccacgctgcactgcagacctgcgaactcgcgtcactccaaactcagccttccgggcacaagacatcctgcgactccagcctaccgag

SEQ ID NO: 642961 - DNA, 111 bp, Homo sapiens
ggcccggggactgatcaggaaaatatattcctgcataactcattttgaaccaaggattgtagtttagttttcccccttgccttcccttttgtgtgcccgcccccttggcca

SEQ ID NO: 642962 - DNA, 132 bp, Homo sapiens
cctaggctgattccgcctgagatggctcctgttcaggcggggtttatctggcggcgtgaggcctgtgagatcctgacccaagctcaggtacacccaatggtcacctgcactctcatgactcttgtggtctca

SEQ ID NO: 642963 - DNA, 755 bp, Homo sapiens
gacagtgaagctccctctgatgaagatcaactctgacatgagctccctggtagtatctttggcccatggtgccgtcatctatgcgaccaagggcatcactcggtgcctcctgaatgaaacaaccaacaataagaacgagaaggagcttgtgctaaacacagaaggaatcaacctcccagagctattcaagtatgcagaggtcctggatctgcgccggctctaatcccaaagagatccacgcgatagtcacaacacgtatggtgtgatggacgggcggggggtgatctgagaaggaagatgaggagatgggtatgtgtgggactgggatatggactcgaggtcgaccactcgacaatctctcccgtggatggcgtgataatagtgtgctatcgagggtgttaacaagccactgaatcgcttgggatccggtcaaactcttccccgcatacagcagatgacatttgaaaccagcttccagttttctgaagcaagccaccatgctgggatcccacgatgagctgaggtctccttctgcctgcttgtggtcgggaaggtcgtcaggggcggtgacaggcactgttcgagctcaagcagcctctgagatagccagctaccccggaacatctgccaagctccaggacccttggctgagggctgtggcccagcctgactttctgcatgagagggaccaggagactggaatccagggcagttccagtgaacagtacagagcacagagggaactggggcctgaa

SEQ ID NO: 642964 - DNA, 169 bp, Homo sapiens
tcagagcctccaggagagcgtccaccggccgtgccctggcacctgcgagagctcagtgcccggctctgcaccggccatcctcagcaagaacctgataggcttacaacaaaaatattcagtatactatttaacaaactaaattgagtggcagaagcaggggtaccgagct

SEQ ID NO: 642965 - DNA, 165 bp, Homo sapiens
  misc_feature (86)..(87): n is a, c, g, or t
aaaaagggggtttccccccccccccccgggggttcccggggggggggtttccccgttttgtttttttttttttttgggcccccccnnaacaaaccccccctttgggggtcccccgggttttttttttttttttttttaaaaagggggtccttttttttgggccca

SEQ ID NO: 642966 - DNA, 1625 bp, Homo sapiens
  misc_feature (1256)..(1256): n is a, c, g, or t
ctccgtgaatgctcctcttaactcaggtgtactagacccatggactactgttatcgctacctatggtcgcgatggtaaccagatgaggagtccatcgcagggtgctcgtcgagcgaacaacgcattcatgctccacgtaatgggccgtcacgatagcggtgactagatcttgattgtatctgcctcttcaatgtctagctttctgagacaatgcttcttcactggaagaccattatagctcagatccctgacacgtgagcccgccctcaatccctctctgctcggggcatggggtcgaaatgtgacactgccaactacgagcgatccaggccacgttgaacattcggccttaggcaagagtgcgccctgtcacatgatgagcatgcatagccgcgtgattccgtacgtcccattgccgtgcgagtgatacaaactccaagcgctcgtgagcccatcaactccctaaggtcctgagataagccatacacgaatgcgagaactctacatagtcaaattatccaaaggtcagcgtcggacgtgtaaatctaatctaaattaaccattagcgcgagggttgcattcttcattggtttgtgacaccgcacgttcgctaagcaagaagacgcgtacgaaatacgggtggaccttttgctggaggtttacttccaccctttttgaaacgcgaatatacttcgcgggtaaacggaggttctcaattccatcaggccagtgggctttggctagaacctaacctatggtaagaaatgtgtgtgaagattccttaactaggagcactttgtgacccaaaggagagaacgagggcgtctacggagacggtaaccaattttacgtctcttgtggtcttccaacaactttctccaacttcttatcaaccctcatttccttgttcctctctaccaattggccgggcccccgaaaagcggtaaacacctaagttgttctctcgcatcctagtgtccaaaccaaatttcctccaagattatccattttccaaacactagtgggggacaactctttttcccgaaataacgaactctcggaaactcgtgttggcgctgaggcacgtggaacccatggggcgttccactttttggcgggagagccccctcggacacttcgcgaacgggctcgattcctttggcgcacctttatgaattttaaccacccgctggggttaactaaagctcccaaatattcccccaccgtgccgttaaaaattcctaggtgtactttgngcaaggttggggcctaccttactttagggccattattaacacgttacctcccccaagagcccacaaaaaacacacacagtacaaacagctagcgaccagtagcacacgacacaccacaacaccaccgaagatataccccccccccgcaaagacagcggggccccccacataagaagtcatatacagaccggcgctcactccccgccaggcagcctaccgtccacgcatcgccaacaaacgatggaggggggcgtcccgcacataacaagaggcaggacgcatacgcacgaatcaccgtcacatcagacaacggcgcagacgaacgagacaactgggagcagctgcacgacgactgctaccaaacaccgg

SEQ ID NO: 642967 - DNA, 829 bp, Homo sapiens
ccacgcgtcggaagaggaggaagtggcgcccggaaccgagcctgggggtcttggatgcagagaggatggcgtcgtcgagccccgatgccccttgttcctgcgactgttttgtctctgtgcccccggctcagccatcccagctgtaatctttgcaaagaactcagaccggccccgagatgaggtgcaggaggtggtgtttataccagcaggcactcacgtccctgggagccggcttcagtgtacctatatcgaggtggaacaggtggggaagacacacgctgtgattctgagccgcccctcttggctgtggggagctgagatgggggccaacgagcttggtgtctgcattggaaacgaagcagtgtggaccaaagagcctgtggggcagggggaagccctgctgggtatggacctgctcaggctggcttggaacggagcagcactgcccaggaggctgttcacgtgattgcaggcttgctggaccgctatgggcagggaggcagctgccgggaggatcagagccgttctgtatcacaacactttttactgggctgatcggacagaggcgtgcgtgctggagacagtgggagcctgtgggctgtcagcggatccaggaggtgcccggaatatttccaaccagctgagcatgtacaagacattcagtgaacaccggagttccgagccatgccaggtcaggggacatcacaggcagaggtgatgagggatctcaggacaagcagagcggatttgtggcatccgggggttccgcaaagcagtatgtttcgccttgccaagacccaagctggtcattccatgtcccaaacctcgc

SEQ ID NO: 642968 - DNA, 261 bp, Homo sapiens
gtgcaggcgtggcggtgcacgcctgtagtcccagccaatcagtaggcggaggcacgagaatcgctggagagcccaggaggccacggctgcacggagccacgagttgcaccacgtgcactctagacctgagcaacacacgactccactctcaaaaccaaaaaaaaaacaactgggcgaatggcccccattatatccaagttggtgatagaggcattaattattaggtaaaggtcatataaaaattgcgggtgtattgacaaa

SEQ ID NO: 642969 - DNA, 180 bp, Homo sapiens
tggacattgcatatggtcacccagcaagtggtcccagtaactatccctgcaggccctaggtctagactcttaacctcacactgatcatatagtacctagaagacatagagcacaataacaacgtcaatacaattgtacatacaatgcaatgctacttatgttgcttgaattgcttgtaat

SEQ ID NO: 642970 - DNA, 377 bp, Homo sapiens
gaggactaataacgatacagtcagccaaactataatgatagatctagaattaggtgcaatcaaggcttataagagtgaatttcaagtagttaccagtaaagtttgtctttttcattcagcctgatgcctttaacagaaaactcagatgagtggataggtcacgtgagatggcagtgacaaaaacttcagtttaaaatgccttatggatctgtattggcattccttcccgctgatgaaatgctaggagcttttattaaattaaagctgcatttgcatgaagaagccagagaaattacggactggtttgaagataatgacgtgcatggtcggataagaagacatgccctggagttgctgtttgaccatcagtatcgtta

SEQ ID NO: 642971 - DNA, 303 bp, Homo sapiens
actaaggatcccaatgtgttgtgtgtgatgtgtgtgcagtgtgatgtgtggagtgtgcatattgcatgtgtggtagtgtgcgtgtggtcgtgtaaatctgtcaatacatgtgagcttgatgacatgtggcatgtagtgtgatggtgtgtgtgtgtagtgttgacgttgtgtgttgatgtgtgtgctgtgagtgtgcagagaggcctggggctcgaggaggggctacagctcatagtactcacccgggcggcccagttgacgaggtcatccagcttgggcaccacatgcatgcacccagggggt

SEQ ID NO: 642972 - DNA, 258 bp, Homo sapiens
  misc_feature (63)..(63): n is a, c, g, or t
  misc_feature (100)..(100): n is a, c, g, or t
gcggttctccatcagcatctgtctctctaggcagttgagatgtccttacagctccagtcatcnattcaatgaatacacacattcgacttagattctaaanactggcataatacagtgacttttcatattgtgtattttatcttttagtaactttccaaactctgtaaagtcatctcttgaagatgggtacatagcatctattccataaactgcattattaacaccaaaagtttcctttgctaatcaccggtcgacgga

SEQ ID NO: 642973 - DNA, 909 bp, Homo sapiens
gaaacgcaacgcttgagaacttggacgttcatatcgccccagtccgtgcctgggacgataacattcccgtggatgccgatcgctttggccgggcgataatacaggaacatttccaaatggcaacacacacgcgcgtgaggtgagacaagctgctctatgaccagacgaacatacctgtggggtgtgtcttggcatgtattgatctatccatgtgtggggtggactagagtccctgcaacatgatcctgggagagaatcgtgccttggatgcttggtgtacactaaggggtgttgttgtgaacagtcgcgaataataaggacgtcctttcggcaggcgtgacagaagagggctaacccgcagtggagttcgtagaatggtgtgtcatgttggcggagcatatttgtactcttgtatctgccatgtaggagagggagtcaatggtcttatgtgtgttgagggacattaacattttctgcttgtgctgtgagaatgtaatatccaatgcattcggttggaggacttgcggaagctcaatgaacaaaaagttggagaatgtaagactggagggaaataggttgggaaagaggacgccgagtggggcatggtgcctgtgattgcgctagaagcagcagggagaaggcatcagcaggactcactggatatatcaggcacagtgaaggaataaacataaattaaactgagctatggttgaggcagacattgagttgcagttgccttgtacagacctattgcgtgctggcgttttgaaaaaaggcgggacgtccccccaatatttatggcagctggtgtttagggcgatatattaagctggtgtcgaaagaagcttgaaggaagaaaccagcgtctatgggtgaacagggttaaatatggagcgcgcaggttaggga

SEQ ID NO: 642974 - DNA, 374 bp, Homo sapiens
cgggatctctgtcctcaaaaagtatacctgtgcagattttcaatcagagactgtgtgctaaatattaggctactgtgatcttaggccacctgaggcacatactatctgaaacggctatggaagggtagggccactctggactggacacatactaaagcgccaaaagacctttaacattttctgagagccaccgagtatttgccaataaatgagctctcattttttcaccttgactggccatctaacttaaacaattaataagtgtaatttccaagcaggcctggaagactggggtttacctggcccttcattaccatttaaattataggctgtccaaattggtgtgtaacaattacacgagaagctgatccgcg

SEQ ID NO: 642975 - DNA, 273 bp, Homo sapiens
aggatccctttgttcaccgcgtacgacgctcgtctttggtcgcacagcaggtcttgcctgtattttttcaccggccttcgacatgaatcacgacggcaaatgccagcctgccagaaccgattcctgcgcgttgcgtcactcgcgcgaatcgggtcatgacgctggtcgagttgctggtagcgctgttgattttggcgatcggcctgattggcgctgcggtgctgcaactcagcgcgctcaagtacaccaacacgcgatatacgttcgggtacc

SEQ ID NO: 642976 - DNA, 148 bp, Homo sapiens
catggtgggcggaggtgggtctcaaattctggaccccaagtgatcggcccactcggcctcccaaggggcgggcataacgggtgtgagccatggtgccgggcataactaattatttttggagaagacctcatggatagcacaaaagtag

SEQ ID NO: 642977 - DNA, 134 bp, Homo sapiens
ctcttggattcataccattctcctgcctcagcctcttgagtagctgggaccacaggcatgcaccaccacactcaactaatttttgtatgttaatgttagagatacgtatctctaacattacaaatagtttttac

SEQ ID NO: 642978 - DNA, 893 bp, Homo sapiens
taaccatgcaacgaaacctttattaacatttgggaacaggttcagctattactgaaactgttgtaatttctaaactttaagttgtggggcaaagtggcttattaggtgcaaagtaagtgccactcacgtgggcacgtgcgaaagtgccagtgactgtgaagaaattaacgagccacccctctaaggtcgcaggaccaggtgtgcagggtctcagactctctttctcagtgagagtgttgtgtagctcaagaaaagaggtgcgggccattcttctccaagctgtgcatgtgcctgtgcaaaagatgtgagcctctctgtgcagtggctcggggggggagatgtgccttctctttaattcttgtggaaactcgtgtggtcgcttctcaacaactttctcgaagtgggtgttccatgtgtggccttccaacctctccaagaagtgtgaagtgggctcctgtgcgcggctcgaggggactcttctccacagaacagacatctgtgcccattaaccccacaccctctctctcagacaccgtccaggagaaacaccgaggggagtgggcagagaggcctcagacaatctccccttctccgtgggaaaagtgcgtgtgggatagagttctgagaacagacgaagagttgccggctgccccattctttctccgcccagactgtgacttgatggcccctgtggcaccaaacgtattttgaagcgcgctttatgtagccagtgggacttcagctggaaaagggggaaaagatgacacaaatatcactatataattcccctgtggagaacatccgcttggggggccccactctccaacacatgttatctcttccccaagtggcgagtggtctccaaccggtgggagcgccttctccccacagtt

SEQ ID NO: 642979 - DNA, 511 bp, Homo sapiens
  misc_feature (64)..(64): n is a, c, g, or t
gatatttatgaggaaatgagtcctgagtcacatgtctaacaggtggtttggatagctttctaancatttgttcctctgagtttgaaggcagcatcaaggagttggaatttcaggacctgagtgaatagacaggaaaaagaggaggatgtttagccatagggtagaatgtggaagattgggagaaaaaagggggatgatttgaaaattggaaattgtattaaatgaaatgatggtagtgtccttcaaatagcactaaatagtcaacggtatagtttgtcacatcctgcttattgtgacagtaagaatcaggaatcgtaagccattgagatcaactgaatacagatcaggtgagtgccaatccattcaacacgtattatatgggggttggtgccaagagaagtgaccagtacacgaggatccagccctaaaggaacttgtagaccacttaggaggtaagctatgtgcatcagtaactgatacaaggatggaaggactggccacagtgtctgcg

SEQ ID NO: 642980 - DNA, 504 bp, Homo sapiens
tacttttccacaggagggttaagtttttattcatcttcctctcagttaatttatcacttttatctgactaagataactttagatcttctttattcccttggatagatagtatagtgaattgattagggcagggctttgaagccagagagtcctgggttcaaatcctggtgtggactctatctttttggcggttagaacctttaaattctctgactttctaggtgtcgtttaaatgggttaacataacccttactttatggaatgttgcaaagatgagagaggatgtatgtaaaatgttaacctattacagagcttgatatggagtagacgaattctaaaattacattgagccattttgcctatagtggtgttagaatagaaaagtatactcatacattagaattgtgcacctagagctaagtgattccagccctgtggaacccgtcaatgccagaatggcatgtaggactagatagatgaatgtcacctgaccctgtggaaaag

SEQ ID NO: 642981 - DNA, 1099 bp, Homo sapiens
  misc_feature (233)..(233): n is a, c, g, or t
cccggttaaactcggcacgaggccaagatccaggactgcccagcccaactcgggtctgctgcagtgcctcggtcatcaccctctacaccatgttatgtcacctggtcagccctatccagtatccctgaacagaaatgcaacccccatttgccaacccagctgggcaacgacgcacacgttgtgcgcagcgccccgcagggctatgagacccagtggtgggatgccccgagcanttgtgggcctcatcatcttcctcctgtgcaccctcttcatcagtctgcgctcctcagaccaccggcaggtgaacagcctgatgcagaccgaggagtgcccacctatgctagacgccacacagcagcagcacgcagccaggctggcacgcctgctgcaggcgccgggcccctttgcacaacgacgcagcgacgtgcgtcacctacagcctactccttcttccaacttctgcctggctgctggccctcactgcaccgtcatgatgacgctcaccaacctggtaccagccctggtgagaccctggactgatgatctagcacgtgcgccgccgtgtgggtgacgcactctgtgcccgcctggccagggctgctcctctacctgtgccacccttggtagcccccactcctcctgccgcaaccgcgactttccgcctgaggccgccctcacagccctgccatctggtgccttcttgctctcccttgtgtgccatcttcgagcttcgcgctgacttggccaaactttgcctctctctctctccaccgcattcagcgctatgtctctatctcctctaatcacttgactctcactctcagtgtcctggcgcttggagcctgcggctccttcatgccgttaggccaccaaggcgcccccacaagtaacccccactacgggctctccttgcgaactgctcctctactacccccccgctgcacactcctccaaatgtctgctccctcgctcccctttacctgacccctattactccctctgccttactcctatacttctagagtgctcttgggcttaagctgtgcaactcctttgtgcccccccgctcccacgcaaagttggagcgcagcacgactcc

SEQ ID NO: 642982 - DNA, 1083 bp, Homo sapiens
gggattcttttatttttaggaattccaaacagagttaacctaaactgtcatgccaaaagatcagtcttaaactttcttagcacctgtacctggtttaatgtgatcagctaatccagtgaggaaacaacaaacaaaaaaaaaaaagaaaaaaaaaatttgtgtgcggggcggcttgggcctcaaggaaaaggtttcttaaacccaatcgtttggggcggccggggccccaattgcgttaggggaaccttgggctaacggctggtccccaaaggaaaaacctgggtccagggactcagttggctgggttcccccccccaataaaaaaaaggcgccgggcggcaacccggagctggtttttggatccccaatccccagaatggaggtcttcgaggaggagcacacaaacgcgggactatcaccaagcaggcgggtccccaagggcgacgtcccagaatctacaaatttactgcccccgcgctgggagaataacaaacaacgtaagcagactagcagtacgcagactacatcaagcaaacagaggcacgaacagagtgacaaccagccagcaccagcaaccgacagcacgacaacacgcagagacaagcacacacaacagcgagacagcagcacagcatccgacaacagacacagtaacaacaacaggccgacgaccagacacgccaaactcgcaagtcgacagaaatcacagcagacgagacccgtcacggaaacgtgacgcacgtacacgacatccacagcgggcagaccagaggaaccgatgcccacacacaggccagccgagagtcagctacaggatggagacgcgctgggcacgcatcacatgagacgcatcgaagcaccgcagtcgacaccgcacagacacagacgccgcgcacacgcaacagcccagagacagagagccgccggacgtaggcgccatgccggcactgacagagccaaggatacacgagcaacagtagacggaagccgaccgcagcagcacgccacaggacgacggcgattggatgccgcaaacagagagcgacccgaccacgcgataggcgtacctgaataacgtgtgtg

SEQ ID NO: 642983 - DNA, 106 bp, Homo sapiens
tcgtaccgatttcaaaaccgacctgaggtttcagagcgcagccattggtgcgctgcagtgagtgctagcgaagctgtacctggtgggtcttgttcgaatataccaa

SEQ ID NO: 642984 - DNA, 227 bp, Homo sapiens
tgacacccattcgagaacaccagattaaaagacctccagcaatccatgattctagtatactcatctctgactggcggtatgtaagatggtgatttggattacaagaagacagacaacaatgtgcatttattaaggaacaacattctggaatactcacgacgtagtaatctatgcacacttaaaccctaaggccaagaggacacaggggcaacccacacagggaaaag

SEQ ID NO: 642985 - DNA, 981 bp, Homo sapiens
agcgggctccgaggggtttccctcggaccccgctgctaaaccccggccagcggtgagcgtctaaggctagccttgtaccccaccgagcacgtcggccatgggggagggcttattccgctgaggcggtgcggcccagcgtggctggaacggtgtgggtgtccacgatctagagcggagtactggatgccggagcatggcgtggggctgagagagcaaggagaaagagggaggactagaacgcgggcctggggaagctatcaactttcccccacggagcgggtcaccgagtagtacaggaaagcataccgaagggaacggtgccagagacagctggataacagcgagacgacctgatgcggacgtcaaaacaccggcattccacgtggaggtaaagaggaggaagacgacggcagagaagacatctcattcacacatataatataacacccaggagggaaaagcacgacgagatcggaaagacgagaaaccacaccggagaccgaataagatcgacagaaaggagccacggcacccgagaccagcaggcaagcccccagtgagcacacctaatacaagtcgacaacagggggcgagagaaggattacacagcgagatggtgtgacgagaggtggccgacaaacaagagacgaagacggacgagcaaaacacacaggaccacgtgaagaaggaaagatcgagaacccaatatggaagatactgcaggaacaagtacacgagcgaagacaggagacacgaacagagacgacaccagagacacacgccgcgaatgaaaataaagaaggggagaagaccgagcgaaacgacgaagaatacatgcaccatagagaacgagacgaagagagaaaaacacgaaagaagcaagcaaaaacggaaccaacgacaagacaaacacatgaaagaagaaaaaaaacatcaaaaaacagagaggacacaacacagagagagaaggaggggacaaac

SEQ ID NO: 642986 - DNA, 175 bp, Homo sapiens
  misc_feature (78)..(78): n is a, c, g, or t
tagaggcccaatagatggcgtgtcttcgcgcttagtactcgtgtgaagttggcggggacggttcctgtcatcttcttngggcgtattgtgaggtgtgcgtggttgcaacgcggcgcggagactttagagacaatggcagggaacctcttatccggggcaggttacggcgcctgtg

SEQ ID NO: 642987 - DNA, 271 bp, Homo sapiens
gaaaatgacatagaggcaggtttcaccgtgttaccaggatggtctcaatctcctgaccttctgatccgcccgcctcggcctcccaaagtgctgggattacaggcgtgagccaccggcacccggcccatcagtcactttttcttttctctttttttttttttctttcttttggagagggagtctccttcggtggcccaggttggaaatggcgggggtgctatctcgggctcactggcaaggcttcaccttctggggatttcaaggcatattc

SEQ ID NO: 642988 - DNA, 827 bp, Homo sapiens
atttttatgtagtgaaaatattgcaagttagtcccaaatctgttttcatatagctttatgatttcctagaaaattgagattgtgagatttccctcctaggaatatattttcgtgtctcattcaaactactccacttgcaacaactaccagcagttgagagttactgttcacatgggagatgtcactgatggatgtctgttgcacaaatgaacagtatagaaggattaaaatgattgaaaaccactgctttagaattttgaaagcatgaaaacacaccagtctttgcaggcttttcattcactctcagcctacatcctacaaatcctgttgaccccacctttaaaatacatctagaatcctaccacgttaagccagctgaatcattggcgttatttgatttcaattatttgattatcagttactgcagatgagaaatgacaaattgtaatttggtcagctgtccatttaccactctagggcatcataggaaaacagtgcctttgtgtggttacttaattcttccaaagactaatcctgttttataggactagaaactcattgtcataaacccacagtggaaaaatcttaggaatactgattcaccataacaaaactttagaggagactaatgaagttcagaatccatctgataaatgatctagaatatattcacataggtgctcagtgtctcatttcaactgaaggaagtccacaggcttgtagttagtaaacttaatagtcaagtaatacattacaattaccataggatgaatgatctgacgtaatggcctaattgggatagagtcaagcagactattttatctaaa

SEQ ID NO: 642989 - DNA, 583 bp, Homo sapiens
ccagttaaacccttttttaagggcatccagggagggggccagggatggaggggaggggttgaggaccaaaaggcagttatttttgggggggattaaccatttttcccatgaaaaggggaaacttggaatttgggtaaatcattaaaaaaacaaagggtttgttgaacttgacctcgggggggataaacatgggtatggcctttaaaaacatggccccagcagtttaagtccctttttggtcaatggtcagcaaagccttatgcacggccttggaaagcttaaggggggcctcctttgggaccccggaaaggtcagccccattgttgaaaaccttagggatgcccagttgacccaggacgcttttaaaatcataggttccaagaatggacagtttgggaaaatgaaactggaagacctgtcgggcaaaaaagaaatttaaggcttgggaacaaattcccttttgttctttttggacccaccaaagtgcaagtgttttctttttttgtttggtgttcctgggccaaatttctgaacccggggaatccgccgggtttaaacgccccaacccggtggaattccattt

SEQ ID NO: 642990 - DNA, 886 bp, Homo sapiens
taatgatgaaaaaatatgacaaaatgtcaaaaaaaaagcgctaaaaatgttgtacaaccccataagaaatccatatggtgttggcctggatagaactgtctctggattctgggtgttccttctcagagggagtgtctactatattattatatcaaccatctgggttggcttgacgaatgatggaaagggtaacaaatattctgaatttctgctagccaaggccactgagatatatgaagaagcttcgtggaaatattatagcctgaggaccagtggcatctgtcaccacttaaaccttcgtagttgaagggctatcattttaagcgatcgaggttgttctgagtggagttcagaatggaaagcacgggtataccagtcacatttgtccatggatagagatggatttgagatagcaggggagatgagtacgcatcgaacagcagtcagtcaatcatagattccatagccaccctaggaggaatcctcatattgaaccttgctcctggtacgtaactgactagattcgaattgaaactgttattcattcgagctgaggactagttgtcactaattgggttggctttacatatataaaccgcacaataaaacgtctagtggtttccaattcgaaaatgtgtatttgtaagataatgttgccttccttccacttagagtcaaaatttagttatgaggccaccgagagacaaacatgtggaggcacacctgggggggggaaaatttttaaaaaaaaggggccccccgaaaaataaaaatttgaactagggcctatttgtgcgaaagaggattgcgtttaaacaaggcgagagaaaaaatccgagggaaaatggcttgggaacaaaatttgggggaggaaaggcaaggctgc

SEQ ID NO: 642991 - DNA, 122 bp, Homo sapiens
ccggtccttatactgcctgtacagcatgtacttttaaagcctataactcttcttactattcccccattttacctgtccaacaaacagacaaggcttacacggttagtccacgaattgccccg

SEQ ID NO: 642992 - DNA, 366 bp, Homo sapiens
tcttagtaactatgatactgtgcagcaaatgagagtctgtgactgtctttcatgtttcacagccattagcgtcaatcactgataccagacactctaagtcccataaatcaaaatgcaacctcgaataaagggtgttcagagttgactttgtcctgatggaaaatgaatatccttgtagcctctatatagttaacttccaaatgtaggacaactatgtggtaacacgtttcgtgtctattcctatcaagatgagcctttaagagagggacttctattaagctcttgagctaaggaagaatacacttgattcagagtctcggagtgctcttaatcagaactatatgtattgtctcaatattaaataaa

SEQ ID NO: 642993 - DNA, 187 bp, Homo sapiens
  misc_feature (17)..(17): n is a, c, g, or t
  misc_feature (156)..(157): n is a, c, g, or t
tttcaccatatgcagtnactcctgacctcaagtgatccacctgcctcggcgtcccaaactgctaggattacaggtgtgagccaccgctcctggccttaaattttttttaaaaaaattttatttttttatagagatgaggtctcacgtgtgttgccnncaggctggtctcaatactccgtgggctcaa

SEQ ID NO: 642994 - DNA, 245 bp, Homo sapiens
gcagagtgaggctcagttgccataagaccacccccttctgcccgctaatcacaagtctgggcctttggaacttctgaccaaatggtttcaaactggggttcccacaaccccctctttgggctcaattactctgctagagcagctcacagaactcagggaaacacttatgtctattggtttgttatgaaagatattttaaaggatgcagataaacagcctgggtgacaaagcgagactctgtctca

SEQ ID NO: 642995 - DNA, 184 bp, Homo sapiens
attcttttctttccagaacatcaaagctgagaatattacattagattagcagtctctgtagatcctcagtacccgcatcgcattctaatctaatctaatatactatagttgccagttccaaaagcaaatctactgtagtgaatgggaaagtccaaacccttattcccttcagaggagccaagtt

SEQ ID NO: 642996 - DNA, 150 bp, Homo sapiens
ggaaagatataagtcaagtggtgagagggaattccaggaatgtatgagggtatacaacaagtaatcttactataactaagatcaaaagattgtggtggcgataacggtcctgacattaaagagtcaagtcagattaagacgggatattgt

SEQ ID NO: 642997 - DNA, 259 bp, Homo sapiens
  misc_feature (71)..(72): n is a, c, g, or t
aagtgttgtcgagcattaaaagaaatacaggcgctaaaacagagctagtcaatagaacattgcttgagagnnggaaatttttttttaatctgtaatgtccaataaggcagccattagctacatgcagctatttggatttgatacatggctagtgtgaaggagggactaaatttttaaaattatttttgagagagtcctgctctgttgcccatgctggaatgcagtggcactatcatagttcactgtaaccttgaactgc

SEQ ID NO: 642998 - DNA, 229 bp, Homo sapiens
tatgcgcacacatgtgtgtatatatgtcgtgtttagttgacgtcgtgtgtatgtgtgcgtgtgtgtgaattgtgtgtgtgtatgtgtggactgtgcgtgtgttcatgttcggactgtgtgtgtgtatgtaagtgtgtgtgcgtgtgtgtgactgtgtgtgcctgtgtggactgctgtgtgtgcgtggactgtgtggtgtgggtgtgtgcgtgtgtgtgaactgtgcatg

SEQ ID NO: 642999 - DNA, 589 bp, Homo sapiens
  misc_feature (589)..(589): n is a, c, g, or t
gcttcagctccgtggtcactcaggacggagagctggtgcttggggctcctggcggctattatttcttaggtctcctggcccaggctccagttgcggatattttctcgagttaccgcccaggcatccttttgtggcacgtgtcctcccagagcctctccatttgactccagcaacccagaagtacttcgacggctactgggggtactcggatggtcgtggggcgaagttccgaagggggattttcaacaataaacgaagaaatagtgtcgtcgtgtgccccacacttggagctggaccctgggagcggtggaaattttggattcctactaccagaggctgcatcggctgcgcggagagcagatggcgtcgtatattgggcattcagtggctgtcactgacgtcaacggggatgggaggcatgatctgctggtgggcgctccactgtatatggagagccgggcagaccgaaaactggccgaagtggggcgtgtgtatatgttcctgcagacgcgaggccccacgcgctgggtgcccccagcctcctgctgactggcacacagctctatgggcgattcggctctgccatcgn

SEQ ID NO: 643000 - DNA, 371 bp, Homo sapiens
  misc_feature (20)..(20): n is a, c, g, or t
  misc_feature (185)..(185): n is a, c, g, or t
aagccccttcctccacaganttgtgatcatttcccttttttcccctcctttcacaccgaggttcctgttttcctgtgcctccgaggcccccaggtggaagtgccttgttgcctttgccctttgaagtcggaacaattcctagcacctgtgggaaggtcaaggccaaaggcaaattcaaggccagnttgtgacaaacccagggttgaggcctgccccatgaaaaggttgagccccctgaaacccctgccccttgttggtacattccagaggggcaggggcctgggggatatgaagttagggaagcccctgttttgattcccccctgcccttgtcttggatccaacaccaaataaaaagaaacaagtgaagta

SEQ ID NO: 643001 - DNA, 236 bp, Homo sapiens
aaccccgggggcggtcccccccccgggtttttttcttgggccgggggggggtttccttttttccccggggaccccttttcccctttggccctttttggggccccttttaccccagtttgttcctaaaacccgggggggtccgggcccggttttcccgggtttttttgacccccggggccggccccggggcccggttaaaaaaaaattaaaaacacaaaggaccaaccaagggtaca

SEQ ID NO: 643002 - DNA, 284 bp, Homo sapiens
tcgcagtgatagttgactttggatacaaggtttggcaaaaaaaaaaaatattaacaaaatattctgtaagaatcaattggctatatggaatttaggataaagaatatttacaataaagaatatttacaataaagagtttattattatttgtaagttgtgagcaacaaacataccctttatctctgtaaaatttatacacacaaaaattaacaaaagattctgtaagaattaattggctatatggaatttaggatagaatatttacaataaagagtatttacaat

SEQ ID NO: 643003 - DNA, 128 bp, Homo sapiens
gatggccgggaactcgatcctgcctggctgctgtctctattcttctcggcctgtcagcaaagttattttgctttcaagttggaaaggcaagattaaaatacaaagttacgcccccgcagtcacttggt

SEQ ID NO: 643004 - DNA, 125 bp, Homo sapiens
gtctgatggtgatctagaggatcccagcgggaacattcactttgactggggaggtggaggtagcagtaagccgaagatcgtgccatatgcgctccagcctgggagacagagccagactctgactc

SEQ ID NO: 643005 - DNA, 750 bp, Homo sapiens
  misc_feature (151)..(151): n is a, c, g, or t
  misc_feature (620)..(620): n is a, c, g, or t
agcaacactttccccgggaggttgctgcacctccctgctcctcactttcctcatttgtggaataggaatagggtcattgtgagaattaaataagttaatatttgtaaagggtttaacagtgactagctcataatccgtcacgtagaaagtnttttcttagctcatttaataagtacctttctaacccatcactgatagcatttttcttttgcaccagacttctttctagtcattgctgggagcgtcctctcattttcctgcctccctgtagctgtcactctcactcctaaactgttggcgttctcattttggcttgcccaaatcttacgcattcttttaagtccatgttcaagtgaatcctcactgattttgttcttcattcatccccttaacagacttttatggagggtctactgtgtgcaaggtgtattatgtaggaagccttccacagttcccagagctaggtgagctctgtcatgtaggcctgtcttgtacatatcaccttcgacattgctgagcagtttgtgttggacatgtttgatctcctcccctagaatataaacagctggagagtaggatgcttattagtaggtgcttattaagctttctttaaaatgagnaagtgcacatgctaccttttatagatctgttaccttctaatgaaggcaagaacaataggaacaaacattagttttgtgtgtgtgtgtgagagagagagagacagagagtgagagagagatagagagagat

SEQ ID NO: 643006 - DNA, 363 bp, Homo sapiens
tctaacagtgtcgaatttctaggattagaggaagaggtcctccagtccagccctcctctgaatagccatggttctaggctgccggcctctgaactgtactatgtatagcagcttgtgaatagcgtgtgggtatatgctgcccctgaagacaccgtgtaaccacgttgtccattggacggctcgcagtgagctatagccagcttcataagaccctcatgggagccctccgtgttggcatccatgcctgtccaggcaacgagtgctatgtctacaaggaaccgtacataagacaaagttacatcacatggctttggcagagagcaaaggttgatagtgtcatctccatgtggctctccagcacgt

SEQ ID NO: 643007 - DNA, 575 bp, Homo sapiens
agagcgggtgagaaggcaatgcgcagcaaagtctctctgtaccaccctgtgccaggtcgctgcgctacatgtcctgaacgggcaaaacacggcgaatgtaccgcacgtacctggacacggtgaaattgctgatgaggttgcatgaactattatcctccatgaatggatcgaagcgactcctcaggggcagcgaactggagcttcagttcacaagcttcccatgcgcacatcatggttgacttcgtgcttagatagttggcatggagagcgatgctagtgatgcacatgatgatcagcatggttcagagactgttgggtggtatgccacacatgatgcgaacagtacagattgcggcagtgagcaaaactgatagcaaaagtaatataaaagtaccatgagaaccacatgaatgacttggagggcgagaaaataggtactagatttgcgtcctgatggacatcgagcaggtctctggactcacaatcgagggatctgccaccgagatctgtcgcgtgcgcaagtcttgaacatctaggccattgcaaagtttcccgttcccatgcctcaacagact

SEQ ID NO: 643008 - DNA, 762 bp, Homo sapiens
cggggcatccagcaagtaccgggcgctcacgggttgcctgagttcacccagcagatgttcgagttccaatgaacattgagtggcgcgcgttgcgaccccggcgtccacgcctctgttactcatctatcgcgtgcactgtcacatcgtgtgcctggggaccggcattggtccatggaacggagcgtgagacgagcagagtgcgtcaacgtgctagatacataccgaacaggcatgcgtactctcggtggaggctgggatgccgctcacacctaactgtgatacgaccggcgccctgtctgtagagcactcaccagctcctcggctggcctgagagactgtcgggccactcgttcattctggcagacacgcaacaggcctactccaaggaagctgttcaagcgcatcctccgagcagctcacggcacatgttccaggcgcaaggccttcaagtcactaggcacacggcggcgacgggcgataggacagagatggagttcaccgaggccgagagcaacatgaacgacttggtgtccgagtaccagcagtaccaggacgccacggcacgacgaatcaaggggagttgcgaggaggaggagggcgaggacgaggcgttaaaaacttctcgagatcagatcgtgcatccgttagtgaacttctagttgtcgctcaagcatcggtctttctacttgtaaactatggtgctcagttttgcctctgttagaaacttcacactgttgatgtaataccccggaggtcctctaa

SEQ ID NO: 643009 - DNA, 112 bp, Homo sapiens
  misc_feature (5)..(5): n is a, c, g, or t
gaggntctactacgcgctttgacgctgtttgtcatgaccgaaagagatatgcgatgcgtatactgagctgaatgatcccatgcgggacggtacgctttttgaatgaacaggc

SEQ ID NO: 643010 - DNA, 307 bp, Homo sapiens
cactcacacatccccctaaccctgtccctggtcccactccaccgcagcaaaggcatgatccagctgctcctcctgactctctgtaactttagacccagagtgggacacctgtcccccagcctgtcctccgttggtctgggcacggatgttggccagggtgcccaccttgcctgtgtccatgccctggtggctgtagaccttgtagcggatcatgaggatgatgatgaagacgagcacggaggctacgatgatgccaccgataatgatgatcatggtgccgcccaggaactggctgtggagtcgacgc

SEQ ID NO: 643011 - DNA, 738 bp, Homo sapiens
  misc_feature (237)..(237): n is a, c, g, or t
agcggccttgagacgcggcggctgacagtacaacccgcctgagctgtcctcccgctctcctccccgatgaaaggattttagatttcacatgaacggaaggaatgcaatggacaaactcccagcgttcccactgtccactccatcatcggcccttttcctgtgcggccgttgctcggcgcagtgagccatagaagagcagagcgagccaggatgcttccaaatcagcattcgtcaatnagctttgctagagcaaggtgcacaaaggagcgtcggaacgagcgatgtcttgctcatgagcagcaaagtgcaatgatttcgcatagcattatgcgctcatagccgaggaccaagagccccgtgtctatggcaacagtcagcacattgcacccacagcattattatcctcttccgcgaataggtgcgtcagcaccatcgagaagccacagttccccagggggatccccacagtgtccattccccaagcagggcgctcactttcagagctcctctctttctcctcctgtctgcgtcctggagatagttcgtcccatgagaagtccgaagaggcagggacaccacttccgttggcccttgttccccagtctgtgatgtactgtttagccggacacggaacagctgggcgaggaagaattgttgcgaactgaaagcgacttgcttggccagagtgtaacacaggcgacgtcctccatggaggaaataaacggctttgcgaaaccc

SEQ ID NO: 643012 - DNA, 255 bp, Homo sapiens
  misc_feature (251)..(251): n is a, c, g, or t
catgaatagaaatacttctttattcatgtttgcaatcgacttgagaattattttgaaatttgattttgggtttgtgagagataataagattgaagaacttcatcatttcagtgactttgcctccaactctctggaatctggctacctcttgattgatatgtcccttagcagtacttttgccagttaaggttgcgttaccctcctcattagctaaacctctttatcttgtgcctcaaaagagcttttacttntctt

SEQ ID NO: 643013 - DNA, 239 bp, Homo sapiens
  misc_feature (9)..(9): n is a, c, g, or t
  misc_feature (15)..(15): n is a, c, g, or t
  misc_feature (39)..(39): n is a, c, g, or t
  misc_feature (112)..(112): n is a, c, g, or t
  misc_feature (154)..(154): n is a, c, g, or t
  misc_feature (161)..(161): n is a, c, g, or t
  misc_feature (233)..(233): n is a, c, g, or t
gaattcggnacgagnagtgtggaaggattgcttgacgtnagaagtttgagatcagcctgggtaatacagtaagactctaactccacaaaaaattttaaaaaattagctgggnatgctagtgtgtaccagtagtcctagctactcaggaggctgnggcaggnggatcgcttgagcccgggatagtcacgattacagtgagctatgattggaccactgcactccagcctggacancagcat

SEQ ID NO: 643014 - DNA, 134 bp, Homo sapiens
tcacgcccattccacaaggcggaggaatggagtggcatccctgggggagttaagacacacgaggtttgcagtttcattttgtttcagaatcagtttggccattaaaatgggactgggttgtggacattgcgtga

SEQ ID NO: 643015 - DNA, 368 bp, Homo sapiens
cccaatgttttgatatgagttcgaggactaaacttgtaatctgttgaaaacatattttgagatttaagttattgatgcatttgtttattgtgagtaaaaagaaaacagtaaaaaatcatactcacatttccttgtttacatttgggagatcgtttatcatttctttttaatttgactgtttaagtatattagagacaaggtctcgccatgttgcccaggctggtctctaacccctggcctcaagcaatcctcccacctcagccttctaaatttctgagattacaggcatgagccaccatgcccagtctgtcttttttttttttttttttaaagacagaaagaactttgtaacacaccattttctccaa

SEQ ID NO: 643016 - DNA, 857 bp, Homo sapiens
ggctgaaggccgactgtgattccccctacccccacaaggggattttgacccctctgagggctgctctagaggattcaggccccgaagctgtcccaggtaggtccccgctgcttcccaccagccaagctgtgcctcatggagtcgatgtctagcaggcctggcgaggcggcgctgcaccgaggagaccggcgtgccacgactggttactcctcttccggacctggacggaatgtacaaagctggtagcgagtcgtcgtggatttgtcctggcgacctggggtgtgaacgagttgccttgcagttccctgaccagggtattgggagatgctgtggctagtggctgcatcgactggaggagacgaccggtcaagagtatgttcattctgggtgacaacagcactacggcagctgctgcgtggatgtgctgggtgctgaggcacgtctggagctcaggctctcgatcattttggtccctgcctggttaatgccctctcagccctgctccgactgtccgttggcttcgtgcttcgttcacgttctgtggccttgggagctctgtgtcatggcctttggggcccagcatacccatgatcccaaagtcgcctgtggtgctgcttgagtcgagcccgcgtctgtgcccaatgtcctggagaggctttagggctactcttcctgtagcccaacgggtaccctgggaagcctgcgtaagttctaccaagggccgagtataatcccaaagcaaatgtggttcccctgaagttccagaagccttattggcccctaaaaagggttggggggccgcgttccccctttgccccaaggagaggggtctaaaaaacattttggggggcgtctac

SEQ ID NO: 643017 - DNA, 207 bp, Homo sapiens
  misc_feature (9)..(9): n is a, c, g, or t
ctcgcactncacctccagcaccacctccagcacactccacactacacctccagcactacctccaccactaccacctccagcaccacctccaccactaccacctccagcaccacctccaccaccacctccaccaccaccacctccagcaccaccaggtcctttgagttttaagctgtggctcgtagttgttctggctgagcagtgggt

SEQ ID NO: 643018 - DNA, 345 bp, Homo sapiens
gctgctacttcgcagcgctccagtcatgctcttcatccgatctgccgctgacggtcggctccgtgtccccaactgtgcctccggaccagcccgaaggagtagacacatctttgtggcctgtgaagggagcccattattgccagtccactttgatgcttctgtggaggactctaccttcggtcagagctgtgagatatctcacctccctcaacctcatcctctccacagctgcctcttccctcttccttccctgctgtgaaagaagtaactacagttagggctcctattcaacacacacatgcttccctttctggtggccaccagaaagggcagaaggaccaggtc

SEQ ID NO: 643019 - DNA, 885 bp, Homo sapiens
ggcaagccccaagccttggcagcttccacatggtgttgagcctgcaggtgcacagaagtcaagaattgagatttgggaacctttgcctagatttaggaagacgtatggaagtacctggatgcccagtcaaaagtttgctgcaggggtggggccctcatggagaaactctgctagggcagtgtggaagggaaatgtggggttggagcccccacacagagttcctactgggacactgcctagtggagctgtgagaagagggccaccatcctccagaccccagaatagcagatgcaccaacagcttgcaccatgtacctggaaaaggctgtagacactcaacaccagcttgtgaaagtagctgggagggaggctgtaccctgcaaagccacaggcatggagctgcccaagaccatgggaacctacctcttgcatcactgtgacctcgatgtgagacctggagtcaaaggagatcattctggaactttaaaatttgactgcccattggatttcagacttgcatgagccctgtattgttttggccaatttctcccgtttggaatggctgtatttacccaatatctgtacccccattgtgtctaggcagtaactaccttgcttttgattttacaggatcataggtggaagggacttgtcttgcctcagatgagacttcggactgtgggttaatgggttaatgatgaaatgagttaagaactttggggggactgttggaaatgcctgattggtttcgaaatgtgagaacatgagatctatagggccaggggctgaatgactatggtaggctgttcacttaccaaacctcattgattgtatctcccattattccacgtgttgtgggagaacccaggggaggtattgactctgg

SEQ ID NO: 643020 - DNA, 421 bp, Homo sapiens
ctccatgggtgaggatacagatgtgtacaccaggcgggtagttttaaattttttggtaaaggacaggtctcacaaggtggcccaggctgggtctcaaattccgggtcttaagtgatcctcccacctcagcctcccaaaacgggatcaaggtttttatttttttgggagacaggctctttctctgtggcccaggcgggagtgcaggggctggatctcggttcactacaacctctgtctccccagctcaaatgatcctcccacctcagctttccaagcagctgggactacaggcacaggtcaccactcctcgttgatcttttcaaaaaatttaaatagagatgaggtctgtttggcccaggcgggtctggaactcctgagataaagcaatctgcccaggctgaggcaggaggatcatcggagg

SEQ ID NO: 643021 - DNA, 249 bp, Homo sapiens
atacgtcacttcagatatatcctttacagagtgctactctatcagatatgaagtgttctctacccatgtccagaactaaagactccagatagaaccagctgctgatggtctcgggaggggatatgcaaggctgtgcattcagccttcacaaagctcatttacactatgcacttccacagcctcttcccttgtgtcccttctgtcctagcacattgtttacggttgagcccgcatcctgtggaatccttt

SEQ ID NO: 643022 - DNA, 790 bp, Homo sapiens
gccaggcccgggatcgccgagcccgagctcgggcgccccgccggtcacctccgcagctggacaccagccctgcatagcccaggtagatggaagacttcggcccgaggggcgtgctccccaggcccctcccggtcctggtcctggttcccgtcagcatcatcaggggctgagagatgaggattttgagaacgaggctggagacttagagctcaggaatgagcaaaacagccaggttccatgagcctggacgcaggtgaagcaggcgcggcagtccagcctcatggccctcctgctatcacgtggcctcgttgcagtttgaggccaggaccccgtggttctccgggtgccggtccctcccaacgtcggctttgaacttgaccgtcctagggcttgacctcatctccgatggatgtccagtgcggcgcgttctgttgcgcgagtaggtggtgcacaagccctgcaggtcgccgtgtggccgtgcatgcttggaggacttcctgttccaagcggctcattgggcgttgactgccctggggacgcaagtgagctggcccagctggaggcttgtggtttgggctgggaccgacgccatggtaccgaggcccggggagcggcacgtgcgcggagcggtgctcatgcacctggaggagatgcaacataccatctctaccgacgaagacaagagtgctgccggtggtcgacgccattggctgtccctgcgccaccttggggtgcggaccaagagtggagacccagaagtcgggggaaggaattcttccggaaaaaaggg

SEQ ID NO: 643023 - DNA, 309 bp, Homo sapiens
tagggcaccagcagagccacgtacgtacgtagctggactggcgccttgagggatgcacttacccttgccctcccgagtgggtttctaggtactcacctgagggctgcacctttctgggccctacttactctgtaaactacatgggacgagagtagtgagcattctcggactcatccagaagtacactgagggtttgaggtacgaactgtccttataaatgtgatggggcctcttctactttggaggagatgcctgtgagtcaaaagcccctgccaggtggctgttctgtctctgtgtctgtgccgaggg

SEQ ID NO: 643024 - DNA, 524 bp, Homo sapiens
  misc_feature (5)..(5): n is a, c, g, or t
  misc_feature (85)..(85): n is a, c, g, or t
  misc_feature (113)..(113): n is a, c, g, or t
acaancatactgcacctgttatccagtgtgacagcagattaccaaaaaaggagtctgatgaagtgccataaacatacttggaaangtcacatggatttaaggaaagaaagaangaaagaaagaacattgtttggggtttgttgctgttgttggtttgcccttctggcgcttcttttcttgcccagtgtgccgctgggtcctttggtactggctgtgcttaaatacaaaccaatcaagccccgggcggacaaatgccctgctcttggtgctcatcactgtaatttttttcctgactttgctctcaggagcgtgagtatgtaaatatctgataatgaatagtttagtcactgtcaagaaaattaatttacattgtataactgaagactcttttcagggttaggtgatttgcattgatgtatatatagtaaaattgctgtaaaattttaaaccgattttcttaacttgatgttctttttaaactttctgtaagatacatgcaaatgataaacgttcagtcacactaa

SEQ ID NO: 643025 - DNA, 365 bp, Homo sapiens
ggcctgctcgccgtctacaccatgctgacgatagacttgctgtacgatgcgcggctgttgaacaggctgcagctctatgatcaggtgctatattttggaatggaccgccttatcattactaatcatctggaaggacttactggacatcactaggacatgaatgtaccattgtcttgttagcatcagtggcacgatggagcctacgttgcatagatgcgatctggtctttctaactcgagtgctaagatcccatactagagggaatgtgtattcatgaatggcatcctgggcatatcaagttattgaccacttgagattatactgcggcagatgaccgatgcctctataatcaaggaccattggct

SEQ ID NO: 643026 - DNA, 504 bp, Homo sapiens
  misc_feature (22)..(22): n is a, c, g, or t
  misc_feature (31)..(31): n is a, c, g, or t
  misc_feature (37)..(37): n is a, c, g, or t
  misc_feature (40)..(40): n is a, c, g, or t
  misc_feature (44)..(44): n is a, c, g, or t
  misc_feature (46)..(46): n is a, c, g, or t
  misc_feature (94)..(94): n is a, c, g, or t
  misc_feature (98)..(98): n is a, c, g, or t
  misc_feature (122)..(122): n is a, c, g, or t
  misc_feature (125)..(125): n is a, c, g, or t
  misc_feature (148)..(148): n is a, c, g, or t
  misc_feature (151)..(151): n is a, c, g, or t
  misc_feature (167)..(168): n is a, c, g, or t
  misc_feature (173)..(173): n is a, c, g, or t
  misc_feature (175)..(175): n is a, c, g, or t
  misc_feature (192)..(192): n is a, c, g, or t
  misc_feature (200)..(200): n is a, c, g, or t
  misc_feature (208)..(208): n is a, c, g, or t
  misc_feature (228)..(228): n is a, c, g, or t
  misc_feature (232)..(232): n is a, c, g, or t
  misc_feature (238)..(238): n is a, c, g, or t
  misc_feature (240)..(240): n is a, c, g, or t
  misc_feature (256)..(256): n is a, c, g, or t
  misc_feature (266)..(266): n is a, c, g, or t
  misc_feature (285)..(285): n is a, c, g, or t
  misc_feature (287)..(287): n is a, c, g, or t
  misc_feature (290)..(290): n is a, c, g, or t
  misc_feature (305)..(305): n is a, c, g, or t
  misc_feature (312)..(312): n is a, c, g, or t
  misc_feature (320)..(320): n is a, c, g, or t
  misc_feature (324)..(324): n is a, c, g, or t
  misc_feature (341)..(341): n is a, c, g, or t
  misc_feature (355)..(355): n is a, c, g, or t
  misc_feature (405)..(405): n is a, c, g, or t
  misc_feature (448)..(448): n is a, c, g, or t
tggattcattttgaaatttaanaattctaanagtaanaanaaananagtttatgctttttttttaatgaaaacaaacaagtaattttgtaaaantcanaaaacaccagtttccttctgatcncancctggatttttctgtcagctggnggntgcatttctgaccccnncccananacgtgaaagcagaaganatgatgcntctttaanaatgaaagcccaatctaaanagtnttatcncnccgtgaacagcttctncctgacccanagcaaatattaagagaaananaanatatttacaaacaanatttaanaatgcccncaanaatagagtttgcccccnaatggaaaattacncattattttgtttcaaaaagttataaatttagtgcttgaaaaatccagcnggtaagtggaaggactaacagggtctgtttctggaactgtccnccagccaatgagcctgccctgtcctggaagccatttttctttttcttttttttttc

SEQ ID NO: 643027 - DNA, 222 bp, Homo sapiens
gccggtctcagactcacagctggccttgctggtctgactcatctcccacccctctctaatctctgaaacttcccatggccccatgggatggcgatttcccctcccgtatcccatggaccatggacctggaggctggtatgtgtcctccttgcttccctcactgctgtaccctggcactgttcttcccacttacatcatgcttcatgtaccaacactctactt

SEQ ID NO: 643028 - DNA, 179 bp, Homo sapiens
ggtgttgtttctgtcctgcattagttgctgggagtagtggcttcaaattccaaccatgtccctgcaaaggacatcatctcattacattttatggcttcatagtgttccatggtgtatgtgtaccacattttctttatccagtatatcattgatgggcatgtagattgattacatgacgt

SEQ ID NO: 643029 - DNA, 642 bp, Homo sapiens
  misc_feature (380)..(380): n is a, c, g, or t
ttgctcttcgcaataaatcttgctgctgctcactctttgggtttacactacctttatgagctgtaacactcaccgcgaaggtctgcagcttcactccaagccagcgagaccaggaacgcaccaggaggaacaaacaactccagacatgccacctttaagagctgtaacactcactgcaaaggtctgtggcttcactcctaaagtcagtgagaccacgaacccaacgaaagaaactccggacacatctgaatatctgaaggaacaaactccagacacaccatctttaagaactgtaacactcaccgcaagggtctgcagcttcattcttgaagtcagcgaaaccaagaacccaccagaaggaaccaattctggacacattntggtgaccacgaagggactattacctatcactaagcgaatcaaggccatcaaactacagatggtcttacaaacggaaacccaaatgagctcaactaacaacttctaccgaggacccctggaccgacccactggccctttcactggcctagagagttcccctctggaggacactacaactgcagggccccttctttgcccctgtccagcaggaagtagctagagcagtcattgcccaattccaacagcagatggggtgcccgg

SEQ ID NO: 643030 - DNA, 297 bp, Homo sapiens
tcaaggatccccttgtcgagagacgagagagagaaagagagagggagggttctgtgggcagtggcatgacagatttgggtttctgaaagattgccagctactgggtggagcattgatttggaggtgggcaccaggaggctgttagtttttgctggcaccttagtaacagcagtgtttgccctgaagcaaaggggctaacttggaaaattactttaagaacagagacctaaacagggacgttggtggttcctgggaaggtgacttcttgacttcttggtgtcacccatctttggcttg

SEQ ID NO: 643031 - DNA, 239 bp, Homo sapiens
tagtcggtgaccatttttttaaatagtcttcattgcaattgtacaagaacacctcagatggtatgcactgaggtttgagctccttgaggctaccggcgcgattcatggcgtaccactgtgcagcacccggtcgttgccaaggttggcgtcgcgcaggctgaaggcgtagtggttgtcccagtcgagcttgcccggccattgcaccacggggccgaactgcgaactgtagacggtgtggg

SEQ ID NO: 643032 - DNA, 5808 bp, Homo sapiens
  misc_feature (129)..(129): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 643033 - DNA, 243 bp, Homo sapiens
  misc_feature (238)..(238): n is a, c, g, or t
ttgggaaactttttgagggacatgacctccacaagtgggaaattcccacacctgacattatgtgatgggttgccatcaaaatttagtcaaaactttgtttcttgcacaaaatgattaaaaaatattctatagaagtaccttcaggctatgtgttatgaggtgtatatgaaacataaatgaatttgatgtttagacttgggtcccatcctcaggattatcttgctctatatatgcaatntactt

SEQ ID NO: 643034 - DNA, 5854 bp, Homo sapiens
  misc_feature (129)..(129): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaacccccaaaaaaaaaccacaaaacgaaccaagggaacctcataacggaaccca

SEQ ID NO: 643035 - DNA, 5768 bp, Homo sapiens
  misc_feature (129)..(129): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaacccccaaaaaaaaaccacaaaacgaaccaagggaacctcataacggaaccca

SEQ ID NO: 643036 - DNA, 509 bp, Homo sapiens
tgcgcagcgtgcttcaagccatcaacttgcaggtgcagatctacaacacctgccagtgacccctgcccaagggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctagaggcaacagcacagcaggcctccgccctgcctggccacagg

SEQ ID NO: 643037 - DNA, 749 bp, Homo sapiens
ggtcccaggtaacgcagcgagctggatcccctactctgcgggcggcgcgaggcgtctggctcttcgcggcggcggtcgaggggacacggggagcgcggtggcgctgggatggcaatcgaggagtgaggagccagggaggggcgtcgggggagcagggacctaaggtgaaaggcggtccggggcgggaatctcgacgcagggtttggtacgttttcgcgcgagcacgtttgtggacatgatggcagccatgtcgtgacacgtgtccattgcccattatgagcacttatgattcatccatgcaagacattaatagcttcttcgcgaacccaattctgactctcacataacgaaaccgagacctgataccagatccgacatggcctgagggtgtccttgacggtgcagttcggaagtgcttccaccgcgtgtgacttcatcttcaacatgtcctgtgaactgaccatgggcgtgccattcacagaggcaatatctctggtgcacgccggaccatcccgaagctaaaacgtactcttaccttaggtgcgcataaggcttactgccaggaagtaattagtatgtcagataaacggaggctgagggggcaatccggagacgcgatcatcttcactctcctctccactggcgataaatgtatgcgcgggagacgctcagtagtgggtgaatcgtggtaaccaggtttgtgtcggccccacctccgtgtgggtgatatcttatgcggcgagtggatt

SEQ ID NO: 643038 - DNA, 6141 bp, Homo sapiens
  misc_feature (129)..(129): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccgtgagcctcccacgtgtcccaggccatgtggttgtcccctttggcaactcccggtgtctgtatctcccttggttcatacttgagcctcagggactacactggattagtgtttatgatcccttgactggctcctgagttattgcccatatgtggtcccaggtccatgttcttgagtctgagccccttgtatagtccctgtccttgtgattatatccttatgcctggtaacaaacccctatcccatgtacatgtcctgagtccataccccaaaactgtatcctcatgcccatgctggagaatctatgttcttaagttcttgctgtgtccctatagaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 643039 - DNA, 110 bp, Homo sapiens
tcctcggagcaggctggagtaaagggcccttgagcaagccagtttgccgccattatttatattccacacgtcctgttttatccgcccgtgcaacttttagtttaaccgtt

SEQ ID NO: 643040 - DNA, 3994 bp, Homo sapiens
ttgtaggagataccaggctcaaggcagacaggattaggaaatatcaagtacctggcatgtggttgcagagtcccttggatgcgatcatccttgggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 643041 - DNA, 6220 bp, Homo sapiens
  misc_feature (129)..(129): n is a, c, g, or t
gaaggcagtttccggagggaaggggtagggttggggtgggggcgctctccgcccggtgttgcgctccttcccagaatccgctccggcctttccttcctgccgcgattcccaactttgctcaaagtcgcnggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgaggttgaagtgttgggtggggcaggtgggtgtagatgttcctctcacagggccctgacttgttctgtgcctggcaggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccgtgagcctcccacgtgtcccaggccatgtggttgtcccctttggcaactcccggtgtctgtatctcccttggttcatacttgagcctcagggactacactggattagtgtttatgatcccttgactggctcctgagttattgcccatatgtggtcccaggtccatgttcttgagtctgagccccttgtatagtccctgtccttgtgattatatccttatgcctggtaacaaacccctatcccatgtacatgtcctgagtccataccccaaaactgtatcctcatgcccatgctggagaatctatgttcttaagttcttgctgtgtccctatagaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 643042 - DNA, 3246 bp, Homo sapiens
caccttggccgcgttgtcctcttcaaagtcctcatccacctccagccgatggaccaccccactggtgatcgtggggttgcttacaaccccacgatcaccaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 643043 - DNA, 2216 bp, Homo sapiens
cttcagaggatcctctccccgtacgcccaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 643044 - DNA, 198 bp, Homo sapiens
tcagtagtacataggtcctcactttgctgaacttggctatcctgccatgctccatgacactacctgcagctccagttaatcattcacagtggatgccaacgtcgtgtcataccggggaagttccccagaagtaggccggccttgtgtgcggttaccattttttgggattaatcatcaccgggtttgactccgagaaat

SEQ ID NO: 643045 - DNA, 1965 bp, Homo sapiens
tttctgatacccccaaacagtggctcaagacgctggccgataccccccacacattggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 643046 - DNA, 808 bp, Homo sapiens
ccgtaagtagtcagaaatatccccagctaaaacccgtatgattcatacataacatatatctatactgtgatgatcacagtgccagggctactaaaagaaagaaggatctcgatatattggctgccagcgataggtatcttatctctcgaccacattaaagactctcagacgtgtcctcgtctctgctggctatcgatgcgagacaggtccgaatacctacacgtgcggtcacgctactaagaatgagtcctcaacacacttgacaatgcctgcaactaagcatcgtctaaatgctgacagaatgctattttatcaaggtttctgttctcactcttaatactgtctcattgcatgatctggtagtcatcgaagatgccttctcgtgaagttctggctgacagacctctgagaatctgcaggcttgtcaagatctagcttcacaatctgtctatcccatgcagaacaggaacaacaagtatgtataacagaccacttcctgagtagaagagtgtctttgtgaaaaggtcacgattgacgactcacaaacctgcagttgtgtacccatcatgtattccatcctgtcggactcttgtcaacactctgtaccaagggtctcgattttttcacgaaattaaacttgcaacacagtccagctgtataacacatggcaactggtaggattcacctcaaccatgggtccccaaatttctagtccacaatctttgctggaagactgacgacgtaaagatgaaaactgccgggccacaagtccaccctatataccgataatgaaccctcgagggcatta

SEQ ID NO: 643047 - DNA, 208 bp, Homo sapiens
gagccggccgtctgttctatagatgtaaaccgagaagccattatttggaagccaaactcctttgcaacgtgggaggatcgtttgagcccgggaagtcaaggctgcagtgagctgtgactctgccagtgcactccaacctttttcaaaaatgttgctgctgtttctctctttgttgctgtgatccgcttcactccaacggggaggaacg

SEQ ID NO: 643048 - DNA, 847 bp, Homo sapiens
  misc_feature (45)..(45): n is a, c, g, or t
  misc_feature (104)..(104): n is a, c, g, or t
  misc_feature (110)..(110): n is a, c, g, or t
  misc_feature (114)..(114): n is a, c, g, or t
  misc_feature (134)..(134): n is a, c, g, or t
  misc_feature (167)..(167): n is a, c, g, or t
  misc_feature (239)..(239): n is a, c, g, or t
  misc_feature (309)..(309): n is a, c, g, or t
  misc_feature (313)..(313): n is a, c, g, or t
  misc_feature (326)..(326): n is a, c, g, or t
  misc_feature (336)..(336): n is a, c, g, or t
  misc_feature (355)..(355): n is a, c, g, or t
  misc_feature (357)..(357): n is a, c, g, or t
  misc_feature (530)..(530): n is a, c, g, or t
  misc_feature (550)..(550): n is a, c, g, or t
  misc_feature (626)..(626): n is a, c, g, or t
  misc_feature (662)..(662): n is a, c, g, or t
  misc_feature (746)..(746): n is a, c, g, or t
  misc_feature (751)..(751): n is a, c, g, or t
  misc_feature (763)..(763): n is a, c, g, or t
  misc_feature (774)..(774): n is a, c, g, or t
gcgtgttaattacaaagaacagtgaggagcatagaggtggtgaantttccaaacagggaaccaggatccacagccccaaggcccaggggtccggccacccaggnaggagnaacnccgtaataaataatggagtngggggcagggggtcagggctgcccctgcttctncttgactgaaaaccgcttctttctcgctgccagcatctcatagaaggggtccacactcacagcccgcctggntggacttgatccactcgtccttctcctcctgcgtgggggccgagatccggtacaccatgtggtttccctnccanccactcggccgtncgcctcagtnttgcaggctttgatgagcngncccttgttagttggggatgtaagttcaaagcagttcggtttccgaggggtcagtccacctctcggatgcccagattctccagggggatgattcctcggggctccttgtccgtggtgtactcaaagtagtaaaggcagttgtctgtgaggataaaccagcgccgcttccacgtnttcacccggccccctcccancttcaggagccagccctcccggtccgggtagaagaaggtgtgaggtaaggtcattcccgttatcctcaggaatctngaagggctctatttcggatgcttgttgtacaggttncctgagcagctcctcaggcaggtccccgccctccgttgatgccccgggtttcatggccacaaagcgctccaggcccggcttgtnccggnacatatggattntagtatactanttgttcgatcattatgcggcgaagacagcacaaagcacgtgtttgtggactggaaacccaaggttgcacagca

SEQ ID NO: 643049 - DNA, 403 bp, Homo sapiens
  misc_feature (14)..(14): n is a, c, g, or t
  misc_feature (30)..(30): n is a, c, g, or t
  misc_feature (81)..(81): n is a, c, g, or t
  misc_feature (92)..(92): n is a, c, g, or t
  misc_feature (101)..(101): n is a, c, g, or t
  misc_feature (122)..(122): n is a, c, g, or t
  misc_feature (138)..(138): n is a, c, g, or t
  misc_feature (178)..(178): n is a, c, g, or t
  misc_feature (291)..(291): n is a, c, g, or t
gtcaccggaggggntggcctggcccttccntggcctcccctggtttcgggttggcctcctttggcctccccttccctaaantcccccttccntttccccancttcccttgtccaaaaccccnttcacttccccctgcnctctcttcggtttcccctttcccttcattctttccctgcncctcctgccctacttcccctgcctcctttcctttaccctcttgtcttagtctattttctgttgctgtaacccacagattggataatggataattttaaagaaaagagatttantcgctgggcgtggtggcttatgcttcaaatcccagcattttgggaggccgaggcaggaggatcgcttgagcccatgaattcgagaccaaccctgggcaacataataagaccc

SEQ ID NO: 643050 - DNA, 2620 bp, Homo sapiens
ggtcggcggtttcctgcttcaaccagtgcttggacggaacccggcgcctcgttccccaccccggcccggacgcccactagcaccagcccctccgagtacaccatcattcacacgacacgccgtcgcgcacctgaccacccaaggaccaccacgacccggccgacgctccgacgcgcccagcgacacgcccaacacgacacagccgacccgccgccccctcatccatctagcatcagcacagacacaatgcaccgaaccggacgattcccacccactcgcacagggatgactgccaagaacaacataccacatcaccaagagcaccactcaagcaacgcgtcccgaccacaagtctaacgcccggccccagcagtccaaaccccccttgtcgtaaagagcacttccactaaccggccacattcgccattaaccggcatcgtgtaaaccccgttggcgctaccccacactgcgctccctatataacagttaaccaatgattcgggaaacccccggtacgggcaaattggcaagctcgctggcgcgggccaccaaattacgctagcggcacaacacgcgacaaaaccccggtcatcactagcgagcacccaccacgacgagacaacacagtacaaacaaactgatatcgatgacgaccatacattcgacacagacagcccaacacataacaagaaatcgacactacatcctagcaacaatacggctgagacccacggcccagcccacaccaccaagggggcgaacccaacccagcaccgtagcggccgcacccacgccacgcgacacaccaaccaaacaacagacctccggcaacgcgccacgagccctaacgcacaccgcaccccgcgccccgcgccacaggacagcaaagacagccaaaccaacactcacagcaccgacaccaccggaccaccacgcgcggcacaccgtcctggaagcctgagcagacaaccacgtcacagcgacaacgcacacgccgtataccacatgacgcagcacgacgcacgacacgacgatgcccgcaaggagaagaggaaaacgcatataaacagtttaaccacaacctacgagacgaaaacacccagcacaccactgccccgcaacaacgcgcacagcgcccacccattgcggaccacactgacaacaaacaccgctcccgacacaacgccaacattctggggcacacgccccacacaaacaccgccaacacagcgccccaccggagcagccagcgccaacacgcacgtcgccaacaaccaccactagtgggacaacctacagccaaacccactgagccgcggcccacaccgaccacgatagtccagctatagccgccacacacacgccctcgcacacaccccaacccgataccccacctgacgccgccaaccaaacacgccgcacacaccaagaaccaaccgatgcagtgcgccctctggaccaacaacagcgctaaccccccacagcgcccacacactccccccccgactgtaaaccgcagccccgtgaggggcgacagcacaaacacaccacgacctgaggccgcaccacatagcaccacacagccaccagcaccacaccctgcgcggcacgcaacagaccacccgaacatagcaccccacgaggcacgacacccgcacgtaccaacaccaaacacacaaacacccagtcgccacaccagaccagaccacgagccccagccaaaacaagaccataacaactgcacgcaaacaccgccaaattcagcgaacaacgaccgaccaccacgcgagcaacatacgcaggaccaaccagcgcaaccagacaaagagaccccagaagaatgtatcgtcgaagcccccccacgtcagcgacgcaaccaacaagcctgagcacacagcgaccgccacagacatggaaagcgcatggaaacaacacaacaacagagcgcccccaccccacctgcatcgacaccgacagcacacaacagacgcaaaaaaaagcatgtccgagagccaggaacgaacaactagtcgaaacacaccagcatcaaactaaaccagcatactcggtaccacaactacacacacacagaccacccaatcaacgtgggacgaccagacgaaccccacactgagacagaacactacacgaccgcagctcagcgcaaaggcaaacgaccacccgcgagccacgccaccacacatcgacagacaacaacaaagacatacacgctaacgacacaccacccagatagctgcatgcgcaccacacttagcgagcgcacacaccaccatctaccagccccaacgagccacacggcatcatgcgaggaggagacagagccagctagacagcgaggcacgcaccggaccgcccacacaccccgcaccccaccgtggacgagccgacacaaacagccgaaagccacaaactacagcgccgctcagcaagacgtactaccacaagcacatgaaggcacaccaaccgacgacagctgcacgcaccccgacgacccacgcccaaccatcgcgtaggctgacaccaccaacagagaagacgacgacgatgcccacgaccagcaccacgccagtcgaggccgataacgaggccagccgccacg

SEQ ID NO: 643051 - DNA, 388 bp, Homo sapiens
  misc_feature (135)..(136): n is a, c, g, or t
  misc_feature (262)..(262): n is a, c, g, or t
  misc_feature (270)..(270): n is a, c, g, or t
  misc_feature (278)..(278): n is a, c, g, or t
  misc_feature (310)..(310): n is a, c, g, or t
  misc_feature (362)..(362): n is a, c, g, or t
ctcacacccaaagcaagtgacagaggcagctggaacgagatcgcctatggtacgagctctggagcagtacgagagattgtgcaacacccacagacagttgggacaggacctcagctctttcggactttcacagtnnaccgaagtcccgaaacagaaagcatgctatcagagaagcatcttgtatcagtcagtgcagataatatgtcatgtccggacgtggacagcaacacgattcatgggaaagatctttactcatccggtnctactccnttagcganattcaagatactattcctggaggagacagaangtgatggcagctattcctctggaaatgacataggacctttaggagagcgagnctatcaacatgggtttatccagagag

SEQ ID NO: 643052 - DNA, 186 bp, Homo sapiens
tttttttttttccgggcccccccccccccttttggaaaaaggggcccccggccctttggggggccatttttttttttcccctggggggggggggggggggaaaaaaaggggtttttcctgggggggcctgggggggccctttttttcccccccgggggggggtttaaaaaagttttttttttttta

SEQ ID NO: 643053 - DNA, 130 bp, Homo sapiens
aatcctagcactttgggaggtcaaggagggaggatcacttgggcccaggagttcaaggccagcctgggcaacattagcgggacgctgtctgtacaaaaaatattttttttaaataaacgatattatgagg

SEQ ID NO: 643054 - DNA, 191 bp, Homo sapiens
tgccgggattacaggcgtgagccactgcgcctggacaaaataatttttaagggaaataaatgtgagcatttagaagccttactgttttaaaccagggtagttgggcaggcttcagtcacagtctataactgtagcttatttgttcaaatattctactgtggtctctttcttttaacgttttgttttgttga

SEQ ID NO: 643055 - DNA, 118 bp, Homo sapiens
agttgaggatgagctcaggttagctgcatgcacttgataggcagtggcctgtctcctcacttgagtgcaaggtccatcgaccaaagccctgtactgatcactactcatgtccagccag

SEQ ID NO: 643056 - DNA, 594 bp, Homo sapiens
  misc_feature (36)..(37): n is a, c, g, or t
  misc_feature (395)..(395): n is a, c, g, or t
  misc_feature (470)..(470): n is a, c, g, or t
  misc_feature (503)..(503): n is a, c, g, or t
  misc_feature (509)..(509): n is a, c, g, or t
  misc_feature (511)..(511): n is a, c, g, or t
  misc_feature (517)..(517): n is a, c, g, or t
  misc_feature (528)..(528): n is a, c, g, or t
catgccagccgccatcagctacacttcggttcagtnncgaccgacagaagcacggcaccagtacagaccgccaagaagaaatggtgacgaattggcttgtccgtaatcctgactacacacgttccaatctgaagtacaaagacgttgccaagagtggttacaagggcgagcacatcaaggacggtggaggatttgccaagctgttgcaggctgtagaagctggcgatatccaagctggtgacgttgttctttgcgaagcaatggaccgtgctgggcgtttggaatctttggacatgctcaccaaggttattgccccaattctgtatgctggtgtgtcgatcatcaccctagacgataacacggcgtatacgaaggcaagtgttaacacgcctcanattcacttgctattggcaaagattcaagctgcacacgggtacagtcaggctctgagtgaccgtatcaaatccaantacgccacacgcattaagaacgccaaagagacnggtaangnaaaacncaatacgcctntctggcttaacagcgacggtgagcctaatggaactggcgtgcctttgattaaagcaagcatttgaa

SEQ ID NO: 643057 - DNA, 192 bp, Homo sapiens
ctgactctgcaacactagaaaactaacaaatgagcaacactataaagagtagaggtagtctcattgggtgtaactttcaacccattctgcttgtggttagacttataactttgctaacgatgtaatttactaaggcttgaaatggtattctaacagtgagttcattgtcttgaggataatctgatttataag

SEQ ID NO: 643058 - DNA, 325 bp, Homo sapiens
ggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagcgcctggactgcaggggggcggcagagccgcggtgcagatgggtcctgtagattgatgtgtcttaactaataaagtgctaagaggcaggatgcttgggcttcctggccccctcagaatgcgcagt

SEQ ID NO: 643059 - DNA, 111 bp, Homo sapiens
tggatccatcggcgccttttttaactggtcctttctgtgcactttatgtttgttttcgtcttgtctggtttgagatggagtctcgctctgtgccgaggtgagtgcggtggc

SEQ ID NO: 643060 - DNA, 90 bp, Homo sapiens
gaaatatggtttatcaatatttactattgatatatatgttcaggtaactttacacttacaatgaattcatggatttgttagcagcatagg

SEQ ID NO: 643061 - DNA, 214 bp, Homo sapiens
gatacaaaggagagggaaaactatctggtccacatgacactactaccatatataccaggtcccacatcttaccaccccttccccatcactgtcctcagagagacgctgttaacagctccttgaggtgattctctcaggcttgattgtagatactctcgctgtcaagatctgatgctgactctcatcttccgtgattcgttctttacctcacctg

SEQ ID NO: 643062 - DNA, 335 bp, Homo sapiens
ccacatatgcctccttttgaggtgttggttttgctttgttttgttttgttttgggtggtttgtatggttgttgagatggagtttcactcgtgttgcccaggttggagcgcaatggctcgatcttggcttacggcaccctcccccttccgggttcaagtgattctcctgcttcagcctcccgagtggctgggattgcaggcgtggtggtgcacgcctttaatcccagctactccagagactgcgcaaggagaatcgcttgaacccaggaggcagacgttgcagtgagccaagatcgtgccactcactccagcctgggtgacagcaagactgtctca

SEQ ID NO: 643063 - DNA, 621 bp, Homo sapiens
gagcgttcagaggatcctccaacgctgctcacaaaactatctgaaaaaacagagaaaaggctaaagaaaaaagaaaaatgaacagagcatctggcaagtgggggcccaaatttcagggggcctaaaaggcttggtacttgggagtcccagggaagggcagacttgtggagagaagctggtggctggttcacagggaacaaatataaatggtttggtaactaccagaaggggctctcgccatcacttagttaaaggctaattaaatgagatacctctttacctatcaggcatagataagaaggttggataaggtacaacgtgggcagtgttatggggaaacacagcttccgggggggggggaggacagacgggtagttggagacgggggacagaggttgatttggtggtgcacggactctgattcagcacttccatttctagagtatctcatgggggggaccatacacaggcagatacgttcaagggaatgctcacgggggcttggtttaatagtaagaagcccaaacgactcacatgcacacatgtcagggcctaggtaaattatttattggggttcccagacaatgaaatactgtgtccccattaaagaaggtaataagt

SEQ ID NO: 643064 - DNA, 542 bp, Homo sapiens
  misc_feature (36)..(36): n is a, c, g, or t
gaggccccggggccccaccatttctcccagttcccnccccgttttgggaggagggttaaggggcccggtcccaggaaggtcttccaaaacccccttgcgttttttgttaaggaagacccgggggcccctttgggggatttccttaaaagggggtttcccaccccgggggggggggtttccaattaggaaaggggttggtggggcaaaaaaacccccttttcccaaaaggggggtttttttttcattggggttccccggccccttgaaacagggggccaaaacaaaaaggggttggaagacctttgggaaaattttcccggggccagggttttctttttttttttttttaggaccttccccccccccccaaaaaaccgggggggggaaattaggtttcccgggtggcccttttttttttgggggttttttcccccccctttttcccccttggccctggttaaacaggccgggaaaggggggggggggggtaatttttttttaaaaagggggggataaaaaacccccaatggggggggcccgga

SEQ ID NO: 643065 - DNA, 1138 bp, Homo sapiens
ggatgggcggggcaggcgcgcggggattgcggcgaggatgcgagcgcgccgagcgagtagagaacatcggtatccacggcacgataagatttccaagtgagacacaagtgtctggtgtcaagctactagtctgttgctctcttctaatcccagtatccttcagaggtgcacgggatgcacaccagggcagagctgactgcttctgggcgggatggcacgagtgcggcatgcaagggaatgccggtttgatgctaattctgcaagttgcaaccctcactaatggccgtgagtcggaagcgctgtgttggagcctagatgcgaatgtcgaggatgttgtaggcaccactggtttacttgcagcgagtgcttgcaccaaataaggggccccaaggagctcatacgtgttgcccaatacagtacagccaacacatgccaccctttggccccagggttgccatgttggacaaagcccctaattagcccaagtcttccgctcatcaataccaccctattccggggctaaggcgtatgaagcggctacgtcattaaagcccagtgccaaggtaactaggcacccagcgatactcagtcgaccacacccggtgctcaactccagatagtgaaggaccgcctatcgctgggacgaaacactggcgccccaaagaccaatgaactaagcttgcgtgggtcccaagttgcagaactgtgggggcaaagctgcacagcgacaacggcctagatggttgaaaccgttggaccacgcccccttgacggggcaagcaacctctttcacattggctgacatgagcgtggcggccaaccatcccatggtttgcacacactgtgcgtaccctaactgggtcccgttcactcaggcatacacatcacatacccaaagatcccccctggcccgggcacacacggtattccacagctgcgaaagtggtcatgtacaacccaacagcaccttggatttacccccctccaagcgcgcttctcctatcgagtaagtaattaacatcttacgcctcgtacagtatgcccacacgtcacatgtgaatctgtagttcgcttgggtctccattagtgctgacatgccactgtcaaacacattggcacctgccgtcattatatacac

SEQ ID NO: 643066 - DNA, 248 bp, Homo sapiens
ggctcggtacctttttataactcttgaccatcatctagttacggagcatccacttttcacccctgggccataaccatttgacgcatgaaaaatcatcaaattataatatcatggcttatacttttgatagcttctgcccggagcatggcggtaagagcttctcattttcaattgattcattgggggagaaaatatacacggctgtcctagactttctatgacacacaatttgcttgtccggggttgtt

SEQ ID NO: 643067 - DNA, 629 bp, Homo sapiens
agtatacctcgaaagagaagggtggctgtgagtacagaagtcgagatccctaatctaagatcaaggaagaagactgtggtgtggaccgtgactcctgggatacgtaagataagcctgccaagtgaacgacccctatgacatcctcgtgggagcgtgtaaaacccccggaagggaagcacaatctggtcaaaattggcctgtgccggtacgaaatagctctagaagtaatagatcaacactcatgaatttcctacaaagggatcaagaatcttccaggtgaggccttgaggactcagaagttacaacacaggctttcctgcgggcccaaagtaggccttgaggtcaaaacccgatgactgaagggacacctgtacaggcaccatactggctaagtgcttggatgaggcagcgagcgagggagtgcatggcccagatcaaggcttaaggacaaacgcttggaccctgcaacctgttcccagcatttaccaggctctcaccccatgcgtgctgactcaatactgcacccgtgatctctcgcagaaggctggtggggcgatagctgacctcccggggtgcttgctcccaccctcctcctgcgagggtccgcgtcgtttctatccgtggctgcg

SEQ ID NO: 643068 - DNA, 124 bp, Homo sapiens
tccccattactactagtttactacttggtcatcttattgaatcttaacatgggcgggtgcagtggttcacacctaataaccgtcaaccaatgtgtggagcgccgggttaccgatgctcgatatt

SEQ ID NO: 643069 - DNA, 358 bp, Homo sapiens
agtgaatgaagaaaagctgaaagcattccctctgagaacaggaacaatacacggctgctagctttcactacgggcgcttcagcacagtacggggggtcctagccagagctatctgacaagagaaagagataaagggcatccacatcagtaaagaggaagtcaaactgttgctgtttgctgatatgattgtttacctagaaaaccctaaagcctcctccagaaagctcctggaactgataaaagaattcagcaaagttcccggacacaaaattattgtacactaatcagcacctcttctgtacaccaacagtgaccaagttgagaatcaaatcaagaatcaaccccttttacaatagct

SEQ ID NO: 643070 - DNA, 120 bp, Homo sapiens
atgcggtcgactctagacggactccctcacggttgagcgcgcatcagtaagcggtcagtaagcggagcggctgctgggggtatgttgtgttgattcatttaatctgtgctcgcttactga

SEQ ID NO: 643071 - DNA, 1057 bp, Homo sapiens
acaagttggcttttattatccatgttcaacctggggagaaagctcggccacagacctgtgctacggggggggttacaaggtcatgtggcgggcgcccgtcccgggtgggttctccgggtacacgttccgaggcacgtgccgcgcaagtggggagtgcaagtgtcctttcaagcggaaagtgcgtgcctcgagggtggtgttatcacggccgccggtgtgataacattcagcgtggaggcgccaggacacacagggtgcccgccaggtgggcgttcgcataagtgtctttcgagagtccaaagcgcccgaggggttctccaagcagagaatagtctcctcaagcacagagaaaagagaaaagtgtgtggaagcgcggagtgtgcctctttgaaatatgctcctcccgattgtgcgagagagaagacaccagagggtgctctgaaaagaggggcacacacaaaactgtggtgttgcgcccagtgtgggcgcgagaaatactctcacgagggcgcgcaagagttcacacgggaggctccacacaagagaaggcaccagaggagacgaggaggcccacacgaagggggagcaggagacgaagcggcgggagggagagtatcaacacgcgacagggggtatctcccttcgtgaccagaaggggacacaggcggcacatcttcgggggctctcctcacaacaagagggcgaccaacacaacacaagcaagggtgtgttgtgcgcaccgcaacagaaggtgttgtgctctcccaccgaagagcgtttcctagctacttccgccggtggagaaagtttaccccgccagaagaggggggggggaacacacgtggcaagtctcctccaattctcccgaggtgtggacaaccggacaacaaggaaaaaatctttccaacgaggaggggagtctcctccactttctattttcccccgaaggtgctgcggatcttccacaacgccgttgttgtggactttggtctccccgaaggctctgcgctttccgacgggtgtgcgtccccaacccgccgcttttcgctgcttcgga

SEQ ID NO: 643072 - DNA, 189 bp, Homo sapiens
ttatcacaccaacaatgactaactcaaactagctcaaaacaaatataaccatacacaacattaatggactgaactgatctctttatagaagctatccctaagtcatttttattgccacaactaacctcctcggactcctgcctcactcatttacaccaaccacccaactatctattaacctgacctaag

SEQ ID NO: 643073 - DNA, 649 bp, Homo sapiens
agttccctttgtctttactttctgagatcaggcttgtatataagagaaaattaccttcagtagtgaacttttactaggctagggaaatggacaggtaactagccaaacttgtgtatcacgtttaacacatgaaccttacatcaacctctgggcatttccccccactgaggctaatcacagtttacccaggaagttaaaagtaagctctaactagttcctcttaaaacactttactagagattttgttagaaagtgttctatgcttaacacttcagcaccatggctgagcttaaattctcaactctaagcaacagaagttttagaaagtcactttgcacccggtgcggtggctcacgcctataatcccaacactttgggaggccgagacaggcagattgcctgagctcaggagtttgagaccagcctgggcaacacagtgaaaccctatctctactaaaatgcaaaaaaaattagccgggcatggcggcatgcacctgtagtcccagctgcttgggaggctgaggcaggagaattgcttgaacccgggaggcggaggttgcagtgagctgagatcgtgccactgcactccagcccgggcaacagagcaagactccatctctaaaaaaataaataaatcaccagatggtga

SEQ ID NO: 643074 - DNA, 154 bp, Homo sapiens
aattactcattcatttttttattcattatgtcaggctatgtataagtgctgagaataacaagataaattatagtataatctctggcctcaagattcaataattggtgaaaggagacagatatataatcaatatgtacagtagattgtaattatg

SEQ ID NO: 643075 - DNA, 806 bp, Homo sapiens
ggccgcggttagtccctgctggcaccccactgcgagcatgtgcgttccctgcggggagtcggcccccgagcttgccggcttcaccctcctaatgccagcagctatcatgtggaaatgtgggccagcttgcaacggagtctgagttattctctacactgaatatgtctaagattggttacttctataccgattgtcttgtgccaaatggttggaagagcaatccatatgcgaccacagaaggacacattcaagcagaagcttagcataagatgctgaagtataacatcaaagccattctgtgaaaaagctgctttcctgggtgaacgagcagtggctgtgccagagtcatggttctttcaagcagtcattcatatcagcgtagtgatctgcagcttcgtaggtactcccttccggtacctacttacaccttccatgcaatgaaagtgttcaaaataagataaagagccttaactgggaagacatggaagaatagatgccggtgcacttcctgaagagtagatgattccgagttttgtatccggattccgggaggaggtatcacaaaaacactctatgatgaaagctgttctaaagaagatccaacatggcagttcgtgctgacaattggttcagaaggggacaacatcccagatgcattaggtcgttgttgagtatcttaatgagtggcttcagatactcaaaaccagcttgtacagtgcgtattataggttaagcctcttctaggtcgtgggtgtattcattaactcgcactttatattactacctaagtagaacagtaagtgaac

SEQ ID NO: 643076 - DNA, 285 bp, Homo sapiens
ggaagcagctccaggttctcctgtatgtaagccttgggaagaggcaggccagcagtgagcgaggggccgcgcccgtgcatcgtgagagccctgacaggggcaacaagcagccaccacgtgggggacagaggccgggaataccgggcataagagggtaaagaaaacttttccattaccaagtgtctagctccaacatccttgcttccgtacacttacaagacccttctggtgccaacaatgcttgatgtgcgcatccgtgtcttgcaattgatggagtgaatttgc

SEQ ID NO: 643077 - DNA, 778 bp, Homo sapiens
cacggtggctcacgcctataatcccagcactttgggaggccgaggcaggcggatcatgaggtcaggagctcgagaccaacctgaccaacgtggtgaaaccccgtctctactaaaaacacaaaaatcagccgggcgtggtggcgcgtgcctgtaatcccagctactcaggaggctaaggcaggagaatcacctgaacacttgaacctgggaggcagaggttgcagtgagctaagatcgtaccactgcactgggtgacagagcaagactccatttcaaaagaaaaaaaaaaaatttaagagaataaagagaaaatcggaaaaacgagttttaaagtatagtgtgtgaaataaggggtaactcttccagagggtggcagaaatataacaaaagaaacctttaagagcttaaattaaggccggaacgcccatatagcttcagcgttcgtggtaatctcccgaggaacattgggacgaggctgtggagatcaagcgcaaattcacgttggaaggctcaaggaaagttctggaaaacacaaggccgtggcgcacacacagtgtgtgaaaaacccacacggatcactcggtccgtaaagagaacttaccaaaaagactcaggcctgggggagcaatagggagaggagaccacccaaattccgcgggaaagagatcccacaagagaataacgcacacataaagggggcaactaaaagggaaacgagggagacaaccgggagccccaaaacccccaaagggaagcgcgcaagagaagggctcggaac

SEQ ID NO: 643078 - DNA, 1069 bp, Homo sapiens
ttgatcaggaagaactagacaagaccaagcctatttggaccagaaaccctgatgacatcacccaagaggagtcatggcagcaattctacaagcagcctcactcaatgcactgggcaagacccacttggcagtcaagccacttttctgtcagcaaggtcaagttggcaattccagggcattcgctcatttattcctcgatcgggctccactttgacctcttttgcagaacaagaagaaaaagaacaacatcaaactctatgtccgccgtgtgttcatcatgagacagatgtgatgagttgataccagcagtatctccaattttcatccgtggatgtgggttgactctcgcagcgaatctgccccttgaacatcatcccgcagcaaatgctccagcaagagccaacaatcttggaaagtcattcggcaacaaacattatgtgcaagcaaagtcgccttgaagctctatctctagcagctcggccaagcaagcaccaaggagccacatactagcaagcaacacataccatcatggcagagccatttcctccttagcaacagacatctacaaaggccattcggggcaaatccccgcacgcagagcacgtcacaaattaaacccggagcggacgcgcacgtgggtcgttggcaaggacttggcaatgcccgcctcagttccagcataacacccatccaccccaagatccctggcgaaacagacagtgcaccgccactggcaccacacacataacatggaatcaaggaaaggatcacatggatataacgctcaggaccacttggaaacggagaggaaccaaccgaagcacagcgggatacaccaaagacactgacgtttagaaacgaaatccaaacacatgggagcagtgaacagaaaggacaaaaacgaaaccacacagaggactggagacccacacacgattcagggcgcagtcgagacggggaggggcacgacaggaagaaatggcggagacacaaactcgagagagggacattactcagaacagacgatggcggatcaaaaaatacaaatacaacgccacgacacgcccgc

SEQ ID NO: 643079 - DNA, 527 bp, Homo sapiens
gagagagaactgcagccgaatctgtttggactcagatcaacatggaacgaagagagtgaaagtgaaagtgagcaacgtattgattctgaggagtcggacagccggggaggctcctcatcagatggatgacatcaaagtgttccagaatgaggttaaaggaacactacagtggtccacaagaggagaacatttcttgtgacaatctcatactggaaatcaactctctcaagtatgcctataacataagtctaaaggaggtgatgcgggtactgagccacgtggtcctggagttccccctgcaacagatggattccccgcttgactcaagccgctactgtgccctgcttgctacctctgctaaaaggcctggagccctgtaattaggaactacatacagcgcgcagccaaccatttggaagcgttagcagccattgaggacttcttcctaagagcatgaagctcttggatattccatggcccaggtattgctgcctttctaccaggtggagatcctggcttgaggaaac

SEQ ID NO: 643080 - DNA, 258 bp, Homo sapiens
cacatgtgtggtatctgaaacttgctgaagtgttataactaggggagctttgggctgagattatgggtttttctaaatatagaatcatgtcgtctgcaaacagagatagtttgatttcctctcttcctattgggatgccctttatttctttctcttgcctgatcctctggctaggatttccaatgttgaatataagtggtgagaggtgacatgcttttcttgtgctggttttcacggggaatgcttccagctttggct

SEQ ID NO: 643081 - DNA, 137 bp, Homo sapiens
gcggcccaaagacccacttgcgtctattagtatggaaccataggcatttgtttttttaagctttatctttccttgttgcatccggaccaagaaaatatctttgataatgagaatgacggcgcctgtgggcttcatgt

SEQ ID NO: 643082 - DNA, 933 bp, Homo sapiens
ggagtaactgagattataggcagtgcaccatcgacacctggctaatttctgtatttttagatagagacaagggtttcacctagtattggtcaggctgggtcttgaaacatccttgcaccgtcgatgatccacccaccctcgagctagaggtgctggagattacagagcgtgtgagactcagacacgcccgtgccatgaaatattttgacttaataaatgtgtgaataatcctattcgagtgtgcttgtgggcttttggtgttggtggtcatctattggatgtaatgtggttctatctatttaacctattgggtgcaatacatggccgtctctagtgtatcctgtttcgtggacgactcgggcgtgaggatgtgaaacacggggttccgagctacgtgcgggccctaccatgtgaaaaactgcttctgaccctaccgtgggttctccccaatgcatatttcaatggcctaatttttctaaagacctgtcctcggagagatcaggcttgggggagaatgtacagccagggactttgccagcgcacatcatgaaacccgtggaggcataagatgtcgtcggtgtggtatgtgttggacttccaaaagacatcgagggcgattagtgccgtggtaccagtgttgagccccaccgcgagagtgtggggttttctcaaaagaatgtcttttgtgggacactgtccttagggtgagaaattcggggaccccgggcgtctctccggagacctatcccggcaaaaaatgtgtcgcgtcttcgaggaggctaattttcactacaggggtgtgctactagaaagaacaccacacaccagaggtgtccacacgggaggcctccagagggagaaaaagttcaagacacttttgtttcgctgacagcatttgtcaaccgcgccgtaaaattttcggagcgatagtga

SEQ ID NO: 643083 - DNA, 332 bp, Homo sapiens
  misc_feature (280)..(280): n is a, c, g, or t
gggcgagcgctacccgcggcccccgcgcggccctccccacaaagggccgcggagctgcgtggccgccgccgccgtgccgtggctcgcctccgcgggcgcggaaatttgttgcacttcttggggcttgtttatttgttgttttttctctgggtttcttatttttttcgttattttggacaaaatgtcggtccgtgatataaaaattgagcgaggaaccttggtggcattgggagctttgcagacagtttttccaagagataacttcaccaagcatgtccangtgaatttaggcaaagcgtccgatgaatgaagaaagccccgagcaccaaagc

SEQ ID NO: 643084 - DNA, 724 bp, Homo sapiens
  misc_feature (249)..(249): n is a, c, g, or t
ggcacgagctgatatgctctgtgaagctgggcgatttggtcagaagacaggtaagggctggtatcagtatgacaagccactgggtcgcatccacaaacctgatccctggctttctgagtttctgtcacagtatagagaaacccatcacatcaagcagcgctccatcagcaatgaggaaatcctggagcgttgcttatattcccttatcaacgaggcattccgcatcttggaggaggggatggccgctanccagagcacattgatgtcatctacttgcatgggtatgggtggccaaggcacgtgggtgggcccatgtactatgctgcctcagttgggctgccacagttctagagaaattgcagaaatattacagacagaatcctgacatcccccagctggagcccagtgactacctgaggaggctgggttgcccagggaagccctcctctgaaagaatggcaaagcttggcaggaccccatagcagcaaactgtgattcagccttctgcattttgccatgtatggtggcatctaatttcagtgtgattcattcctaaaatccaaacagatttctctgaagtacaaatgattgatttgctgctgttgctgctgctgctggtggtggtggtgctaaatggtcagcaaaagcccctctctgtatcttcctacctcataattctaatggccagatttcaggaatgtgttttctatacctctgacggtac

SEQ ID NO: 643085 - DNA, 220 bp, Homo sapiens
gccacttgacactaacaccatcgagggcaattaatcaggagacaagtaaatataaccgctctgctcttaacgtcacacactacagggtaattctgtcattctctagcactcacttaagaagcttgtaggttagcaccatttcagtttctctagttcagccagtgtcttgtccttagtgattgctccgccttcctgcagttcaatttctcctaggactcta

SEQ ID NO: 643086 - DNA, 517 bp, Homo sapiens
agtagagatggcggtggtgatggttcacagcagtgtgaatgtacttaatgccatggagatgtatacctacagatgattcaaatagtacatttatgttgtgtatattttaccacaatgagaaaacccaatgaaattagttagttgaaatcagaataaaatgttgagcaaaaaccttttaaatagattttattttatcaggattcagagcattataactttggccagctataaaaatgactaggattcttgcatgcatgcgcgtatacacatgtacacaattttcaatggaaagatggtaaaacacattcatttaagttgtaaaaattttgttagaaaattatgaggaaaagactaaaaagatatcttaggctggcgtggtggctcacacctgtaatcccagcaactcgggaggctgaggcgggagagtcgcctgaacctgggaggcggaggttgcggtgagctgagatcgtgccatttcactccaacctgtgcaacaagaggaaaactccatctcaaa

SEQ ID NO: 643087 - DNA, 340 bp, Homo sapiens
  misc_feature (326)..(326): n is a, c, g, or t
aagatggagtctcactctattccaggctggaatgcagtggcacaaatctcagctcactgcaacctccgcctcccaggttcaaacaattctgatgcctcagcctcccgagtagctgggattactggtacacaccaccacgcctggctaatttttgtatttttagtagagatggggtttcaccatgttggtcaggctggtctcgaactcctgacctcaggtgatccacccacgttggcctctcaaagtgctgggattacatgcatgagcaaccacgcttggcctaccatactatttttgaagtaaacattctccattacctattactngtagataatacact

SEQ ID NO: 643088 - DNA, 211 bp, Homo sapiens
  misc_feature (5)..(5): n is a, c, g, or t
  misc_feature (11)..(11): n is a, c, g, or t
  misc_feature (111)..(111): n is a, c, g, or t
  misc_feature (114)..(114): n is a, c, g, or t
gaccnccggancccctacacgccccaaagcccagtctctggccgtgatgttgctgctcgttgcgcttctggcgccgacgttgttgttggtcgcggtttgcggcgcgcgganggncgcgtgtttgctctgattccaggctgggcgtgctggccctgaaagcggggcgggtgctggcctatctgggcttggcggccgccctggccgcctgcct

SEQ ID NO: 643089 - DNA, 852 bp, Homo sapiens
cgcaatagatatagtaccgcaagggaaagatgaaaaattataaccaagcataatttatagctatggattaacccctataccttctggccataattgaatgacctagaaataactttgctaaggagagcctaatagcgtaagaaccccgaataccagacgagctacctaagaacagctagaggagcacacccgtcatatgtatgcaaaatagtgggaagatccataggtagaggcgaaaaaccttaccgtagcctggatgtatagcgtggtagtccaaagatagaatctatagttcaactctataaatttgtcccacagaatcctctaaatcggcctgtgtaactttaactgtctagtccacagaggaaacagctctttggacactaggaaaaaaccttgtagagagagtacctacattttaggacccatagtaggcctaccatgcagccacctagttggaagaaagcgtcgaatgctcaaatccactacgctagaagaatccccaaacatataagtgaattccgtcatacccaaagtgtggaccaaattctatccaccctatagaagaactaaatgttaggtataaacgtatacattgagaaaactattcctcctcggggataaagcctgtgtcagattaaaacagctgaactgacaatttaacagcccaattatctactagtcaaaccacaagtcattacttacccgtcactgtgcaagcccaaacacaggcatggtcaataaggaaggtgtattcaacacgtaacggaactccgggaaatcgtcccggctggttaccaaaaaaattactttgggatacacaggtttagaggaccgcctgtccagggcaat

SEQ ID NO: 643090 - DNA, 870 bp, Homo sapiens
caaaagctttttttttgtgcccctgattttatttttctaactgacttgtgttctcttatgatcatgtgatttgttttctttagcctgttacatgctgggttacattgatatttgaatgcctaaccagccttacatacctggaatacgtggtcagggtatattattctttttataactttgttgggtttgatttgctaatatcttgttgagtatttttatatgtgtattcatgagagagattggcttatagttttctcttataatgttgtttttgacccatgtgttatttagaagtatgttcttttaatctccaaatatttgggatttttttgcacctgtctttgtgttgcagatttctagtttaattctgtgtggtctaagagcatactgtctatgatttatgttatttggaattcgttaagatattttttatgacccagaatatggtcttcttggttcagtgtaagtttaagaaaaatgtgtattctgctgctgttgaatgaagtagtcttattatacaaacccattagatcaccctgatgctttctgtatttaatgcactcgctttacggaacgatgttacacttaactattctgcaaattacctgttattagcttctcacgtttccctcctgattattttgccagaatttttccccctgcttgggttcttaccaggagtgactggttaaccccttgattccggaggtattgtattgttgtttcttcccaaaacacagggtgcgggccccattacagagtcttgctataagggatcaacgggggaaggagcacataatatatattggaggcacggaggtattcgccttcgcaggagaagcgctaaccataccattatgaaaggtcggg

SEQ ID NO: 643091 - DNA, 1056 bp, Homo sapiens
  misc_feature (285)..(285): n is a, c, g, or t
gacgaaacagcaaggagcatgtcgaggaaagatcaagaacgaccaggatttgactgcaccatccgacagacacttgactcgttccgagtaatggcagacaaaatgatcagtgcgtaggggcacggagcacttgagcgtctcaccagagtacagcaagatgcctgaacgacgtaatccccctgtgacactacgtgaccttactcaattgcgtaggcttgatcttctagttcacatcgacattggaacgagtgcgagccagaacaggttaacttcccttgttgagcnacgcgaatcatggatcgagatgggatgagagaggaataggatctatcgtccacctatcaaccctgcggcattggggcatccatgtgcgatgaaaacgtattcgctggattcgcctctcccaaaatctcatggtgagacaacgatgctgccagtgtcgacgggaaccgcttgctagatgctggagccgacgagactgatggcgaggccccatgtttcacctgagggacaccaattgtcgctcatgccttcactaagatatggggagatgtaattgtagagtgcaacttgtggtatggccaacatagagtcgcaataatcgtgtggaacactccggtgatatcgtgtagacaggtggttgtaagagggcagatctatgcggagtaagctgtagtagtaggtatcaagtagctccggatgtggagagagcaatgataacatgggagacggtgctgttgtaggtagctggacattgcatcgaggtggtttccatgttttggatgagtagatgggaaacttctgtgtggacgctaagttggcacacatgaatgacttcggacaagagtagatgttggagagaatattggtgtacccgttgaagtggagtatggagtgattaatacttcgtagatttgttgggcccttggtccccaatatttgggagtgaagatattgcttgtctttcaaaattttgggcgagtctgaaggaaattttaaggctgtttttaaggggttgggggaaaatgtagtccataaaaagcagagggaattatt

SEQ ID NO: 643092 - DNA, 120 bp, Homo sapiens
tctagcggatcccttacttagtagtgccgggcacggagctcatacgtagtaatccagcacttatgggaggctgaggcaggtggatctcttgaggccaggagaatggcgtgaacacgggag

SEQ ID NO: 643093 - DNA, 1094 bp, Homo sapiens
agggtagccctggctgaggctcggaggtcctcccgggctgttcagagggccccaagcggtagccacgttctgatacttggctagaatgccatggggacgtgtgatgcttgtggtgtaatggtggagtggccctgagtggagtgggtcatgactgctttagtgaaatgagttaatgctgaagaggggtgagtgggataggactgaatgaaacctgaagggaaagctcagggcctgccaactttccatgcttgcatgctggctggactttcacgtttccatttccctactgtggccccttcttggccttggtgggccggagggccggccggccgggagattggcccaaggttcacggtccagcgcttggcctggcgaaggttccggtgtaacggccggtgcgccaggttgtgtctctcgagagagacgtttcaccctgtgtgtacgggttcccagggggcgcacccttggcgacccatttgtggaccgaccaggatttcagctagatggctgtgctttgctgtgaccccattttacttaagccttgcagatcgtttcctagagaattccagcctttttggggagcccctcatctggaccccgttggtggtcgttttccttcacattcccgaattggcctgtgagtaactttgcgcagacttggacactgactttgggcaaaaaacttctgttgtcgcccttaacagtttcagaccccagaaaggaaccttcggcggggtccaacagcggttcacctttccacgaaccgttccgagaccggctttggggcccgtgactggtggcttgggttcccccagaaaaaccagcgacaaggcgtcaacttggcaaacgcctggggtgcggctcccaggcaattatttccagcgctaaaatgtacatccgacgcacatgtcttcacactggagcttaaagacccgtaacggaattcctttttctattgcaacccgaggggcttgtgcaggttgatctttccacttgtgcggcaaaaaaccattgtattggtctgtgcacctggtttgcgcacacgtttccacaggggtggccccccgactgtcaacgtccctcgggtggttatt

SEQ ID NO: 643094 - DNA, 318 bp, Homo sapiens
cagacagaagataaaacgctaccagagactactagatatggtcaggagatgtaactaaacaaattgtagaaatatcaacatgaaatgatggacaaaaatcccatttaatatagatcattgagcaataaaggatatgaaaccaatagatataaatattcaattcagtctttccggaatgtgttgttagactacgaatccatccaacacagggcccccgatcgagggagcaaccccggaggagtgcggtcatggttgcgtgtacattggttctgtcctgtggcggccggaggtgagggactgtggtgagacatcatctgg

SEQ ID NO: 643095 - DNA, 325 bp, Homo sapiens
  misc_feature (171)..(171): n is a, c, g, or t
ttcccccccaaattttttttttgggggccccccccccccctaaaccggcccccaaattccggggaaaaacccccccccccccgggccccccaaaggggttttttttttggggggttcccccccgcccccacccccctgggccacccccgggtttaaaaccccctccggggnaaaagggggtttttgggggggcccccctttttttacccgcccccccctaaaagaaccccccccttgggggattttgggggtggggtttaagccccttggggggccaacccaatttaatttttttttttaaaaaaaaaggggcctttttccttta

SEQ ID NO: 643096 - DNA, 331 bp, Homo sapiens
gcgtcgaccaaggttatgactaaattgaaaaatgcgacaagaggccaggcgtggtggctcacgtctgtaatctcagcactttgggaggctgagacgggcgaatcacgaggtcaggagtttgagaccagcctgaccaacaaggtgaaaccccatctctactaaaaatacaaaaattagatgggtgtggcggtgcacacctgtaatcccagctactcaagaggctgaggcaggagaatcgcttgaacctaggagatggaggttgcagtgagccaagatcgcaagatcgcatcattggcactccatcctgggcgagagagcgagactccatctc

SEQ ID NO: 643097 - DNA, 741 bp, Homo sapiens
taccctcctccttccgtgtgtccctccgtgaggaggagggagtggactgatgtgcccccataccgcccccacacacagcccagtgagaaggtgagcagtattgattaggagatccgactctctgtacctcactgctggatgacaatgaccaatgacatgatcctttcaaagcccggtgtgtcatctggatatgtgcccccaccagtggccactccattcagttccaatgtccagataccaatgcctgcatgcctggtggtgcacatgcaccccatgaccatccttgtgaagtccccttccagctccacagactctgccccaggttcctggctcctggctcagagccaagacacagttccatgttcagccccagccccagcccaatgcctcaggtccaactccatgtccagtcccagacccagagctgtgtctttggctaacacccagaccctgatgggcccccagcctcatctccggctaccagcccctaagttttctccagtgactcctaagtttactacctgtggctaccaagttcagtccatggagccccaggtggatcttgggtcacaaaccaaatcaagaaatagggggcacaccgaaagctactttctgctggcacagggctcagcactcaactcacagcttcactatgccagcaagggagagcccgagtgcagcaagagcacccagagccacacggtcgaacacacagtgcgcctggccaggctgtctaagagg

SEQ ID NO: 643098 - DNA, 113 bp, Homo sapiens
ctggatatatgtgaggagtttgctaatacaatgcccgtcaggccacctacggtgaaaagaaagatgaatccgtaggagctcacgagcaactgcagctagatcatgttcactat

SEQ ID NO: 643099 - DNA, 264 bp, Homo sapiens
cggaggttgagaaggctcgcagttattgagaggagtactcatctgcagctggagctagactgagttccagttcttatggtgaaataggtcattttcttctcagaattatggcagactcagatacctgaaataagacggaaactaaaaaggacattcgcatgtctgagtgctgataactgtggacttgatggtaagcaacagtagctcagtggaacaggtattgatgagaagaaaggtgagggcatcccagctctacccggggag

SEQ ID NO: 643100 - DNA, 726 bp, Homo sapiens
  misc_feature (726)..(726): n is a, c, g, or t
cggctctcaagaactaagtttgtgctgtgctgcgggatccccagggagcttccttatatcttcggcaggaccccttctttttgtctcgaagattgagagcctagacaatatgcctggatgggactccctaggggaatggaggcaccacgtggttaaggagatcgagcgacgcctgccacatcttgcgggcagttgaggcgccgacatgatcatagccacagtcacgaaaggctgaccatagctcagactgaaggtacatccagcgatggtcattcgacaacgagcagcagccggcctgactgaactccaccactgtaatcagagagtcaaaggcggactgagttgcaacgtcattggcgagatcaacagctctgccttaccagggccggtacctgaacgttgtgcagacttgtgacctgggaacgcatacaacgctgatagcattgcgagtcttaagatcctgttagtgttaaggcgctggtcacactattcgaaaggtgagcgccatctactgccaagtcttagatgatcttctgagaccatcagacggtaaacacatggatgcatattagacgtgtaacagattgatgcaaagttgcgcaatccagccgtagagcgcgtcaggtaaccatacaattgcacggcgttcatcaacgtctagcctgtgaaaacgctggggtaacccacttaatggccttgaacttccccttttgccaccagccgcgn

SEQ ID NO: 643101 - DNA, 163 bp, Homo sapiens
  misc_feature (150)..(150): n is a, c, g, or t
gggttacttgagccctggaagttcaaggccccagtaagctgtgatcatgccactgcactccaacctcagtgacaggctagaccctatctctgaaaaaatattttttattaaagttgcaattatctagcttatacagtgaagtagatctanggaactttatatg

SEQ ID NO: 643102 - DNA, 586 bp, Homo sapiens
tactgtttagaaggcaattacctaagtcggagttgtatttctatcagggatgcagttctagatatatactatcagttgaaaacagctgcaagtcattctctagtactagataaagcaccactatacacttacctgacatatgtagagtgaaatacagcagtatgtacggttgtgcctctcagaaattaagaataactaagggtctcaagttcccttatagtaggatacatacagagtcactgagttcccactagtatgctaaataggaaccgcacatgcataaccaagggtagtaactacccccaggaccacatgcaacccccaagtctgaggcacaactatatacttctgccagtgaatagctatacaagcatatataaaggctgtattcggctatcaagcgtacaacctactactttaatattcatactatgtaaatcacatacacaattcaaaatctaataagacaggtgaaacgtctccaaacactttttacataccattctccatacaatttatagtcagcatatttacataaggaagtgtcacacttacaaatgcaaccacaattttcaatcgtcgtcca

SEQ ID NO: 643103 - DNA, 390 bp, Homo sapiens
  misc_feature (29)..(29): n is a, c, g, or t
tcactatccaagactgaaaaacaggctgnatggattatcactctgacccaactgcacatttctaatgtcttcatgttttcaattactccatgaattcccttatctgatgctgattatgcacaggactgtgtaagagttaaacaacacctgacactggtgactcgcgcctgtggtccgagcattttgggaggctgaggcgggtggatcgcctgagatcggaggtttgagaccagcctggtcagcgcggaggaactccgtctctgctaaaaatgcagaattacggccgggtgcggtggctcatgcctgtggtctcggcctcccagggtgctgggattgcatggcgtgagccatggtgcccggtcagtccctgtctctatttctaagaacgta

SEQ ID NO: 643104 - DNA, 982 bp, Homo sapiens
  misc_feature (835)..(836): n is a, c, g, or t
  misc_feature (848)..(848): n is a, c, g, or t
  misc_feature (857)..(857): n is a, c, g, or t
cgggaaggggtttgcagctgctccgtcatcgtgcggccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcccagaagatctctgatgatctgatgcagaagatcagtactcagaaccgccggggccttagaccttggtagccgcaaaagtgttactattatcacgcccgggtctatgagttcctggacaagctggatgtggtggnngtttttgatgtncggtcggangtagttcgcgttagcgcgggggcccccgttggcccctgctggggtacacctcagtgtacacgggcgaggggtcctggttccaggcgacagggggcacctacaggggaaggcccgtcacgcgggcg

SEQ ID NO: 643105 - DNA, 950 bp, Homo sapiens
  misc_feature (866)..(866): n is a, c, g, or t
  misc_feature (914)..(914): n is a, c, g, or t
  misc_feature (917)..(917): n is a, c, g, or t
  misc_feature (923)..(923): n is a, c, g, or t
cgggaaggggtttgcagctgctccgtcatcgtgcggccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcccagaagatctctgatgatctgatgcagaagatcagtactcagaaccgccggggccttagaccttggtagccgcaaaagtgttactattatcacgcccgggtctatgagttcctggacaagctggattgtggtgcgcagcttcttgcatgctcgggtccggacagntacgcttcggcattgatgcagacgggcaggccacctgtttgaacctcntgntggganttactacactacagttgacgacccgct

SEQ ID NO: 643106 - DNA, 1813 bp, Homo sapiens
tctcgcactcgtatcgcgttggtgtgtctccctctgataatgagagtatagttgtactcatacatagtgagaggaatagatttgttgtttcgtggagaacctgttgtatgtcctgcggtgatgtatgataactcctcatctcttcgtgccgactacaattagtgggagggtggcctcacaagatgattatacttgctgttgtatcttgtccgctggggtgtgatgataccaacgaactagatttgtgggtccgaatcatctcataacatgatctgctctcacgtcgttggtgggccggcttcgttgttgatacatcagggtgccatcaggcgttgacctaacatatgtgagctcttggtggtgcgctgttgtctccggtggggatatggtgttttcgccccttgccgcgtccccttcctgtgtgttttcgccgtttgttgtgtgtgggtgtgttccgccagtcttctcctctctctaccgggtgggctactctatgtgcacctcgacatggggtgactcagcctcgtgctcccccctgcgggctagtgaggtgtggtttagtaaaaagatgttaagttgaagtggggtgagggtaatagagttaagatagtagtgtgtggagagccctacgagttgggaagccacgatttgtctgtcaccacgtggagggggtgtgtcccccccccctccggagagggtgcgtgttgtgtcagcaagaggctctcgcctgcatgtggcgggggggcccgccagcgggtgtggggtgggggggtttttctcactcgtcccctcttgtggtccgcctctgttgtcgacaccccttcgtcttcggtaagacggggggggggcccttctcgtgttggtgggggccgactagtccgcctgctgtgtgtcgcgcgcgccccgcacatgggggtcgcttgttgatgttcttcaggaaggtgagccacgttgtttcgccccccttcttggtcctctcccatcttgtgtagccccacttgtctcggcagaagatcctgtggggggcctccacatcttgggcgccttctgctgtgtcgcctcgtgttgtccacccccctcctgggagaggacccccacagaagttttttgataagtgggggcgcgcttctcactggtgtcgctctcgtcgagctcgctcgcacacagcttgcccctctctggggtcgcatcagtgtgtccctgtgtctcgtctgcgcctctgtctgtgtcgcccccccttctggggcgtcttctgtggtgtctctgtggtctgctctgtgagagcctgctctctgtggtgtgtctctctcgcgcttgtgtcactgttgccgcactacgggtctgctggagagagttcacactgtgatagttgctgtgcgctctctgtgccctctttctgcgatatgtctctgagagactctggcactcttgctgtgtctgacacacacagtgatatggcttgtgtgtctccacacacacctctgtttgggctcgccacagaagaactcttaatatgtgataacaggagagaggagagctctctttgcggcacacctctgcttgccccacgccaccacgctcgcacctcggctcgtggctgcacccaccaccacttctcgggcgcaccgcctctgtccctcggcacggggccctctcgtggctttgctcactttgtgccctctgtccctgttcacctcgtgggctaaaggggtggggtgagagggatggagaagaggaggcgccccctaccctggttctggggcttgaggaaaatgacatttgttgaattaaataaagaaattgtccaattttg

SEQ ID NO: 643107 - DNA, 984 bp, Homo sapiens
  misc_feature (16)..(16): n is a, c, g, or t
  misc_feature (18)..(18): n is a, c, g, or t
  misc_feature (900)..(900): n is a, c, g, or t
  misc_feature (948)..(948): n is a, c, g, or t
  misc_feature (951)..(951): n is a, c, g, or t
  misc_feature (957)..(957): n is a, c, g, or t
gacgggggaaccatananccctttaggctaggtacgaggccccgtggttagctgctccgtcatcgtgcggccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcccagaagatctctgatgatctgatgcagaagatcagtactcagaaccgccggggccttagaccttggtagccgcaaaagtgttactattatcacgcccgggtctatgagttcctggacaagctggattgtggtgcgcagcttcttgcatgctcgggtccggacagntacgcttcggcattgatgcagacgggcaggccacctgtttgaacctcntgntggganttactacactacagttgacgacccgct

SEQ ID NO: 643108 - DNA, 193 bp, Homo sapiens
  misc_feature (164)..(164): n is a, c, g, or t
  misc_feature (193)..(193): n is a, c, g, or t
gagatcgcatcagcctgggcgacagagcaaggactctgtctcaaaaataaataaataaataatttccccttattaaattatcatagacacaggacatttcctccgaaactctctttctttccattcctggctgttttttcctcttatttttctttgcactttanaagtaaatttttattcagaaataattttn

SEQ ID NO: 643109 - DNA, 990 bp, Homo sapiens
  misc_feature (843)..(844): n is a, c, g, or t
  misc_feature (856)..(856): n is a, c, g, or t
  misc_feature (865)..(865): n is a, c, g, or t
tgagaggacggtggggcttcaggttgtaattactgtgcacggtcggctgaccatttccagctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggaggacatcaaggagcacgtgaaacagctagagaaagcggtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcccagaagatctctgatgatctgatgcagaagatcagtactcagaaccgccggggccttagaccttggtagccgcaaaagtgttactattatcacgcccgggtctatgagttcctggacaagctggatgtggtggnngtttttgatgtncggtcggangtagttcgcgttagcgcgggggcccccgttggcccctgctggggtacacctcagtgtacacgggcgaggggtcctggttccaggcgacagggggcacctacaggggaaggcccgtcacgcgggcg

SEQ ID NO: 643110 - DNA, 400 bp, Homo sapiens
  misc_feature (12)..(12): n is a, c, g, or t
  misc_feature (17)..(17): n is a, c, g, or t
  misc_feature (237)..(237): n is a, c, g, or t
  misc_feature (310)..(310): n is a, c, g, or t
  misc_feature (342)..(342): n is a, c, g, or t
  misc_feature (364)..(364): n is a, c, g, or t
  misc_feature (380)..(380): n is a, c, g, or t
ttcaaaactggnaaatnattaattgctttagccaaattacattgtaattaaatcaagaaggaagaagatctaagagctccattgataggcaagcctagagagaactagctaatttatcatgctaggatattgaaacacagaaagtttacatacatttatgaagggcaatttagtttggacagtgaggtatttgcttagtggaaaaaaggagaattagtctgatcaaatcgtgaagtnatacagtgaacttcaggtgcactaagagggccacatctatatggtgcagctggaatctggttaagtttgaggnacctcttggcctctgaattgatccattgcatnacccagacatttacatagatcngacggtccgatgcacngagacacctgttggactggc

SEQ ID NO: 643111 - DNA, 1056 bp, Homo sapiens
  misc_feature (972)..(972): n is a, c, g, or t
  misc_feature (1020)..(1020): n is a, c, g, or t
  misc_feature (1023)..(1023): n is a, c, g, or t
  misc_feature (1029)..(1029): n is a, c, g, or t
tgggtctaggtagaggctgggtgtttaatcggccgaggccgggaaggggttttatgctgctccgtcatcgtgcggccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccagtgattgttggatgattgaaatgatgtgatgtgcagctgactgtgtgtgtgcgtggtcaactgtggtgtgatgtgccaagactgtgcacatgactgtgctgtgctgtgcatgctgtgctttgatgcacatccccaagcatgatgatgcttgcgacagcatgtcatccattgcgagtgacatcaatgtgatgcactgtgataacatgctatgatgaaactgctgtgtttcaggcaaggagccgagattcgtgctgcgggccctgcggatgctgccttccacatcacgccgcctcaaccactatgttctgtataaggctgtgcagggcttcttcacttcaaataatgccactcgagactttttgctccccttcctggaagagcccatggacacagaggctgatttacagttccgtccccgcacgggaaaagctgcgtcgacacccctcctgcctgaagtggaagcctatctccaactcctcgtggtcatcttcatgatgaacagcaagcgctacaaagaggcccagaagatctctgatgatctgatgcagaagatcagtactcagaaccgccggggccttagaccttggtagccgcaaaagtgttactattatcacgcccgggtctatgagttcctggacaagctggattgtggtgcgcagcttcttgcatgctcgggtccggacagntacgcttcggcattgatgcagacgggcaggccacctgtttgaacctcntgntggganttactacactacagttgacgacccgct

SEQ ID NO: 643112 - DNA, 1050 bp, Homo sapiens
agcccgggaggcggaggcgggaggcggcggcggcgcgcggagacgcagcagcggcagcggcagcatgtcggccggcggagcgtcagtcccgccgcccccgaaccccggcgtgtacttcccgcctgcccgggtcatccctgaccgccggctcccgacatcctgcggacctactcgggcgccttcgtctgcctggagattctgtatcgggggtacttcgtctggcatttcggttgcctacctccaatgttcctctaacctactactacaaggatgggctcatgtaaagtgtaccagctgacagcgtatccactattaacgctacctctcatctgggacatgttcctctctggcatggtggctcaaattgatgctaactggaacttcctggacttcacgcctaccatattacagtatattgccttctataatcggagcctctcacatcggaagcagcagccacatccctgcatgatccgcatcgccatacaaccataacccgggcacgccactcctgacgtgataaccagtatacccataaccgtaccagcctcaatcaccgcctttatgacgaccagctagacatggtcgcacgcgggtctggccttacgaaccatggcgaccgcaaacactccttacaccctgccccgtcggcatgtaacacccactcgctctacccatatctctgaccacccggcatacaaaacgacccacgatgccaacaacccttccacaccgtcacgcgcccgccacagcgagaccccaaccccagctcagccccacccagcgccgcacaccaaaccaccagaccacccacccgcacaccaaacaacccccccccattccgtccccgcaacaaaccacccgcgcacgcacccccccctccgaacaccaacccccaacggctcccacacacccacgggccccccccccccggcacccccatcgccacaccgaacacacgccccacggccaaaccgcgccgcaaaccacagaaccccacacacccacgcaaaacacccacccacccacacgccccctgccatacacccc

SEQ ID NO: 643113 - DNA, 147 bp, Homo sapiens
aaataaaaccggggggtcttggggccccttaaggggggattgaagggttttccccttccgggcccggagcaaagggggggggcgactttggggcccgggttgggtcccaagttggggggcttgggggttttttccgggtttttggta

SEQ ID NO: 643114 - DNA, 576 bp, Homo sapiens
  misc_feature (60)..(60): n is a, c, g, or t
  misc_feature (65)..(65): n is a, c, g, or t
  misc_feature (427)..(427): n is a, c, g, or t
atcctgtttgagctgctgagctggggggttctggctggtccctagtgccgatgggcctgncctgnctacggtgatgtcccaccctctgagcacatcttctcacgcccttccaagcaatccctgtgctgctccccctctgaagatgtcttttcagttcagcggagcctcaggccccctgggaattgagctggacccgtgctgctgcccctgcatcgcagacacgctcttccctccctgccttcacggggcctgcaccttcaccatcaccgccaccatcgtccctgtgctgccctgggtgtggcggtggcacgtgcaaagccagtgtgtgctgttgctcaccatgtcatgagtacacacttgttgtttacacagattatccccctgtgatcctggcagcaaacccacaagctggttgtggccccagatnctcagacgaggaacaggggcagccaggattagtgacctgcccgtgttggcaccggcagtggtggagagtgctccagggttcacacccaggcaggctgaccccagagcctgtggccagggcagttgcaggggcttcctcagcagctgcaa

SEQ ID NO: 643115 - DNA, 322 bp, Homo sapiens
gagtgcacgggaaggagatcgggcgtcttgcaggcagacgtatttccttctatacctagagtgctttcggggggatggttgaatgtttgttggttttgagatggggtttcactcttcgttgcccaggctggagtgaagtggcgcgatctcagcccactgcagcctccgcccgccatgtttaagcgattctcctgcgttagcctccctagtagctgggctaacaggcgcgtgggaccacgcccagctaattttttgtatttttagtggagacagggttttaccatgttggccaggctggggttgaacttctgaccttaggtga

SEQ ID NO: 643116 - DNA, 439 bp, Homo sapiens
  misc_feature (4)..(4): n is a, c, g, or t
  misc_feature (6)..(6): n is a, c, g, or t
  misc_feature (11)..(11): n is a, c, g, or t
  misc_feature (13)..(13): n is a, c, g, or t
  misc_feature (27)..(27): n is a, c, g, or t
  misc_feature (33)..(33): n is a, c, g, or t
  misc_feature (64)..(64): n is a, c, g, or t
  misc_feature (68)..(68): n is a, c, g, or t
  misc_feature (79)..(80): n is a, c, g, or t
  misc_feature (87)..(87): n is a, c, g, or t
  misc_feature (90)..(91): n is a, c, g, or t
  misc_feature (106)..(106): n is a, c, g, or t
  misc_feature (112)..(112): n is a, c, g, or t
  misc_feature (114)..(114): n is a, c, g, or t
  misc_feature (120)..(120): n is a, c, g, or t
  misc_feature (135)..(135): n is a, c, g, or t
  misc_feature (145)..(146): n is a, c, g, or t
  misc_feature (186)..(186): n is a, c, g, or t
  misc_feature (188)..(188): n is a, c, g, or t
  misc_feature (194)..(199): n is a, c, g, or t
  misc_feature (205)..(205): n is a, c, g, or t
  misc_feature (225)..(225): n is a, c, g, or t
  misc_feature (227)..(227): n is a, c, g, or t
  misc_feature (265)..(265): n is a, c, g, or t
  misc_feature (272)..(272): n is a, c, g, or t
  misc_feature (278)..(278): n is a, c, g, or t
  misc_feature (283)..(283): n is a, c, g, or t
  misc_feature (285)..(285): n is a, c, g, or t
  misc_feature (317)..(318): n is a, c, g, or t
  misc_feature (329)..(330): n is a, c, g, or t
  misc_feature (333)..(333): n is a, c, g, or t
  misc_feature (373)..(373): n is a, c, g, or t
  misc_feature (375)..(375): n is a, c, g, or t
  misc_feature (381)..(381): n is a, c, g, or t
  misc_feature (386)..(386): n is a, c, g, or t
  misc_feature (390)..(390): n is a, c, g, or t
  misc_feature (395)..(395): n is a, c, g, or t
  misc_feature (409)..(409): n is a, c, g, or t
  misc_feature (411)..(411): n is a, c, g, or t
  misc_feature (420)..(420): n is a, c, g, or t
  misc_feature (425)..(425): n is a, c, g, or t
  misc_feature (427)..(427): n is a, c, g, or t
  misc_feature (437)..(437): n is a, c, g, or t
taangngtgcncntttattcaaccggncccaantcaatgtacaggtaagccccggccgcccccncccncccccagggannccaaaanccnncaaacaccccaagtngggggncnaaaaanggggaagggggggcncgaaggcccnncattcaaaaaaaaacaaaaaaaaaaaatattaaggccaananctcaannnnnntttccnttacaaaatttacacgaaancnatgctaacaccccccccgtgtggacttgggagaggacngggccantccccntaaananaagtgggggggcttttaggatggcaagggacnncccttaacaanncancccaaatttggaaaaactaaaaaaaaaacaacaatgtgcnancaaagnccccngccncattntgaaccttgggggntnccccccccnacccncngccgtcaccntc

SEQ ID NO: 643117 - DNA, 479 bp, Homo sapiens
  misc_feature (385)..(385): n is a, c, g, or t
  misc_feature (410)..(410): n is a, c, g, or t
  misc_feature (479)..(479): n is a, c, g, or t
aaggagattctgaatgatgctgccattgccagaccttctgctaccaaacagagcgaagaggaagagggggcagtgtttggtcaagacagcccacgaaacgttggcgggagtgagcacattagcaatggctaagaacatgcttgaatcatttgtaacaacccaggacagagatgccacaagaggactttggggaaaggcgaatccactcatacatcttggagttgttttttcaagttcagaaaatgaaccttcaccaaggtcttggaacatgaagcagagactctggtgctgactctatcatttgagctcctaagggtactcatgcccagtggagcatgcacaccagcaacaccgccaacaccatctcggtgtcccaccccttagnggaggaagaggacacagaggggcgnccggtaataaccctcatttcctctcttccaccccaccacatcatcttaataaaacatgatcggccaagn

SEQ ID NO: 643118 - DNA, 363 bp, Homo sapiens
gagtagcacggataagacatgcagatacaggttgctctgagattctccactgcacattatagccaaaatgtctaaagtcaaaacaaagagagaatgctaaaacagcaagagaaaagcgtctagtcacctatgaaggaacccccatcagactaacagtagatttctcagcagaaatcttacagaccaggagaaaatagaatcatatattcaaaatactaaaaaaaacttctgccagtcacagatactatactcagcaaagttagccttcataaatgaaggagaaataaagtcttctctagacaagcaaaagcagagggaattcatcaccactacacaagaactacaagaaatgcctaaggaatc

SEQ ID NO: 643119 - DNA, 396 bp, Homo sapiens
cagctatctagaggatcccgcgctgattctgttgttgaccgcgattctgatcatcgccccgcaggaagcggcaggatgctcggtgtggcccaagcctggttgtcgaaaagctttggctggtactacatggtcgtgatcgccgcctacctgctatttgccccacgggatggcgctgtaaagggcatgtactcgctcgctgcgtccttggccggacagttgggcgactcatggattgccgcctggcaggtggctccagatgaagaccgttatgcgctggtcgcggttgaccaaggcgcggtcctacccggctgtgatcaggtcggcagcgcggaagatacaacgcggaaagtcgctcagatgctcggcagttcgatttccttcaaggacgtctatctg

SEQ ID NO: 643120 - DNA, 118 bp, Homo sapiens
gtctagaggatcccgggtctcattggttgctaaaaagcaaagggaaaggaaaactcttcagcgcaaggtgaaacgactaagaagcaagaggaaaaggagaagaagggaaatgggaaag

SEQ ID NO: 643121 - DNA, 946 bp, Homo sapiens
  misc_feature (3)..(3): n is a, c, g, or t
  misc_feature (72)..(72): n is a, c, g, or t
  misc_feature (94)..(94): n is a, c, g, or t
  misc_feature (98)..(98): n is a, c, g, or t
  misc_feature (114)..(114): n is a, c, g, or t
  misc_feature (118)..(118): n is a, c, g, or t
  misc_feature (134)..(134): n is a, c, g, or t
  misc_feature (160)..(160): n is a, c, g, or t
  misc_feature (369)..(369): n is a, c, g, or t
  misc_feature (374)..(374): n is a, c, g, or t
  misc_feature (442)..(442): n is a, c, g, or t
  misc_feature (453)..(453): n is a, c, g, or t
  misc_feature (459)..(459): n is a, c, g, or t
  misc_feature (461)..(461): n is a, c, g, or t
  misc_feature (517)..(517): n is a, c, g, or t
  misc_feature (519)..(519): n is a, c, g, or t
  misc_feature (529)..(529): n is a, c, g, or t
  misc_feature (534)..(535): n is a, c, g, or t
  misc_feature (538)..(538): n is a, c, g, or t
  misc_feature (562)..(562): n is a, c, g, or t
  misc_feature (570)..(572): n is a, c, g, or t
  misc_feature (596)..(596): n is a, c, g, or t
  misc_feature (608)..(608): n is a, c, g, or t
  misc_feature (614)..(614): n is a, c, g, or t
  misc_feature (618)..(618): n is a, c, g, or t
  misc_feature (623)..(623): n is a, c, g, or t
  misc_feature (627)..(627): n is a, c, g, or t
  misc_feature (640)..(641): n is a, c, g, or t
  misc_feature (645)..(645): n is a, c, g, or t
  misc_feature (651)..(651): n is a, c, g, or t
  misc_feature (659)..(659): n is a, c, g, or t
  misc_feature (664)..(664): n is a, c, g, or t
  misc_feature (668)..(668): n is a, c, g, or t
  misc_feature (680)..(680): n is a, c, g, or t
  misc_feature (688)..(688): n is a, c, g, or t
  misc_feature (743)..(743): n is a, c, g, or t
  misc_feature (791)..(791): n is a, c, g, or t
  misc_feature (939)..(939): n is a, c, g, or t
ttngcagtatgaaacaaagtcaacattgctgcattaaaaattcatatatgagcagaacagctagtgtttgcngagggtagttattttaattttnttcntctcttgaagattganagcnttcagaaatgtaaggncatacatggaaatgtccttataaggngcctcgaaaatgggacagattatatcattcctgaaggcatataccttttgttgagagagagattccaggtagatagcatattcaaaaatcccttcttagcaaaagagagacaagtagttaaaactcttgatacttcagagttgctacaaatttgtttttcccttttaaagtaaaatgactcacgatgtggaaatacagtggatagagtnctggngcagaagccacctttatgcccaataatagagagtaaatacatatatacccaatgacaatcattgtgcnccgtaattgtntgaccngngggactataaatacacatttaataggtaatattatcaagacacatttccatataananagttactgtntttcnntcncccctttcaaaaacaaagacttcnctgtcaannntccattatcaatcacttgccactntagcagccagantctggnaacngaganaggnaatagcacttcannacangcacantctaacanctganagtncattcacaaganagattttncaaacattaaagcatctaacacataatacgaatgttttcagcagctcatccagtnatcacctgatgacatttattactgaatattacatacatacattctgtntggcagatagagtcagtacagacaaaacaaaatctgccttaggctgtgtgataaacctatcatacctccatcatcaaaaaaccttcagaataatttgggggatgcttacaaatgcattcatatacacaaggagctggaaatcttaatntgttgcc

SEQ ID NO: 643122 - DNA, 427 bp, Homo sapiens
  misc_feature (98)..(98): n is a, c, g, or t
gggggggggtggtcttttctttaaaccccccccggggcccaaaaaagggtttttttggagggtttttctttttgggggggggcgcccccggggggggnaaggggccccccccccttctccggggcccccctttccccaagggggttctcttttttttccccccccccccggggggggggggggccccccttttttgggggggcccctaaaaagggccccccccaaggggggtttttccccttccccccccggggggggttttaaggggagagggggccccccccccttcccttttcctcccccgggccctgggggtttttttttttttttttttttaaaaccccccccccccctgttggggtttttgggggcccccccccaagggggtttttttccctttaaaaaaaggcccccccccgggggggga

SEQ ID NO: 643123 - DNA, 361 bp, Homo sapiens
agccgcaccgctctcgtgaactccaaagagagctttatcattactgcacctgattttgctcattaatctacgtcaccttccctaataaaagtcatgtggactaaagtctaggggcctctgttctgcagaacagagtgcctcctggtcccccactttctagatgtaaaagagtcttgtgtgttttgttatgctgtgctgtccctctttcaggatctcctgttgccctgcagtgctggacgcagcacctgtggataaccaggagtttgagtgagggtgttgtcctttctcattctgatatttgaggtttctttgcctaagagctctccaacacttgatcccatgttaatcgtctcagtgtgcc

SEQ ID NO: 643124 - DNA, 410 bp, Homo sapiens
  misc_feature (108)..(108): n is a, c, g, or t
  misc_feature (285)..(285): n is a, c, g, or t
  misc_feature (307)..(307): n is a, c, g, or t
  misc_feature (385)..(386): n is a, c, g, or t
tgtccccagacccctccttgccccagcaccacccagcttgccttgggtgcctcagccccttcccaattgggagacaggtatggggcgaaagctggaagggcccgggcnctgagaggggcaaaagtgattgcatggtttcataaagattatatgttcccaatgtgggcggttagctgcatgtgtgaagattataagttgtcaaagtcatttccatgatttcgtttccctactgctgtgagagaagtggtcacaatgtaccaaaaggtttctctgtgtatgtttgtntagtataatagtcataataaangtatgatataaaatatagcagaagctggtcacttctttttgaaccttatagtccatctccaggcaagaaaagagaaannataaataatatttaaaggagagca

SEQ ID NO: 643125 - DNA, 347 bp, Homo sapiens
acgatctagaggatcccatgggagaatgggcactcaaagaaaagaaaaatcggtacgtagaatgcatacgtagtctcaagagaccctgaatagcagaaacaatctggagaaagaacaaggtggcaggactcccacttctgattaactacaaagctaacatagtcaaaacagcggggtactggcgtacggacagcaatagagaccaagggaatagaagagagggcccaaaaagtaagtcctcacatattgggtcaaatgattttccataagtatgacaattcttcattcaatgaggaaaagacagtcttttcaacaaatggcattggaaaaactggatatgcacattc

SEQ ID NO: 643126 - DNA, 365 bp, Homo sapiens
  misc_feature (61)..(61): n is a, c, g, or t
ccaccccacgcaggatatatgcacacctgagagggagagccaactcaagaaccaacctgcncttgttgagctcgtgaaacacaaggtagagaagttctccaagcctcacaataagaacacttggccgagaagggtaaaaaccttgttgtcgcaagtcaagctcctttaggcttataccttcccttttaaaagcttctcagcctcccttgagaataagagaaagaaattgaggttcaaaggcttattcatcggtttttctttttcgtgggtgtaaagcccacaccgtgttataaaaaccataaatttctttaaccatttgcgcctcttttctctgcgcctcaattaataaaaaatggagagtatct

SEQ ID NO: 643127 - DNA, 565 bp, Homo sapiens
attcaccaacatacatttgggaaggcaagccaataggaacagagaaagcaaattgaaagtaagaaaaatcaaaaccaggagacaattcttcctgttacagaactaccaacaaccactagagggtgagtctgtcacactattatttattcgtaactaccaggaaggaagaaacccattatctagtgagctcatctctttctggctcccacaggagaggataatctattgtgtggagctctccaaataaaccattgtttgttctacaaaaccactcccactgtcaacaaatactcaaggttgccctgagcagaaggccctgctcacaggtatcaacatcaactatgcaacagtgattcagatggacaaagcatttagtaaaccatgaccaagatggtcttaaaataacacggaaacaggaccaggcatggtggctcacatctgtaatcccagcacttagggaggctgctgtgggcggataaactgaggtcagaagttcgagaccagcatgaccaacatggaaaaacaacatctctactaaaaatacaaaattagctggggatggtgg

SEQ ID NO: 643128 - DNA, 168 bp, Homo sapiens
ttctggtacgcatgcatttgggaggctcagaggagctgccccttctcactcaccactaccagtccagcctcagtaaggccccagagagaccctgcaggaccacggagggagcgacacttgaatgtagaataggcaggtggccctgccccaccctatccagccattccc

SEQ ID NO: 643129 - DNA, 614 bp, Homo sapiens
aatagtatctgggatatgtccatcaccagactctgagcttaataaggcagctgaatgaagggaggtaacggacccctgagaggggcactgaagtctgcagtggggggggaggggcctggacacaccccttcccccccagactcctccccgtcagggtcagctcagccatggactttggacctggataacgaagagagaagctgcactttggtggatctgatttgggattctcagcttttgcaaaagtggagtgctgatagtggggtatttgtatgatctcctggagcagcaactgtagcacaagagtaatgaaaggtgcatgagctgccgtcctaatcccatatgtccaggaggagtgcatcgcctaggaactgcggtgctaagggacgccgggacaagcaccaggtgcagccttgaaaccgtcccctggacctgcactctccccaggtgggtggccaaggatgcttgaatgaagcagtcgtgcagcggcttgtgcgtgtgtgggctgctatcctctttcgtggcctggaatgccctgctgctccttcttcttctggacgcgcccagcaccttggcaggccaccctctagtcagctgctctcgatggcgaccca

SEQ ID NO: 643130 - DNA, 142 bp, Homo sapiens
taaatattgctagggtgttttccctcagcataataaaagctcttaatgttatcggttgctcttcagagattgacaattttattttataaatgtcttttgcagaagaaatattgatctcctactcaggcattctatattgggc

SEQ ID NO: 643131 - DNA, 111 bp, Homo sapiens
gaccagcgctcgccgtcctcgattgaggcagcagctctgccgtagccggggcggcggcagctggggcggcgggggccttcgcggctgtcctcctccgtgtgaagccgttca

SEQ ID NO: 643132 - DNA, 886 bp, Homo sapiens
gtgggcggccggtgtggcgcacgcattgttgtgctccaacctccctcaggtcctgtgttgccgcactctgctgctatgagcttcctcaaaagttccccgccgctgggcctatcggaggggctcctggcggtgagaagccgagacaactgaggctggtgctgaccgggaagggcctcgggatcccgctaccctttacatcgctgagaagccgcctgtctggttaggatggctctggattagggattctcactggaataccccagcgcattagtttacatgcattatccagggaccgaagtgactgtctaggagagcattgtatgtatggtgaatgccacatttgacgaagaatcaataagaacctgtgtgcttgatgaagaatgagggaacgacagtgatgatgagtgttgaacctattactgaatttatgaatttgtgcctaggtgataaattcaggcgtgggacggcgatgtgcactgcaatgtgcgaaatgccaaggcgcttgaattccaagatcctgaggagtgaggaattcagatgacctacgagtggaggaagaatatgatgtggaagctgattgaacaagggacaggtggacatcccgtaccattttcacaccctatgatgaaggattattcccatctaaacgagcaagaaggtcaaagccacagctggagaagattagaacggaaatgcttctcaggctgtgaagcaggcagtataatatggctggggtcagacagacaattcactcacgacgatttgcaagatgggtggcgggggtcccacccacacggtcgcggcagttgagttcatttggtcacgcaagatttgcagtagacatgcctgtggggaaaaaagggctcccttggtgagaaagaacgtc

SEQ ID NO: 643133 - DNA, 389 bp, Homo sapiens
atctagagatccccttgccaggtctctacctattcacatccaggcctgggccccgggctcataaatctcgcaggaagcgctctcaggaaggacgctacgggccgggggcagcctcggagtggaatgaagagggttggactctgagaatgactggccccagccagattccccggggggcagcccgtcggttgggaagtctccttcccggcggggcctgcacacccacccctccggccacatcagccccaatatctctgcatggagcccagggggcaccttcccttccgtggctcagagagcttcagagacagacccttactccgtgcatggatgtccatccaagggagggggctcaggctgtcccttccagctcacgaaataggtagaga

SEQ ID NO: 643134 - DNA, 685 bp, Homo sapiens
  misc_feature (28)..(28): n is a, c, g, or t
  misc_feature (127)..(127): n is a, c, g, or t
  misc_feature (131)..(131): n is a, c, g, or t
  misc_feature (148)..(148): n is a, c, g, or t
  misc_feature (155)..(155): n is a, c, g, or t
  misc_feature (162)..(162): n is a, c, g, or t
  misc_feature (165)..(165): n is a, c, g, or t
  misc_feature (176)..(176): n is a, c, g, or t
  misc_feature (182)..(183): n is a, c, g, or t
  misc_feature (200)..(200): n is a, c, g, or t
  misc_feature (223)..(223): n is a, c, g, or t
  misc_feature (229)..(229): n is a, c, g, or t
  misc_feature (236)..(236): n is a, c, g, or t
  misc_feature (245)..(245): n is a, c, g, or t
  misc_feature (249)..(249): n is a, c, g, or t
  misc_feature (264)..(264): n is a, c, g, or t
  misc_feature (268)..(269): n is a, c, g, or t
  misc_feature (271)..(271): n is a, c, g, or t
  misc_feature (273)..(273): n is a, c, g, or t
  misc_feature (276)..(276): n is a, c, g, or t
  misc_feature (300)..(300): n is a, c, g, or t
  misc_feature (309)..(310): n is a, c, g, or t
  misc_feature (322)..(322): n is a, c, g, or t
  misc_feature (325)..(326): n is a, c, g, or t
  misc_feature (334)..(334): n is a, c, g, or t
  misc_feature (339)..(339): n is a, c, g, or t
  misc_feature (349)..(349): n is a, c, g, or t
  misc_feature (397)..(397): n is a, c, g, or t
  misc_feature (403)..(403): n is a, c, g, or t
  misc_feature (406)..(406): n is a, c, g, or t
  misc_feature (436)..(436): n is a, c, g, or t
  misc_feature (509)..(509): n is a, c, g, or t
  misc_feature (523)..(523): n is a, c, g, or t
  misc_feature (624)..(624): n is a, c, g, or t
tcccaagcactgatcccacatccctgtnagcagatgcctggtcccacccaggcctggataccacctcccatggccctgaggctgggctgcagtttcccgacagcctaggaccgctgggactgctgcntctncctctgctctgctcttnccaaggncaaggtngcnctgcttctttnccaacnncaccccccccacatgcnccagggtccctcctgtacatganagggtnaccactnaccagtttntgtnggggcctcatctgtnattnntngnggngcccagcccggggtaaccactacncccccatcnntcgttgctgttnttnntgctccangtttngttgcagganctgctgctggttggtaatgacacgccggatgctgttgacaaagttgcnctggtnatnggggatgaggccaatgaagatttttttctntgaagagtacaggagcataagcacgcggatcttacacgatgctttgtaggaaaagtgcacgcagccggcgaanattgttcatgatcnggcacaggctcttcagtgtctccaggtccttggtgaagtggaactggaccaggcgcgagttccggaacagcggcactagggtggtcagcagctgctgcggngatgagctgcatgtacagcttccttggccactgctcggtcctcaggatctccccctggttc

SEQ ID NO: 643135 - DNA, 643 bp, Homo sapiens
acaaagtgctccacgtctctgttcgagtgcggaagacacgttagacaccgtcaaagaaagtgccataagtgcaatgccgcatttggtgccaacgactcccaccgcatatacatcggatgaggcttgtgaatcacagcatctgcatctgtttggtccagttcctcagcattgttctgcagttggagcatgtcctgtattggccgagcatcaagtgttttacattccatttgattcgctcttcagaaaacaaccgacatgttgattagacgtcccagcatcggtttagcagaactaacccggtcacattccacaggtctgtcttagccaacgtttctcacaaaagctgctgcttgcctcaaggactgtcctcaagggttgtttactttttttgagttaaagctgcctcgaccagatctcccattccagcttaacattaacttaactacccagaaccaatgtgaacccatgaacacgagtgagcctacagacctgtctttgaaaacaagctgtctagtcaactgggcagtggttcatttgctgaaaagcttgtattgtaatttttgtattgtctactttttttgactgcctgtagtgatggatgtgcaaatgcttcattgaaatacattaaaaatctatgtatgta

SEQ ID NO: 643136 - DNA, 346 bp, Homo sapiens
atactatacactcagttcgtacctgtgggtagcagcacctaggtgatcagttttgcaggtggtaaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgctgaaatgaggtcattgtgcccgcaggttgtttgtgattagctgtttctaacaattgttcatacaataattgttcattattgttctcaacttggggctctccccaacctggggacccttcctta

SEQ ID NO: 643137 - DNA, 203 bp, Homo sapiens
gctcgagcagtggtgggagaagctatagggtatgacagctggagggagtgagggaatgtcacccacagctcttttgtcccccaggatgcgtcgtgcgcggaatggtgagtagatggctttgtctggccaacctggggctccacttgagcggagtggggagggaaggataggagctagttgcccaaccctttccccaacaattg

SEQ ID NO: 643138 - DNA, 622 bp, Homo sapiens
caaggatatttatctttctgtggctactgtgaatgggattgtgttcctgatttgggtctcagtttggacattattggtatatagaaaggcaactgatttttgtgcactgattttctgtctagaacttgctgaagttgtttatcagatcaaggagcttttaggcagagtctatggggttttctaggtataccatgacatcatctgcaaacagaaatagtttgactttctctctttctatttggagctctagaatttccagtactatgttgaataggagtggtggaagtgggcatccttgtcttgttccagttctcaaggggagtgcttccagcttttcctgttcagtatgatgcaggctgagggtttgacatagatggttcttattattttgaagtatgttccttcaatttcaagttgttgagggtttttaacatgaagcgatgttgaattttaccaaaaccctttttttgcatctgttgagatgaccatgtggttttttgtctttagttcttttatgtgatgaatcacattcattgatttgtgtatggtgaaccaattttgcaacctatgggtaaagactatttgattgggttgaattagctcttggaatagctggggtaca

SEQ ID NO: 643139 - DNA, 1143 bp, Homo sapiens
  misc_feature (290)..(291): n is a, c, g, or t
actgaagctccgtcacacccgaagttggacctaatctagtcacccgtatagaagaactaatgttagtagtaagtaacgatgagaaacagttcgtcctccgcgatagagcgctgctgtcatgattagaaagcatctgagagctgacaagttgaatcagcccgatatatctacaagtgcaaccaagcaagtcattattaccctcactgtcaacccaacacaggcgatgctcgattaagggaacaggttatgaatagaacagtaaaagggaactcggcaaatcttactcccgnncctgtttaccgagaaagacgatctacctctagcatcacgcagtattagaggcgaccgccttgtcaccgagtgactacatgttataacgggccggcagtacccctgaaccggatggctaaacggtagccatccagtccacgttgttccgttaattagaggaccttgtatgacatggcgtccacgtagggttcacgctcgtctctgtacgtttgtaaccagtgcaaattgacctgaccgcgtgaaggaggcgggcatgacgacaggaagaggagaagaccctatggagctttaatgtattaattgcaatacagtacctaacaaatgccacaggtcctaaatgtacgcaaagctgcatttagaaatttcggttggggcgacctcggaagcagaacccgagctccgagcagtacatgctagagacttcagcagtcaaagcgaactactatactcgaattgaatccgatagcttgaccaaccggaacaagtgaccctagggcattacagcgcaagcctatgctagagtccctatcaaggataggagttaagaactcgatgttggatccggaatcccgaggggtgagccgcaattaaagggcgttgtcgacagataaagcccagggagcgggagtcagcgggaggaaacccgggcggggcaacacgacgctaaaatccccccggtcgaaacggcaagagaacaaaggcgcacaaagacgggccgcgaaagaacaccaccatattataaccccccccagaaaaggtgtgtcaacaaaaaaacgacaaacagaagagcggggacaataacagcgacagagacactcagaagacacgagcataaacacgcaaaaaaagcaa

SEQ ID NO: 643140 - DNA, 702 bp, Homo sapiens
gggttgtgtgaaacacccgggttgtttgccgctttataaccaacatgggaacacgatgttggtggaaaccacccgtgggtgaaatttgttcctaactgtggaactcccacaggcttttacgggcttttcgccacgaatttttctcagccccctctttgtggcgcttcaaccaaaaacaactctgtgggaattgttgtcaccacacgggtatacaagagagaaagatgcgcacaagttttttctcggagggccctctaacaggattttcccccgtccataggttaatacccacgagctctggagtttgtcgtgaggacacgaggataattttttgagaaatgttgggtgcggcccttaaatagggcacgggcttcttagaagaagacacttcgagtataaagagtttttcacggagaatatggcactcccctcctcggataatgtttcccctcttggtagtcgtccgagaggagtgccacgcttctaatggttgtgaaacgcacaagcactttttataaagcttccacgctcccacgagaacctcgctgtgaaaattaagaagacacagagttccacccctatgaacatccgggattttggccttttttgtattgggaaggttaaccctgttccaatttttttcctaatcccatttggttttgctcggggtaaataggggagcaggggtacccttttggttta

SEQ ID NO: 643141 - DNA, 229 bp, Homo sapiens
ataattgtggcgataatgcagtttattttattgttagcattgtcatagcgagaaatagtatggtatctggttaaaaaacaaactattaaggggtaatggcaactacatgttcaatttcaaattgacaagtaaatattgagccaatgatgcactttactaaaccagaaacagggaactgtcttacgttgtctgagcacagaagggactcagcgatactcagagattcttc

SEQ ID NO: 643142 - DNA, 234 bp, Homo sapiens
ttactagcatgccaacctcaacttatagtgaaggaagcactccactaacaaatatgtctttcagcaccacgccagtggtcagttctgaggctagcaccctttccacaactcctgttgacaccagcacacctgtcaccacttctactgaagccagtttatctcctacaactgctgaaggtaccagcataccaacctcaagtcctggtgaaggaaccactccattagcaagtatgc

SEQ ID NO: 643143 - DNA, 298 bp, Homo sapiens
aaaccgtttattatccttttttcccttttttggttttaaagttagggtttttactcccggggtttttttggaaattgttccccttagcctaataaaaatttgtttttttggtactcccctttgccctttcccccttttttggttttttttttcccccttttccgccttttggggggaaattttttttttttctttttgaatttacctttttaccttttccctctgggttgtttttgggtttttaaaatttttttcttttggattgttttgccaattccattaaattttttaattttga

SEQ ID NO: 643144 - DNA, 116 bp, Homo sapiens
aattcttgacttcgtttttgaaaacttacttcattaaaataaattttttttagagacaaggtctcactgtcttgcccaggctggtcttgcaatcctgggctcaagcaattcgcctg

SEQ ID NO: 643145 - DNA, 453 bp, Homo sapiens
ggcactgtagtcccagctactcagtgaggctgaggcaggaatcacttgaacctgggaggcagaggttgctgtgagccaagatcacaccactgcattccatcctgggggatagagtgagactctgtctcaaaaaacataacaaaaaaaaaaaaaaaaaaacaaaaaagcccctccaaaattgtgagaattaattttcgggttttttttggtttgtttgtttgtttgtttgttttttacgcagtctgtgtttttctgttaaggcggcacaaaacggactaaaacagcccctttgtgacttgcaaggttgaggctgcaccctgcttattccagcaaccagcagggttgttttgggacgctccaggattcccttgtgcctggtacctcttgacttcacagactggctctttctctttggtttgctgcgtgcccatttgcttggcgggggatcctcta

SEQ ID NO: 643146 - DNA, 107 bp, Homo sapiens
gaggccacacatgtttattaggacggtcctgacacctgcctgcggggaaggaccaccgagaccagaacctgcctgccatggggtgcggggacagaccggtgcatggc

SEQ ID NO: 643147 - DNA, 182 bp, Homo sapiens
gggccttggacatgatataaataagttccctgctcttcactgacacttcaagacaatagtctatccctttttcgtccctaaaatcttttcaattgttgtcaccagataccagctaccactccctcctgccgtcatccaatgatctctgccaccatccacatttcgtaaagatttcagtggct

SEQ ID NO: 643148 - DNA, 302 bp, Homo sapiens
tgcctgtacccctggagtgatgcaacttcccagtcctgagggatatgtcttgggcctccacaaattcacccaggctctgatggaaacactgatgctaggtggtcggctgggctccctcaccaggcctggcagagggctcagctcagaatcagctaagcagggctttaaatgcatcatctcattactcctcaccacaacctatgaggtaggtttttttatttttatttttatttttttgagacagagtctcactctgttgcccaggctggagtacagtggcacgatctcggctcactgtaacc

SEQ ID NO: 643149 - DNA, 183 bp, Homo sapiens
tcgatacgacttctatcttttatttttctctctgtatgtatagtaggcacagcggtgtcgccgcgtaaagcagtatagtgtcgatctcctgacctcgtgatccgcccgtctaggcctcccaaagtgctgggactgcaggcgtgagccaccgcgcccggccaacgtcattttcttttcaggagt

SEQ ID NO: 643150 - DNA, 308 bp, Homo sapiens
  misc_feature (21)..(21): n is a, c, g, or t
gggcacgtcgcccgatgaatngagtggccagccagtgccattccactccactcaggttcttcagggccagagcccctgcaccctgtttgggctggtgatctgggagttcaggtgggatgctcacagcctccttcagaggccccaccaatttttaggccatttcccagtgtgtggaagctcatgtgggcccctcagggttcatgcctgggaagtgttgtggtgggggctcccaggaggactggcccataaagcccttagaaatcggggatccttaattggaattaatcatacgtggtctccccctgcga

SEQ ID NO: 643151 - DNA, 547 bp, Homo sapiens
gtgggtgtccgccttcccccccccaaattccacaccccgcccctttcccggatggaattttttgggcctaatcatgtggtcccccagtcccgcttttgggactttgtatctccgttaaaaaacatgaagaagttttcaggggagattgtttactgtgggcaggtgtttaaaaagtcccccctgcgggtgaaaaattttgggttttgggtgggttataattcccggaagggcccccccaacatgtaccgggaaatccgggcccttccccccccaggggttttcacccagtgctaccaaaaaatgggggcccggccccgggcccgagccccctccatttagtttattaaggtggaggagttctcggccaacaaattcccccgggccggttgttaaacagttccccgattccaagattaagttccccctgcccccccgggtcttgggccgttagcccaaaccccgttttccccccaaaaggccccacccctttttttaggggcagggcccttgtccgggggggccccaaaaaaattcaggaacgccccca

SEQ ID NO: 643152 - DNA, 266 bp, Homo sapiens
agatggaatttcactcttgttgcccaggctggagttcaatggcacacaatctcggctcacggcaagctccacctctcgggatcaagcgattctcctgcctaagcctcccaagtagctgggaatacgggcatgtgccaccacacccagctaattatgtatttttagtatagatggggttgcctatgttggccatactggtcttgaattatggacctcaggtgattcgacccctgggcttccaaagggtaggatacagattctcctca

SEQ ID NO: 643153 - DNA, 1352 bp, Homo sapiens
gaggcgttgagtgcagccagtgcaagggcttctgctgagtgagtgcgcaggcgcgagcttggaggaagaacgcagatagagtattagtacttcctcttgcaaatgatagaggcattaataccaactacttaacaaaatatagtcaataggttacataagatcatcgcttagcgtcacaggtttttaaccgtaaatttccaatagcttaagcatttttagagacgaaacatctgcacaggacattcagaaagcagtcagcctatgacgcgcacaggcaacacgccatcaccacaggtttcctcaacacaccatgtcaccgcgcgcgctcgcaccatgcacaggcttcctttcgattggccgctcccccccactgctcattccacaccagaccccctcttgccgcacgcaccagggcacctaaccatggatgtccccccggcaatttaaactaacccaacataagacactgggccaacgggctttacctacgcaaccttcaccatatgtcgtacacgcgtgaacccttttgatgaccacggctttaacaacggctctaacgcttccttacacacacggtccgctacgccggtgactttcaccactattactactctcttgacaacgcgccgcactccctctcttctaatcaacacaccatgacaggaattccacacaccccccggaccagggcttgacgctttcaaagcacaggagcccttttgtgcgaatcgtcccccgttggaaccgccatcgctcgcatcgacactctggcgtcgtcactttcctaccattgaccctaagcttcaaccgccgccatttcatcacttacaccacagagctcgacaacgaaacacatctcgggcaacacgaatcttaccattatggcgcgaccgcttgggcctaccaggcacacctcgccaaccccacaccctcttgccccactgccccccacactaccgcacccccttcggaacccgcttggccacccatcacctgtggcacaccatgccgctaccagcatcaccgcggcacaagccgccggcaccacacacatcacccccaccctaccaacgcaacgcacctctcgtgccaccccaccttaccccacccgtctactcctaacccccctatacccctccaccaccacacacactacacactcaattccaccctctccacacaccccttcccaccctgtcttctgcacacccacctcgccccaccaccaaaactcacactcccagcccccctcacaacacacacccactagcatcccgcgctacacccatgtctcccaacctcttcacaaccacaccacttcccccatccaccaccccccccactctcaacct

SEQ ID NO: 643154 - DNA, 570 bp, Homo sapiens
aagactttaaaaaaaaaacccaaattctaagcactgactatgaaagtggcctttgagaagctggttattcattatacaaaaagtattggcccattcctattctaagattggcagaatatgtcaccctatctagcttttggagttggctatctggttcacaggtggctatttataatttaaagtggacaatcagaaacctgtttccaagaacctgtattctattccttactgagtgtcccttctttaaaatagtgttggctgaattaagccgatgggggcagttggcgttaaagtggtggcacacaagggcacaagtatatatgtacagagtttggaatgagggataaatagaaagcaagaatggaattaatggaaaagaacttcggtctgtaaggccattctctaaattcttagttaagccaaacagtccactgtgtggttggagggctcacatattacataaactctccatgagtaccacatgggcgactaattacctaaaccaggccaggctctgggaaatttcgggaaattcacaattaccagacaacaaaacaagcaccagacatc

SEQ ID NO: 643155 - DNA, 131 bp, Homo sapiens
cctagcgtagtcaattcaaataacatatacaaagcaacttatttatggctaatggaatataacacataaacaattttttcttaagtttctgtttaccatcatatgattgtgttcatgcaagtacaatcatt

SEQ ID NO: 643156 - DNA, 230 bp, Homo sapiens
tttttttgggggggaaaaaaaaaaaaggggggttttttttccccaaaaaaaaggtccttttttttttcaaaaaggggggggaaaaacccccgccccaggggttcccttttttgaaaagttattttaattgggccaaaaaaacaaaaatttttttttttttgaaacccctttgttttttttccaaaaaaaaatttgggggcaaaaaaaaaaattaaaacccaattttttta

SEQ ID NO: 643157 - DNA, 200 bp, Homo sapiens
gataaactatggagatccccaggacttttttgtttttgagatttaaagttttaagggattgtcaatagaaatcaaaaaattaatcattggacaaaggcttttccaaaaattgggggttttttttttttgttggatccatttgagtcccgcatgctgtgaaaagctgagaacaaaagcattaaattggtttttttcgggga

SEQ ID NO: 643158 - DNA, 371 bp, Homo sapiens
tacaggatcctatgtcatcccccttcgtgtgcatgctgctttaaagacacatgcacacgtatgtttattgtggcactattgacaatagcaaagacttggaaccaacccaaatgcccatcaatgatagactggattaagaaactgtggcacatatacaccatggaatactatgcagccataaaaaatgatgagttcatgtcctttgtagggacatggatgaagctggaaaccatcattctgagcaaactatcgcaaggacagaaaaacaaaaaattgaatgctctcattcataggtgggaattgaacaatgagaacacttggatacagggtggggaacatcacgccacacaccggggcctgtcataaggtgg

SEQ ID NO: 643159 - DNA, 278 bp, Homo sapiens
gaattctatttcatttattctgaatcatagcatactatatgctttcaacgtgggtagtctttcatttccggtcaaattttctccctttttattaagttacacaaagccatgcactttcttcccctcttcattatgccctgggtacaggggtttttttaatccgcatccttttgaccggctccggctttgaaagattcccccggaaatttgtccactgtgcagatctgtgtttgaaaatggccacgattaaagacatttctcagcagttaaaaaaaaaa

SEQ ID NO: 643160 - DNA, 170 bp, Homo sapiens
acggacgagggtgcgtcgagtaggaggtaggtagattgagaccatcctggtcaatgatggtgaaacttcgcctctactaaaaacacaaaaaagtagccgggcgtggtggtgcgtacctgttagtcccagtctactcagtgatgctgagtgcaggccgaatgtgcgtgaac

SEQ ID NO: 643161 - DNA, 143 bp, Homo sapiens
gaaggagtaacagcctacggagtgggagaaatatagcaaatatgctatgacaaaggtctaatatccagcatctataaggaacttaaacaaattgacaagagacaacccattacaaagtgcgtcatggacatgaatggccactt

SEQ ID NO: 643162 - DNA, 408 bp, Homo sapiens; identical to SEQ ID NO: 510459
  misc_feature (400)..(400): n is a, c, g, or t

SEQ ID NO: 643163 - DNA, 330 bp, Homo sapiens
gtgctcgctgtatcgggagccatggtgaaatgtacaacatgtctgggggacggagcggggaggacatttatacatgttaagtatggacgcacatggatgacactgcacatcatgcacacacgatacacacaacacagtggacccgttgagcaatgatgccacacaacttgtcagcatgcccgctttacaagatgggcacactagaggcccagggcagcactccacacacacaccccaaacggccgaacatgagccacgagccagatctcctagatgtcccagcggctaggctcaccactgtgtgtcctgccacagggcctggaccagagc

SEQ ID NO: 643164 - DNA, 86 bp, Homo sapiens
ggttggttggagggaggagaaaagacaaaggagcacttaaggtgcaaagcagcctattttttcttcaataaaaattgcccaagaca

SEQ ID NO: 643165 - DNA, 252 bp, Homo sapiens
gagtcgctctgggttaagtgatctcatgctcggctcctgaatagctgggactacagctgtgtgcaccatgcctggctaattttgtacttttagtagagacaggtttctccatgttgcccaggctggtctcgaacgcctagactcaagcgatctgcccgcctcggcctgccaaggtgctggggttacaggcatgagccactgtgcctggccagcttttttacttcaggtgattttttacttcaggtaatatgt

SEQ ID NO: 643166 - DNA, 468 bp, Homo sapiens
  misc_feature (21)..(21): n is a, c, g, or t
agcctatgtctgcattccccngaattctccacttgttccctggccctgctgctggaccctgctgtgtctggtaggccaactgtttgttggtgcttttgtagggttaagttaaactctgagatcttgggcaaaatggcaaggagaccccaggattcttctctccaaaggtcactccgatgttatttttgattcctggggcagaaatatgactcctttccctagcccaagccatccaagagctctcattcttagaagaaaaggcagccccttggtgactgtcctcctgcctcggctgatttgcagagtacttcttcaaaaagaaaaaaatggtaaagctatttattaaaaattctttgttttttgctacaaatgatgcatatattttcacccacaccaagcactttgtttctaatatctttgataagaaaactacatgtgcagtattttattaaagcaacattttattta

SEQ ID NO: 643167 - DNA, 1067 bp, Homo sapiens
tccatccaacaacttgagattcacttggggggtttataatacaaaagtgagaaaaaagctagttgtcgtgaggtatggcatccgtggatataatctccgtgatatagtggtaaagcataacaagagacctatttctctcaggagagttagttgacccacctcgagggccagtgacggctcttctctttccccacagcctatagtacttttggccaaagggcccagattggatgtaaaggggagaacgccgtgacgcgtaggatccggggcataaggggctgacagtctggttgagacgcttggggcaggttgggttgtccgggggaacgtaaattttcagaagagaatgggtttctcccctgggtgtgtagttagggattagggatgagcctagaatataccgcgggatggggataaccagagaggcgcctaattgtggggccacgaaacaccgggggcactggagcagattcacacaacagacagtaagtgaaatcacggggcgtacgaagcaaaaacttaacatgtggcgtggaccgttatcataatacccggaaagggactcccggagggtatgaccagcaaaaggccaccccaacgtggctgaggctcacacgtgacaaaggtacacaaacgacccaaggaagacatcagtgggatccacatgtgcgttacagagaattaacaaaccagcagtagcattcaatcacaccaagacgggttgagtctacaaagggcggtatgtgcaacaacggaacaagtgattgtgcgccttgaggcccccaccatggtagtgctatgggggagggcacaaacaagaggcacatcaatcactacgaggcagtagacttatggagcaaagaatagaactatacaaccgaacaagaggcttcgacccgagaaacgccctcagagacccgagacaacacaaagggccctatacgtaaactctcatagccatggggagccccccatcattttcacaaacgtattctttgggtaccacacatttcaacaggggggtagaaaggagcgaataggaagaatagacaaggatatagaaaagc

SEQ ID NO: 643168 - DNA, 709 bp, Homo sapiens
attgaattatgcaattctggccaaacggttgaatatgcaaaattgaaacttttccaagcttccaaattatcttttaaaagccaggattctccggtcgtggatttcgaagtgagtcttttttaagggtgtcccccctctgtgaatgtacaggcggactggtagacacagctcccttcatccatttttactctttcggaaataccacttcacacaagcttcgtgctttggtcaagacctttgtacaaggtgtcaagaaaactcatttggttgaagaacaagaggttattgaccccatcatgctggtttttctctaagcccaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaaggaaaaaaaaaa

SEQ ID NO: 643169 - DNA, 156 bp, Homo sapiens
actcaaataacgtcgaaaaagtcaatcccgggaagtgtcccaaaaatcataaaacaatgtcgccggaaaatgacgtcagcttgcctgaaagtgatgtcatcccggtcaattcctagtcaatgaccggaagcccatctcctagcgtgcataacacca

SEQ ID NO: 643170 - DNA, 671 bp, Homo sapiens
agagatagactggatggcgctgaatggcatcaacctggcactggcctggagcggccaggaggccatctggcagcgggtgtacctggccttgggcctgacccaggcagagatcaatgagttctttactggtcctgccttcctggcctggtgggcgaatgggcaacctgcacacctgggatggccccctgcccccacatccatggcacatcaagcagctttacctgcagcaccgggtcctggaccagatgcgctccattcggcatgaccccagtgctgcctgcattcgctggggcatgttcccgaggctgtcaccagggtgttccctcaggtcaatgtcacgaagatgggcagttggggccactttaactgtttcctacttcctggttctttctttctgggattcgggaaggaacccaagtatgccgcaaatacactcggggagccatcattccgtgacgagagcgtgatcatgagagttcggcacaagagcaccatctatgggggccgacacttttcaatgagatgccagcaccttcctcagagccctcctaccttgccgcagccaccactgccgtctatgaggccctgactgctgtggctactgaggctgtgtggctggttccaagggctggactcttccagcgaccaaagcccagcaaggccacatgagg

SEQ ID NO: 643171 - DNA, 109 bp, Homo sapiens
ggggaggggtccagagcgccggatgaggctgagagcatggggacaactgtcaaggcagggacagatgggactgtgggtggagggctggaagttggattgtttctctcag

SEQ ID NO: 643172 - DNA, 2955 bp, Homo sapiens
ggcacgaggctgctttctttttcctttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagcatagatgaaaatggcaagttccctggctttccttctgctcaactttcatgtctccctcttcttggtccagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccatatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagagagaagctccaggaggaactcaagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataattcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgaaaaaaaaaaa

SEQ ID NO: 643173 - DNA, 509 bp, Homo sapiens
tttccttttccaccattggcctgagagcgctgccaaatatccattcacccattctacaaaaacactgtttccaaaccgttcaatcaaaagagggacttaactctctgagattaacacacacatcagaaagccatttctcataatgcttctttccaggttttatctgtaaaagtttcttttttcatcatagctttttgtgttacataatatctcttccagggttttgcaaaaacagtgtttccaaactgctcagtgaaaagaaaggttttactctgaggataaattcacacatcactaagcagtttttcacaaagctcctttctaatttttatcttgaaatatttcctttttcaccgtaggcctcaatgcactcccaaataactgtttgcaacttctgccaaaagggtgtttccaaacagctccatcaaaggaaaaaataatcactgtgaaatgaatgcacacattaaagcactgagacaaataagtatctcagaaagcttctgtacagt

SEQ ID NO: 643174 - DNA, 232 bp, Homo sapiens
atccgaagctcaatgtttcggaatgcctgaccccagcatgagctttgcccgtcgggccgcgttcggatgtatcttaaattcagcggttaaacgtccagggtatctggcgcagatacaaatgaccgcctacgatacgcgccatgttttcagggagcgtgttcatgaagaagtcattggtggtaagtggtttggttgcagcaatgctgctggcgggttgccagtcggtcaatac

SEQ ID NO: 643175 - DNA, 4004 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaa

SEQ ID NO: 643176 - DNA, 183 bp, Homo sapiens
  misc_feature (147)..(147): n is a, c, g, or t
atgtaagcttgcaggctggtgcagatatctctcatgatcggccagttcggtgctggctttccattctgcttattcggttgctgcagaaagtacactgtgatcaccaacacatcacgatgcatgagccagtcacgctagggcagtccntccagccagggtggcatccagtgggtggctcatcag

SEQ ID NO: 643177 - DNA, 4300 bp, Homo sapiens
agcgggtctctcgggcctgggcggcgcagacgaggcctgaggcggcggcgcgaggcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaa

SEQ ID NO: 643178 - DNA, 227 bp, Homo sapiens
tccagcacttgcactgcgctcccttcacaatgctgcctccgaggaagaggtgtgcgtgtgaggcggggtctctgttggtctcatagtatgtcctattgtctcaagtccccatgcagccagttgctgaagtagaggaagcggtcgtccagggagagcaggatgtcggtgatcaggcctggcatttcgggcagcagccagcccgggactttcttggggggcacctggat

SEQ ID NO: 643179 - DNA, 3905 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaa

SEQ ID NO: 643180 - DNA, 3989 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatctcatgccagttactatgggagaatgaatgtgagagaggttctcagagaggatggccacctcagtgtaaatggggaagcgctgtggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaa

SEQ ID NO: 643181 - DNA, 4711 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaagccgaagataagacaaccgtcaacacaaacacggaaacaacaaacagctttgtgtggcgcgcccacttgaggcctccagagaaaagttttataaaacacacattctggttggggccgcggcggccaccaaggggtatcaggagaccatgggcaatacgcgtgtgcccaacgaaaacccggggtacaaaggcaacggggtgggttctcccaccaaaaaaaaagcgcgggggggaaacgggcggttctgaacaagatcccgatggacgctggggcactcaggggccatcaaaggggccagccactcagttaaatac

SEQ ID NO: 643182 - DNA, 3698 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctgggggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaa

SEQ ID NO: 643183 - DNA, 3626 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaa

SEQ ID NO: 643184 - DNA, 4343 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgtggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaa

SEQ ID NO: 643185 - DNA, 365 bp, Homo sapiens
ttccgggagccactgagtaagaaaacagtctttagatgctctccatcagtgagctaaaatacttggagagaactgtctcctattgtggcctagaagtccacgagaacccacctgaggacccaggctgaccatgatcctttctgtctgaacctttaatatattgagggcttttccagagtttgtacctctgaccctgaccctgcctcaactctcagtctttagtccctgggaccttgaggggaagggagatgctgtccatatttttatcagctaaggggaactatattcctgttttgttcctttaaatatcatttctggtgaacataacttaatgatgtttttttcttcctttcagacaaaatttc

SEQ ID NO: 643186 - DNA, 213 bp, Homo sapiens
tatgacggactcccccacgacaacacggtgtggttgctactcgacacgacggaccggtggccactggaacgtcggacactccgctacaggacgtgtgtaacaacctcacccggccgacactaccctacgccctgacaactggactggcgctggacgcgtcggtgcccactaccccgtgccgtcgccggcacgtcgacgacgtggaccacgcgg

SEQ ID NO: 643187 - DNA, 3611 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctgggggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaa

SEQ ID NO: 643188 - DNA, 997 bp, Homo sapiens
cttgcccatcccgtgttttcaagtgttactgtatatgccactatatcccttcgcctgtctatgtgttccttgttcatcgtggttggaacagtggcgcgttgtcccacgaaaccggtgagtgcagatcgtatttggcgtcacttcggatcatatcagatggggaacataaattgatggtagcttctcaaagaactgggcaaatgggatggctcaggaagttactcggtggttgattccacaagcccatagggaaatcgacataccgtatatcgtgatatcgttatctcgtctttttagccaccccctattgctgtgttgcattagttagctgggttgcttgcagcagcgtgtcacaacagctgctattatgcgagtgcgacggctttgcttaaatacgaatattgctggaactacttgttggttcagcggtcatgtattagtgtctgataagctgtacagttcacatagagagagcttctcgatgggctgttgctggacgatgagatgtgtgttataggctgaagccaggagagcctagagacacaagctattttcagtagtagtagcgatcctattcgaagtataatcgttgtcgtcttaaaatttcttttagcatagcagttttcagtggatgagaaagaatcttctatgtggactatatttgggctaaaataatggctgttgtcgtaatcgaagcacaaggtggtaaaggtacaaagttggaagactgttcaagttaacgagacttgctgcaaagccttgcagaacggaggaggctctagccatcgactggcgtgtctcctccctccaacctctctacatatcatgcctgctttgagctgttctgttgccagcaagctgcaccattgggtcactctatttggaatatagtcgactataggctgcgatcacaggcagtaaaaggagttgatgggaaatggactaaaaaactgacatgtgcgaatcagtgatagagggaattacgtgcgccacttga

SEQ ID NO: 643189 - DNA, 4525 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgctctccttgtaggctgaagtcagtctgacttgaaggggcctggtttggatctaagcaaacacccagatggggttctctggtctcagcaaggcttttcctgttgggagtcacagtaaacagaaacccaaaaatctcatcttgggtgttttcagggcttgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaaagtgttacagatgttttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaaaaataatattttttttaaatagccttgcggcccaaatttgagcttaattttggccaatttgccccttttgggaagtcgatatacaaattaattggcccgtcgttttaacaaactttgtaatttggaaa

SEQ ID NO: 643190 - DNA, 243 bp, Homo sapiens
cacaaatgggtgggccaatgggggggtttttgcccccaaaaggggggtgggggggccccttttggggttttcttttcccctttagggggggagggggggccttccctttcccccagggtgggggtcttttccccccccccttttttgcccccgggggggggggggggggtttttttttgggggccggttggccccttttttttttgggggaaaataaagccaattggggggcccttcccccca

SEQ ID NO: 643191 - DNA, 159 bp, Homo sapiens
  misc_feature (27)..(27): n is a, c, g, or t
  misc_feature (50)..(50): n is a, c, g, or t
gccatgctgagggccgcagcctgatgnacatgtgggccacgcctttggtngatatgcgtcagctgggggtcttgtgtgtgccctgcccaccgttctctgccctagtgatagaaagatgtagatggaagtcagtgcctcagaggaggaggctctgaggct

SEQ ID NO: 643192 - DNA, 631 bp, Homo sapiens
agcgggcgggcttctttgcctgcaaccacgggaacttcgaggtatgcccaaccatatacacatgggagcaggagctccacctcagtttaaccggatggaagaaatgggtgtccaatgagggtggtcgagccaaacgctatgcatcccagcggaaagaactgtgccagagcccccctgtccctccagggtgcatagtcacgtatcaatggagggacatttacttatgattccatcgtgcagttccatgggagcaaagtctattagcccatggtgacaggccctgccgcgctggctccagagggcagtgcgttggtgcaacgcgcaaggatgtgaacctttgcgcctatcgcaaggtttaatgatcgccccgagcaagagcaccatgctcgctctgccacgagatccaggccttctgatcacaccacacgcaggtgtccatgtcatccaggaaccaggcacacagcgtcaggagttgcttgatcctacttactgtttctgttccagggcgtcgatgaacttggtaatcccagttacccttatgctccagggcaatgcactacccacaccaacgctcatctgtatcctaatacacaggccccatcacaggtatatggaggagtgacctagtata

SEQ ID NO: 643193 - DNA, 424 bp, Homo sapiens
  misc_feature (424)..(424): n is a, c, g, or t
cgcggagagagagtagtagagagtagtagtagagagagagagagagagagagagagagagagagagagagagagagagagagagagacagacagagagagagagagacagccttatacctctcaccctctttcccctctcgcccttccactctcttttcctccctcctctctctctctctcccttcccctccacccttctctctccccctcactgttcgcatctccctcctctcctcccctcccttccctcctctcttttttttttttccatcccctctttctctctttccccctccttccctcccctctccccctctttcctttcctctcccttctccttccctgtctcctcctcttcttctcccttctccttcccctccctcctctctcccgccttcccccctcctcctcctccttttctcn

SEQ ID NO: 643194 - DNA, 98 bp, Homo sapiens
atggcttcagtcttcataacaatcctgatttccacttagcagtcagcattaatcacaagcttgtattgcagaaactgttaactgaagttttcttcaag

SEQ ID NO: 643195 - DNA, 256 bp, Homo sapiens
gctacttcactctcacctgggcacagagctgagaccttgttctcaaaaaaaaaaaaaaaaaaaaaaggggaaatgcaaataaagggagcagttgtgccccaggagtactatttgaggggccaggctgctaaaaaagcagttaatgtacccttaaagcaaggttggaaaatttgctgtgggttagattcaaaaattccgcgggaattcaggcgttatcggagcaggggtaccgagcttcaaatcgataatcttgtca

SEQ ID NO: 643196 - DNA, 776 bp, Homo sapiens
  misc_feature (150)..(150): n is a, c, g, or t
  misc_feature (176)..(176): n is a, c, g, or t
  misc_feature (208)..(208): n is a, c, g, or t
tggaaaggtgcccctaccctgtcctggacctcaccagcagggaacacacaccaggaccagggcctttgtgaatacttggtggaatggatggacaaatgaatggacgggtggatgaatacagacatgtcagagtacagacatcaggcaaanatcaagcatgaaaattagaaacatantatgtgacaatccactctgcatagcaaacccnacatgtaatgtggtttggcatatgacatcatgagcttccatcgctgccctcgtccctccttccagataagctgctgcttccgcagcggatataactcttcttattgtgtttggactccaatcccatgtgaacacacagctgcacagtccaggatgcagcctggccaggtcaagaagcaaaaagccagctgggagtcgtgcccactttgggaagaacgcacagatccccaacacgggctccaggtgtcagcagaaggccctgatgttctacagacatgtgatgcctataatcaaagatcctccattcaaaattttcctacggatgggagtatctacacacaaaaaccgctcacccccaacactcttcatttgtctagctaaacgggttgttttaaacagaaattctgataaaacggagagggccatcatgtcaaggaaagttgctgttttataaactagaataatggatcaagccttggagtccctaaagagagaggatctcttgagcccaagagttcgaggctgcagtgagctgtagtgctgccactatactccagcctggaccacag

SEQ ID NO: 643197 - DNA, 405 bp, Homo sapiens
tccctccctataagacatcaggattatttatttatttatttatttatttatttatttattatttattattttttagagacagagtctcgctgtcgcccaggctggagtacagtggcaccatcttggctcactgcaacctctgccttctgggttccagcgattctcctgcctcagcctcctgagtagctgggactacaggtgcacaccaccatgcccagctaattttggtatttttagtagagacaaggtttaaccatgtgggcctggctcatctcgaactcctgacctccgttgatctgtccgcctgggcctcccaaagtactgggatgataagtgtgagccaccgcgctcagcctcacttacttatttttaaatttatttttacatatgaatgtctaataggga

SEQ ID NO: 643198 - DNA, 830 bp, Homo sapiens
  misc_feature (150)..(150): n is a, c, g, or t
  misc_feature (176)..(176): n is a, c, g, or t
  misc_feature (208)..(208): n is a, c, g, or t
tggaaaggtgcccctaccctgtcctggacctcaccagcagggaacacacaccaggaccagggcctttgtgaatacttggtggaatggatggacaaatgaatggacgggtggatgaatacagacatgtcagagtacagacatcaggcaaanatcaagcatgaaaattagaaacatantatgtgacaatccactctgcatagcaaacccnacatgtaatgtggtttggcatatgacatcatgagcttccatcgctgccctcgtccctccttccagataagctgctgcttccgcagcggatataactcttcttattgtgtttggactccaatcccatgtgaacacacagctgcacagtccaggatgcagcctggccaggtcaagaagcaaaaagccagctgggagtcgtgcccactttgggaagaacgcacagatccccaacacgggctccaggtgtcagcagaaggccctgatgttctacagacatgtgatgcctataatcaaagatcctccattcaaaggcacgggactctcacacctggaaatgtgctcagagaataccccgcaccattttattttcctacggatgggagtatctacacacaaaaaccgctcacccccaacactcttcatttgtctagctaaacgggttgttttaaacagaaattctgataaaacggagagggccatcatgtcaaggaaagttgctgttttataaactagaataatggatcaagccttggagtccctaaagagagaggatctcttgagcccaagagttcgaggctgcagtgagctgtagtgctgccactatactccagcctggaccacag

SEQ ID NO: 643199 - DNA, 413 bp, Homo sapiens
aacaaattgtaatagtgagagaaagaggagtgggggttcaggagatatttgacttgataggccaggaatgacgtgtatgttaaaagtgtgccgggcttataggtatctcttgatctggccaaacagctggtcctctctgtttctataaacttcgaaaatgccctcatgtctattttatcccttacagttgaataatgtagttgaagagtgcacactggatggtctcggtaactgggctgtgtctaggtagctcacagatgctgcaggtgaatttcaatggatccgttagctttactactaagatcttgctgagatcagagaagggcttctgggcaggctgagcactgggggtgtgcaacatggtaactctgaataagagaaaccctgagttttactgggcaaagaaagaacaa

SEQ ID NO: 643200 - DNA, 113 bp, Homo sapiens
cttgatgcagctccatgagggtttgaggttttttcacagattcttccccagttatctcatttataatacactcctctttgttaacaatctccttcccagcttctccagtacaa

SEQ ID NO: 643201 - DNA, 212 bp, Homo sapiens
taacctgcagctctcaagtgctgggatatagcatgagcacgtgccgtgagtacagttcttaaagacggtgtgtctggagtcgttcctgcagatgttcagcatgtttccatgagtttctatccttctggtgggttcgtggtctcactgacttcaggagtgaagccgcagaccttggcagtgagtgttacagctgttaaaggtggcaggtccgg

SEQ ID NO: 643202 - DNA, 260 bp, Homo sapiens
taccgtcagatcaacaagtttcccctttgaaatcatgggtatttcaaatgtaggtaggggattctctggcaaagcttagacctaacaaatctttctttgcctactgttttccgaatgcaagcttccaccagctgcatgtcttctgacctaactagtttcctgcacagctcacagagggttgcattttccttgtcccagcctacccccattggaatgtgctgttggcatgatactatatcatcctcattaataattaattg

SEQ ID NO: 643203 - DNA, 1466 bp, Homo sapiens
  misc_feature (1371)..(1371): n is a, c, g, or t
gccacgcgtacgaggcaggggtgggcagggtgcccacggaggaaagatatactaggatgtcctagcgaggctcgcagtgatggtctcatgctcggcaggcgtgcgatggccaagaggcaggctgagcgtggctgactctgctgtcccaaccgtaccagtggaggcaaggacagagttccttgtggcttatgtaattgtgtctctcaactggataggcgtgtgaggagttggacaaaagagaaaatcgcccattactaaagaccacgtacaggaggcgaggccgggctgctggaaggcatcgagaagcctggtagatacccatgcaactatagggcgaggccctacggcaggtgtagggactcgacctggagggccgaggccactacgcgagagaacccaagatactgggccgcgaagcatcgggctgtcatgaccacggcggaactactaaacgtaaacacaacataaggacaagaaagtctcagaccgcgaggaccatcggcgtgggttagcgagcccgaccctatataagatttcgcccaagctaacctctcgggagagaagaggccattgtacgcggagcactgcgcgcaggacagaaatgccgagggccatacggggacgacatatcctcagtgcccgcaaagggacgccacgccacagccgcgatgtggagcccagagaggaggacacgccacaccacgaagacaagttcaggagtctggcctcaaacgcattggtggcaaagctgtaccacgacaggagccccgatgggggcggccccacagccacggcgcacaaggggacagacaaaaaacaactcccttgaatccccaacgaagaggcgaccaaacatcgcagaccaacacacaaaataggcccccagagccgaacatagaacgccagcaagaccacaataaagcaacagacaaaccgacacaaaccacgtcggaagggacgaaattagcgcccatatatatcacaccacgagagaggcacaaacggagccgtatatcccgcgaaaagttcaaaagacacaaaagccggttcaaccactcctgttctgcagatattaacagcagtatatcactcccgaaaacggaagagaccaccatacgacacacacaaaggcatggagacacatgtgcacacacacagagggagaatggcggaacaagacgcagtctccatagtcaggaacactgagccacaatacaacatagaacgcacaagtgggcactcaacaggcgaacatggcacaacggcgagcaaccataactggacacatacactccacccccaccgtcgtacagacccccagcgcgtattaagcgacaaccgcacaagtagcggcatacccacaaacaacgntacagaaaagcagggaacaaccactactcgaccgaaagcggatccactagcccgcggaccaaaacctcacaaaccaccgacggatgcacacacca

SEQ ID NO: 643204 - DNA, 599 bp, Homo sapiens
tgtcaattgctgagccatcatacccagtactgtctggtctttctataatacaaatgtgcgttgcacatagtaaagagcgtatccaagatggattaaatataactgtgacacttgcctagcgaactgtttccatctagcttctttggtgcatcaatttttgatagtgaacgaggatgcttgcgacgtttgataaatagagttgtaactcaccagattactaacctattaaacatttatggtatttcggaacaaatacgggctctgtcctttcaggtctaacaaagagaccttttacgataggactattgaggattttaggttatgcaaaatgtaattgcttggattggtatatatagcccttctattgagcttagaaatgcttgtcacatcagcatggaataggctgggcactgtgcctcatgcctggaatcctagcaccttaggaggccaaggtgagagtatcattttgggccaggagttcaagaccagcctgggcaacactgcgagaccacatctctgccaaaaagaaaaaaatcgctggccatggtgacacatgcttgtagtcccagctaactggggggcactgaggtgggagaatt

SEQ ID NO: 643205 - DNA, 826 bp, Homo sapiens
  misc_feature (322)..(322): n is a, c, g, or t
tgcccaaccctgcgtagttccacggcgctctcgtgcgcacgcttgcgccgcggctggccctcatgctctcctctcgcgcacctaccatgccgcgcacacaccatcagcgctccgccgccatctgctcacccatgcgtctcatccgccactgcagcacacccagcggccatatctgcgctccgccactgcggcactcgctatgccccaccctccaccagctgcccagtcgcagccacccagcggctctaactggcccctcttccccaacacgcctgggcccaccttcgcccaccggcgcaccaccgaacccttagcacacttnaccactaaccaactaccttcagtaccagaaaccggagtataataccaccgtagcacacaaccacacgtactagtaccctacaaactctccaacgcaaccgaacgataaaacttagataccgccaggtaaacctcagatggagtcccttaggggccacgagacaccgagcggcccacaggacactcattttcccatcacttacaccccacaccaccactccctaggcgccgcccccaaatgccacctccgtcaaccacacctcaggaccaccctatgccggcgatcccctcccaccaccggcagaagtacatgatcaacattgatggcacacaacaccggtcgcaccccacgcgcgcacagtgcacaccagcagcggcgtcacaccacgaacagccactccaacatcacggcacaacgttggcacacgtctaatgtgcacagcattgctacatcacgggctaggctcccgcgtccctacttcctttgtatcaacatccacgtgac

SEQ ID NO: 643206 - DNA, 1518 bp, Homo sapiens
  misc_feature (157)..(157): n is a, c, g, or t
ggcacgagcccttacaaaggcccagctggggttagaactggaagaactagaagcagcagcactgcttgtccaggaggaagaaactgcattaaaagcagcccattcagtttctgggcagcagacacttgctccagctctgaggcaagtgattcggagnactcagacagcagcgtgtcatctggaaacgaagactcaggctcagattcagaacaagatgaactcaaagatgtccatctgagacagtcagttcttgcaagtccctttcttgaagaaagcagtgcctttcttattgttgatggtggagtacgcagaaacacagccatccaggagtctgatgccagtcagggaaagccacttgcctcttcctggcctcttggagtgtctgggcctctgatagaggagcttggggaacaactgaagactacagttcaggtttctgaacccaagggcaccactgctgtaaaccgcagcaatattcaggagagagacggctgtcagacaccaaataattgactcttaggtggttttattcattgttgagaaatatggtagattgggtttcatttaccgaatgagaattcttcattttcactttgtaatttttcttagtatatagtcagcccactgtatttgtgtgttccacatctgtggattcaaccaactgcagatcaaaaatattgaagaaaaaatcgcatctgtaccaaacatgtacagacttttttcttgttattattctctaaataatacagtatgacaactatttccacagcatttacattgtattgggtaatataagtaatctagtgatgatttaaactgtgcaggaggatgtgggtaggttatatgcaaatactgcaccattttttatcaggggcttgagcatctgaggattttagtatcctcaggagtcctggaaccaaccccccacagatacggggacaactttatgacattgtttttcaaccaatgaatgtttataccttttgttttccttgccgcgactgtgaagataaagttcaaaagtatttttaccaaagtgtagctaatatttcaagctgaaaataatagttctactgcccgtgtctccagaatgtagagcccatcaatatttttattttaggaggtgtacttgacacccaataaactgcacgtatcaaaagtgtacaatgtgttggcgtatgtataccctgcgtaaaactatcaccacaactgaagtgaggaacggacccatcattcccaagtgcccttgtgccctgttattagtttgcatgtcctagaattctatgtaaattgaatcatacaatatgtatcccttttttggtcaggcatattttactcagtatagttattttgagattcatccatgtggtagcatgtgtcacgagtttttgtttttatgtttttcattgctgagtactgcttcattgaatagatttgttcattgacctatcgatggacacctgggttgtttccagtttggggctgttataaataaagctgttatgaacatttgtgtac

SEQ ID NO: 643207 - DNA, 1181 bp, Homo sapiens
cccgggagcgcgtgatgggtgtcggcgtgaccaggcctgaggctccctgtctctcctcagtgacatcgtctttaaaccctgatgtggcaagtccctgcacgcaccggccgtgatgccgcagggaatgacagggcgactctgcgaagtccaacatacttcctctaagatcatccaactattggatgattatccggaaatgttgtcagtggtgggagcagacaatgtgggctcctaagcagatgcagcagatcctgctagtgtcccttcgcgggaaggctgtggtgctgagtgggcaatgaacaccgatgatgctgcaatggccactccggagggcacctggaaaacaattccagctctggcagaaactggctgccgtcatactccgggggacatgtgaggcgtttgtgttcaccaagggaggaccgtcagctgacgatcagggagcatgttgctggccaataaggtgccagctgctgcccgatgctggtagccatttgccccatgttgacgtcactgtgccaggccgagaaacactggtctcgggcccgagaagacctcctttttccaggcttcaaggtatcaccgactaaacatctccagggtgcaccattgaaagtcctgagtgatgtgcagctgatcaaagactggagacaaacgtgggagccaactgaagccacgctgctgaacatgctcaacatatccccgcttctcccttatgggcctggttcatccaaacaggtgtccgacaatgggaagcatctacagccttgaagtgcttgatatccaccataggcaactcctgggattctacgcttcctggaagggggtcacgcacagttgcgcaagttcggcacgcaagcatgggcaacaccaaccgctgccgtacgtaaccccaattcatcaaagcacaggggaaaacacgacaatacgcggccaccacatgcgggacgaaacggagacaacccccgtaccacagtgcggcagaaaggcccaggagcgaacatggggaagcaccccatgccatcaggaggaaccccccgagagaaggcacaacaacaaggagcagggcagacaaccgacaaaagataatcagccaacatcgagacacaacgataatgcgggtccaacaacacaaacacgaacattaagacacacaccactcaaaaccagccacacgcacc

SEQ ID NO: 643208 - DNA, 2121 bp, Homo sapiens
  misc_feature (157)..(157): n is a, c, g, or t
  misc_feature (1523)..(1526): n is a, c, g, or t
ggcacgagcccttacaaaggcccagctggggttagaactggaagaactagaagcagcagcactgcttgtccaggaggaagaaactgcattaaaagcagcccattcagtttctgggcagcagacacttgctccagctctgaggcaagtgattcggagnactcagacagcagcgtgtcatctggaaacgaagactcaggctcagattcagaacaagatgaactcaaagatgtccatctgagacagtcagttcttgcaagtccctttcttgaagaaagcagtgcctttcttattgttgatggtggagtacgcagaaacacagccatccaggagtctgatgccagtcagggaaagccacttgcctcttcctggcctcttggagtgtctgggcctctgatagaggagcttggggaacaactgaagactacagttcaggtttctgaacccaagggcaccactgctgtaaaccgcagcaatattcaggagagagacggctgtcagacaccaaataattgactcttaggtggttttattcattgttgagaaatatggtagattgggtttcatttaccgaatgagaattcttcattttcactttgtaatttttcttagtatatagtcagcccactgtatttgtgtgttccacatctgtggattcaaccaactgcagatcaaaaatattgaagaaaaaatcgcatctgtaccaaacatgtacagacttttttcttgttattattctctaaataatacagtatgacaactatttccacagcatttacattgtattgggtaatataagtaatctagtgatgatttaaactgtgcaggaggatgtgggtaggttatatgcaaatactgcaccattttttatcaggggcttgagcatctgaggattttagtatcctcaggagtcctggaaccaaccccccacagatacggggacaactttatgacattgtttttcaaccaatgaatgtttataccttttgttttccttgccgcgactgtgaagataaagttcaaaagtatttttaccaaagtgtagctaatatttcaagctgaaaataatagttctactgcccgtgtctccagaatgtagagcccatcaatatttttattttaggaggtgtacttgacacccaataaactgcacgtatcaaaagtgtacaatgtgttggcgtatgtataccctgcgtaaaactatcaccacaactgaagtgaggaacggacccatcattcccaagtgcccttgtgccctgttattagtttgcatgtcctagaattctatgtaaattgaatcatacaatatgtatcccttttttggtcaggcatattttactcagtatagttattttgagattcatccatgtggtagcatgtgtcacgagtttttgtttttatgtttttcattgctgagtactgcttcattgaatagatttgttcattgacctatcgatggacacctgggttgtttccagtttggggctgttataaataaagctgttatgaacatttgtgtacaagtnnnnaaaaaaaaaaaaaaaaaaaaaaaaaaaaaaaaaaaaaaagaaaaaaagaaaaaacaaaaaaaaaaaaaaaaaatggggtggggcgcgcgccgcgccggcgccccaaaaaagaattttttacaacaaccccgtgtggtgggcggcgcgcgggcaccacaaagaagaggataatagacgcacggcgcgacaacaaagtgatttaccacaaagagagcaccgcggctgggaataaaaccaacaaggagggggaggaggataccccccccaacacaaaataaaaaaaggcgcgcgcggggggaaaacaacaaacgaggggttgttgtaaaacaagacaatcccaaagaggggggtgcctcgaagggggatcaatatgagggggaagatcataacaagggaggggacatcaccgaaagagaaggacgcgtcaataaataaaaaaataatacccccgcccccgcgtctgggggttattaatatacacaaggcggacagacgagagagaaagtaaagaagaagaacagagagagcgagaggaacgaaagagcgacaaaaagaagaaagaggagagaaagagagacggagtgagaagacaaac

SEQ ID NO: 643209 - DNA, 518 bp, Homo sapiens
  misc_feature (30)..(30): n is a, c, g, or t
  misc_feature (39)..(39): n is a, c, g, or t
ttcggcacgaggctctacattctggagacncgggcagtngaactaatatttcaagctgaaaataatagttctacattctggagacacgggcagtagaacccatcaatatttttattttaggaggtgtacttgacacccaataaactgcacgtatcaaaagtgtacaatgtgttggcgtatgtataccctgcgtaaaactatcaccacaactgaagtgaggaacggacccatcattcccaagtgcccttgtgccctgttattagtttgcatgtcctagaattctatgtaaattgaatcatacaatatgtatcccttttttggtcaggcatattttactcagtatagttattttgagattcatccatgtggtagcatgtgtcacgagtttttgtttttatgtttttcattgctgagtactgcttcattgaatagatttgttcattgacctatcgatggacacctgggttgtttccagtttggggctgttataaataaagctgttatgaacatttgtgtac

SEQ ID NO: 643210 - DNA, 123 bp, Homo sapiens
ggatttgctggtgcagtacaactaggcttaatagggacatgatcaagcaggttttataccaggaatgcagggatggtttaacatacgcaagtcaataaatgtgatacatcacataaacagaaa

SEQ ID NO: 643211 - DNA, 254 bp, Homo sapiens
cataacacaaacatgaaagcatctatcatgccaacactcatagcataaacagcactgttaaacctctattactacatacgactagcctactcctcctcactgactatgttcccatccaccaacaacatacacctcaactgacaattcgaacacacaaaacaactaccattacttcccacaatactcgtcttatcaacactagtcctacctgtaacaccagccctctcgtacctaaactaggactccaggttatt

SEQ ID NO: 643212 - DNA, 161 bp, Homo sapiens
  misc_feature (21)..(21): n is a, c, g, or t
  misc_feature (24)..(24): n is a, c, g, or t
  misc_feature (27)..(27): n is a, c, g, or t
  misc_feature (30)..(30): n is a, c, g, or t
  misc_feature (68)..(68): n is a, c, g, or t
  misc_feature (76)..(76): n is a, c, g, or t
tatccccgacgccaattctgngcntantanaacggcagctttaacatgtactcagtttggtagatgantgcattantggccccacttaatggctgcatgtatctatacactttgacttgtaactctatagtccctttctatctgttgttgggcgtacgggg

SEQ ID NO: 643213 - DNA, 438 bp, Homo sapiens
  misc_feature (5)..(5): n is a, c, g, or t
  misc_feature (41)..(41): n is a, c, g, or t
  misc_feature (60)..(62): n is a, c, g, or t
  misc_feature (117)..(117): n is a, c, g, or t
ccggnacccaacatctaacgacacgagctgacgacagccangcacctcctgtctttaggnnnccccgaagggacactgagagatctttatctcattcctaagacgccccccgctggnaaggttcctcgcgttgtgtcgaattaaaccacatgctccaccgctggtgcgggtccccgtcgacggaacccaacacctagtaatcatcgtttacagcggggactaccagggaatctaatcctgtttgctacccacgctttcgcgcttaagcgaaagaatctgtccagaaagctggctcccccatcggcattcctacaaatatctacgaatttcacctctacacttgtagttccgctaacctctccagtactctagttatacagtttccaacgcaatacagagttgagccctgcatttccacataagacttatataaccacc

SEQ ID NO: 643214 - DNA, 480 bp, Homo sapiens
tgcgatttatagtacgcaaaatataacagaaaccaaaaagtagattaaaagactgataatccatggaatcacacaagcggaccggacactctatactctcccctaccacacataagccgatacccatgagagagaccaagggagatcagaccttccagacctatgcaccatctggtcgccgcaaaatatctacggagattccttgtggaaaagcagtttcccatcttttgtgtctctccctaccatgcaggaagcaagtctggctgtgctattctattaccattatatatcacccatctgcaacaaggtactgtacagacaagtaagaagtatgttatctagtacccttacccccagaaggttgaggctcaggtatacgggtacttctcctgtgcagcctaaatacatgctgactcagtgactacaacaggcttactcatgtggtcaggtcagtagccagctgcataatgctcccacatc

SEQ ID NO: 643215 - DNA, 3985 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagaaaatgagtatcaggaagaagggcagcttctgggacagttcacgtatgatcaggatggggagtcgctccagatgttccaggccctgaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttttgagttttgctgaatagggagcgcaagacgccctgagcctccctctcactggtggtgataagaggagccgtctggtgtgtcagggtcacgaacccgttacatttcaggacgatcctttttccttcagcagcatttcttactggctgtggctggaatctgccttttatcacagctgtcaccattctcacgtgattcttgtgagactctttttggttataattactatttaatatttagactattttactgagcagactttataaatgagatatctacaaggcacttaccttaagaattatttaagttgtgttgggttaagacagttttcagtgtaccgtaaatgttgtgttttcagaaaaagacaaaacgatggtgctgactggttttctgtatattgcacaacagtcctcaaatacactgatgtatgaaactattcatacatcaagcagcatttttttcactctccttagaattggaactatgcagttaaggcagataaaatgtacagatgtttcatatattacaggttacatatataaatcaaaatttcctatataaaactgatttgggatttggggtggaaatattttgaatattaatttatttttaaagatgcaagataggactttgtgcaatgtatttttgtaaatgcttttcaaaatatctgtctttggtagtgcttctgctgctgccaccaaattgataagatgctattaagaggtttaaataaagagttttaatttttaaaa

SEQ ID NO: 643216 - DNA, 2760 bp, Homo sapiens
  misc_feature (2627)..(2629): n is a, c, g, or t
  misc_feature (2635)..(2635): n is a, c, g, or t
  misc_feature (2643)..(2643): n is a, c, g, or t
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagnnngggagncgctccanatgttcaggcccctgaaggaccgccacacactttcctagggggactccgatttttttacctggggcatctgagataccggttggttggtgcttatggcgacctgtagggagacacct

SEQ ID NO: 643217 - DNA, 340 bp, Homo sapiens
gctcgagaggtgagactctgctggttctgtgcattgaatgttgactagcctagcactcactcctggcccgcatcaggagccccgccttgccggctctggttcatcgcctttctttttgtggcctgaaacgatttcttcaattcgcagttaacagaactgccgtctccactgctgttttattagtctgcagcttcacagccaatggctcccatatgcccagttccttcatgttcaccaaatgtaccccgtctcaccatttacaccccaggtctcacagttctcctgggtgtgcttggcccgaagggaggtaagtagacagatggtgctggccccacagttc

SEQ ID NO: 643218 - DNA, 2988 bp, Homo sapiens
  misc_feature (2816)..(2816): n is a, c, g, or t
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagacgctgtcgccaacaggcaacatcagcagcgcccccaaggacttcgccgtctatggattagcccttggccgaccctcctcctcccacaccttcctgggagttcccacagatgaaagcaagtgacgtgagcgcactggggacggctgcctcccgctgcccctccgccctctctcagattcggtgttgaggggaacattccagtgcttttctagggagggtaacttagaaatggcatattacctgatgtccantttacatacagtactacactgaccaaggtagacacgcctaagaattttgctcctcaccgcccttgccaagttgcctgtgaaaggtgttctggcaactggatgacgtgggagcagctggctgacaagaggactgccatgatcccagccccagagaaacccaccattcatactg

SEQ ID NO: 643219 - DNA, 202 bp, Homo sapiens
ctgagaccacaggtacacaaaccccacaacagctatgagtagaagcttttcagaatgaatatctggccatgtcacaagccccccaacaacaatcccatgctttctgggctcttagcacccttcaatactataacatggtatttacgaacctaactaacggcctgccaattcatttttctttcagcctgtgggttatgattga

SEQ ID NO: 643220 - DNA, 2619 bp, Homo sapiens
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcagggtgacagtgaggcttttccgtggcattggatgagtggcgtggagcagcaggtggcctctctgtctggacagtgccaccaccatggtgagaatctccgagagctgaccactttgctacagaagctgcaggctcgggtggaccagatggaaggcggcgctgccgggccgtcagcttcggtcagagacgctgtgggacagcccccgagggagactgactttatggcctttcaccaagaacatgaagtgcgtatgtcacacttggaagatattctgggaaaactgagagaaaaatctgaggccatccagaaggaactagaacagaccaagcaaaaaacaatcagtgcggttggtgagcagctcctgcccacagtcgagcacctccagctggagctggatcagctaaagtcagagctgtccagctggcgacacgtgaagaccggctgtgagacagtggatgccgtacaagaaagagtggacgtgcaagtcagagaaatggtgaaactcctgttttccgaagatcagcaaggcggttctctggaacagctgctgcagaggttctcatcacagtttgtgagcaaaggcgacttgcagacgatgctgcgagacctgcagctgcagatcctgcggaacgtcacccaccacgtttccgtgaccaagcagctcccaacctcagaagccgtggtgtctgctgtgagcgaggcgggggcgtctggaataacagaggcgcaagcacgtgccatcgtgaacagcgccttgaagctgtattcccaagataagaccgggatggtggactttgctctggaatctggtggtggcagcatcttgagtactcgctgttctgaaacttacgaaaccaaaacggcgctgatgagtctgtttgggatcccgctgtggtacttctcgcagtccccgcgcgtggtcatccagcctgacatttaccccggtaactgctgggcatttaaaggctcccaggggtacctggtggtgaggctctccatgatgatccacccagccgccttcactctggagcacatccctaagtcaggtagtgcagtgtttgtaaagtgcagcatattcagttccaagctagaggtt

SEQ ID NO: 643221 - DNA, 2086 bp, Homo sapiens
  misc_feature (1957)..(1958): n is a, c, g, or t
  misc_feature (1982)..(1982): n is a, c, g, or t
  misc_feature (2007)..(2007): n is a, c, g, or t
  misc_feature (2051)..(2051): n is a, c, g, or t
agcgggtctctcgggcctgggcggcgcagacgaggcctgaggcggcggcgcgaggcagtatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagcagcgctgtctccctgaagaaccgagcggccagaacaacaaaacagcgcagaagcacaaacaaatcagcttttagtatcaaccacgtgtcaaggcaggtcacgtcctctggcgtcagccacggcggcactgtcagcctgcaggatgctgtgactcgacggcctcctgtattggacgagtcttggattcgtgaacagaccacagtggaccacttctggggtcttgatgatgatggtgatcttaaaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaagctcatgccagttactatgggagaatgaatgtgagagaggttctcagagaggatggccacctcagtgtaaatggggaagcgctgtgcgacgactgtaagggcaagaggcacctcgacgcgcacacagccgcccactcgcagtcgccacggctgcccggtcgggcagggaccctctggcacatctgggcatgtgcaggttacttcttgctgcagattctgcgcaggatcggagctgtgggccaggctgtgtccaggacggcgtggtcggccctttggctggccgtggttgctccagggaaggcagcctctggagtgttctggtggctggggattggatggtaccagtttgttactttgatttcttggctgaatgtgtttcttcttaccaggtgccttcgaaacatctgcaagtttttagtcttgctcatcccactcttccttttactagcaggtctctccttacggggccagggcaatttcttttcgttcttgcccgtgttgaactgggcaagcatgcatagaacacagcgggtggatgacccccgaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggattttccttttttcagcaccagtaggtactaagtctccagatggggaaataactaaaatgtgtttttctgctttgttcgctcttacttctgaggaaggtttccagtcaggactcgctgtaccaatatccatggaggaatatggaggcatacaccagatgggtctctgtctagcaggctttnnctgtggagccagtaacagaaccanaatctatcctggtgttcaggcttgnttgagtttgtgataggagccaagacgctgagctctctactgtgnatagagagccctgtggtaggcagaaccgtcattat

SEQ ID NO: 643222 - DNA, 188 bp, Homo sapiens
ccaatgggcttctttattgagcaccagattttcagtacaagttgccacagaaggaggttcagattcaaccatgcccatgtgcaagggcgctggtccaggccaggcacatacagagagtgactgcgccatgcaggtatactttcgaatgcctggtacggctcgtactcttggtctctctggtattaatt

SEQ ID NO: 643223 - DNA, 178 bp, Homo sapiens
tactacagaggcaagtgtccaacccagcagtcgtctttgtcacccgaaagaaccgccatgtgtgtgccaccccagagaagaaatgggttcgggcgtacatcaactctttggagatgagctaggatgaagagtccttgaacctgaacttacacaaatttgcctctggtgggtaccgagc

SEQ ID NO: 643224 - DNA, 291 bp, Homo sapiens
ccattagaaagccccattagtggaataggaaacagtgtgtgactcctggatggtcaattaaatagtttcctcatcagaaaaattattttttagccattttttttctattggggtggatctagatgccattgatatcatctcaaacatgcagggcatcaacaacttcatttaatcagctcgcacaatcgcaccaataaatcaagcacatgctcaaaccagcacattagaccaattcatcatccaactctcaacacattttcacagcaccagccccagcaagcaccattcaat

SEQ ID NO: 643225 - DNA, 342 bp, Homo sapiens
ctcctatgtctttaaactgggggttcccctcagacacctcccaaaagatgagggatgagaggtgatgtagactcttttccttttcacttagttttgggacggagtctctctctccatcctgcctgacagagcgagtctgtctcaaacgtctcaataacaaacaatcaaacaaaaaacctctttgaaggggattaaggggatgtgtcccaataaacttgcaaacacctgtgaatcccagctttgtgtcaaggcgagagggatttgcatagctaaatgacattcattgcgtaggaaaaacgtgactgattaaatgcttcctcatcaaataaaaagtgctccaga

SEQ ID NO: 643226 - DNA, 243 bp, Homo sapiens
ctgaacacgaagaccgtgtgacgctgccctccggctcccagaaggttctctcctcagccaacagcgctgtgcgttggtgtggtggcaggcaggtggccgaatcgacgaacccatcttgaaggctggccgggcgtaccacaactataaggcagagaggaagtgctggccacaagtccggggtgtggccataaagtccggtgcacgcatcctctttggaggggggcaagccaccaggcacattcg

SEQ ID NO: 643227 - DNA, 173 bp, Homo sapiens
aggagccaggccatggtggtgctccacgaagaggaaaagctacagcgcctgagtctcacgggaggcaggtgtgaggatgagaatggttgtcccaccctccaggaaagcagcccgggcgtggctgcagcacacagcagtctgctccaagctcagccctgcaagatggggcacct

SEQ ID NO: 643228 - DNA, 109 bp, Homo sapiens
tatccaacccggtgccttggaccataccgaggcaagcgtccctacatagagcaccaacagcacaacaagtatgagaaatagacccagtccgaccgactctccccattta

SEQ ID NO: 643229 - DNA, 302 bp, Homo sapiens
cgctactatacatatatggcgcagtgctctcgctgtgcattatatctactctcatgacctttaacacccactctatcttagccaatattgggcctaatgcgcatactatgatttggcgcctgcgaagcaatcgagggactagccctactagacttaatcttcaacacgtatggcctagagctacgacataacctatgacctacttcaatgctataactatatcggccaacaagtatgtgactaccactgacctgacttttctccccctactattgcttaaccgcaacgccaacctttggtgt

SEQ ID NO: 643230 - DNA, 232 bp, Homo sapiens
gaagttggaaatttttggtttatgcctttgtttaaaaaaaaaatagttttaaacccatttttgttccccaaacaactttaaaaaaacagtggctggccagttttcattatcatcatcatggtcatcatcaaagggaacagttatatcaagcttaatatgtgttgaacattgttttgaaccctttaggtaaatgaactaaatgtatgtgaataaaaattatttggtcctccca

SEQ ID NO: 643231 - DNA, 112 bp, Homo sapiens
aggcttcaggggagaagccgccgaacaccaccgagtggatcgcgccaatgcgggtacaggccagcatggccaccaccgcctccgggatcattggcatatagatagtctctgc

SEQ ID NO: 643232 - DNA, 176 bp, Homo sapiens
ggtgagaggtcattgggctccatctgcaagctccatctacaaggcatcaatctgcgttgtggcatcaacgttaaaatgttctacagctatagggatcttacttgaagtcaaggttccatagcacataaactagatatgaccgagaggctcaactttagacagatgcagtcatcttg

SEQ ID NO: 643233 - DNA, 506 bp, Homo sapiens
  misc_feature (81)..(81): n is a, c, g, or t
  misc_feature (107)..(107): n is a, c, g, or t
  misc_feature (148)..(148): n is a, c, g, or t
  misc_feature (163)..(163): n is a, c, g, or t
  misc_feature (328)..(328): n is a, c, g, or t
gggctgggcaaccagattgtccccgacgcccccaaggaccacgccttcaagtggcgttcggcaagtgcccaagattgagcntggggtgcccggcacccagagggtgntgcccaccatgttcttgagcctcccaagagttgcagcccangggcccggcccggcntggcccttcaggggatggccactgtgaaggacgccttcccagcctgcccgttgccaatttgttgtgagaggggggcctccctgccttggggccttagccctggttttgcatttttcctccggggagaaaggacattgcccctcccccgacttgggcccacaatgntgccttttcccaggagggaggtttttggaccctgggaccccatcccattcagccaagtgtttttttgggtttggggggaggaggggatgatatccgtggggttcgatgtattatttttaagctccgtgggggggggggtcagggtttgcatgaagtggaataaattgccccccgccca

SEQ ID NO: 643234 - DNA, 419 bp, Homo sapiens
agtctcaacaaatttaagaaaattgaaattatagcaagtactctctcagaccacagtggaataaaattggaaatcagctccaaaaggaaccctcaaaaccaggcacgtacatggaaattaaatgatcttctcctgaatgatcattgggtcccctatgagatcaagatggaaatgaaaaaatcctttgaactgagcggcaataatgacacaagctatcaaaacctctgggatacaggaaaagcaatgctaagaggaaaattcatagcattgaatgcctacatcaaaaagtctgaaagagcacaaatagacaatctaagttcacacctgaaggaactagagaaagaagaacaaaccaaacccaaacccagcagaagaaaagaaatagcaaagatcagagaagaagtaaaagctattgaaac

SEQ ID NO: 643235 - DNA, 356 bp, Homo sapiens
  misc_feature (298)..(298): n is a, c, g, or t
ccgcggcgcagcgcgtcgagcgccggcgcgatccagtcgcggtcgagtgcttcgaccgcttgcgtccaggctgcggcgtccaggtagagggcgggcgccagcgcgtcctgcagcagtacgagattgccttcctgcagtgcgacgccggtcttgtccggcagcggtgccgcccgcacgccggcggcgtgcgccagaccgtgcgccagcgggtcgtccgcccacagctgcatgcagggaatgtcggcgcgtaccggcaggctgccggcgccccagaaccacaggctgttgatgaccggcncggccgcctcttcgcgtgcgacgttgaccgggtgggcgtggaacagcatctgcgtttc

SEQ ID NO: 643236 - DNA, 346 bp, Homo sapiens
tgttcctcctccaaggactgtcccgttgcaatactgaatgcctttttttttttgagatggcgtttcgctgtcacccaggctggagtccagtggcacgacctcaggtcactacaacctccgcctcctgggttcaagtgattctcctgcctcagcctcctaagtagctgggattacagctgctaccacgcccgagtaatttttgtatttttagcagagacggggttttaccatgttggccgggctggtcctgaactcctgacctcaggtgatccgcctgcctcggcctcccaaagtgctgggattacaagtgtgagccactgcacccggcctgaatgctttttttgat

SEQ ID NO: 643237 - DNA, 1160 bp, Homo sapiens
ctttgactctcgtcgggaatcccactgattgaggttgatctcttcatcctcaaaaggtctcttcagacgtttaactgtgcccagtggtgctgtcaactgtgtatctatgaagcgccctagagctccgggacacatgataagaactcgctatatggggacgggtgctctcaaaggcttgtcagagcacatcactaacactattgcgcctgccctgattagcaagaaacttgaacgtcacgagaacaagagaagactctgagaagatctgatgatcgagactggatggaaacagagaaataaatctaactttggctgcgaacgccattgctggagggtagtccctatgccgtctcgcttatagctaggtagcctggatgagaagtggggtaccccactgtacgctgcaacgatcgctgactttggcctgaggtaactctgcaagtctatcctgccaagtcccgagcgttcaattgtcatacaaattggcggttctcatggctgtgcaacacagtctgtggcatagcgaggaagtacatgatctctcccaagtcggatagcatgcaaagcttgcagtgtaagtccatgcgacattggaggcagaggtaaagcgacaaagcctgaagaatgtcgatcgaacggacgaacctattggccgaaacaggatggccacccaaatagtagggccgcaaccaagggggcgcggcatagggctcgccagacagatacctggaagaagcgacaagaaacgggcctaggaagcgcgacggaaagaccggcgacgcaggggaaaaggctaggcatacacgcgaattaagggaaggggcacaccggacatagacagctgaagacaggaccaaactcggaagggtacatgcgagggggacatagcgaagagggagtgacagtggggagattcaaaaggtagtcgccggagaggaccacaaaagcagagaaaagagacaaggcccgtgaagaagaagggcaagacgcaggaaaccagaacgccgagacacgaggaggggaaaccccaggaggacgaataagaaaaagaaggccggtgagaaaggggagaaccatgggaagcataggacgaagaaaccacgaggaggcataacacagaagaagaggagaataaaatagaagagaagaaacagaaaaag

SEQ ID NO: 643238 - DNA, 401 bp, Homo sapiens
  misc_feature (361)..(361): n is a, c, g, or t
  misc_feature (391)..(391): n is a, c, g, or t
tcccccaccctggctgtggctcacccttgaacccaggaatcagagactggttcctctgggcccctggggctgggggtgctgcatccccagctttaacatttttattcttcgacccaggcacagtggctcacacctgtaatcccagcactttgggaggccaaggcgggcggatcacttgaggtcaggagttcaagaccagcctgaccaacatggagaaactgtctctactaaaaatacaaaattagctggcctggtggcacacgcctgtgatcccagctactcgggaggctgaggcaggagaatcgcttgaacctgggaggtggaggctgcagtgagccaagatcacaccatggcacttcancctgggcaacaagagcgaaagaaactccanataatactaa

SEQ ID NO: 643239 - DNA, 383 bp, Homo sapiens
cgacttctagaggatcccccccaaatgaatccgaaggatataattcctacgccctctcggctcgatgtaatcagttcgaataggttgtttgcggtaactaagattagtatggtcattaggaagattagtatatatctcaagaactgattaatgttcgggtctgagtttatatttcacacgtgagaattctatgaatggaccctgtcacgaacaatgctacagggatccttattatgtgcagccgtcgtctcagttttgaagcttagggcgagctgggttgtctgggtcgtggctcagtgtctgctcgcgattatcacttcttggtctaggcacgtgaatattgttgtgcggaagagactgctcctaaaggtggatgcgactat

SEQ ID NO: 643240 - DNA, 587 bp, Homo sapiens
  misc_feature (546)..(546): n is a, c, g, or t
gactggttctagcagggggctctggagtcagtacccatgcttcccgcaaattcttttcttgctccacagaattctgaagggaccatcgctaggagcagatgtagcctcggtgccatttgtgggatcgtcaggatgatggtggattgtggctggaaaggggtgtctgcagtgtgaggccatggggccttgcatgctcgcacagcttgggagggtggatgagggccatcctttggtaagcatcccatagcaaggccaggaaaggtgtgtggacagggcctcatgcggtggctgaagcattaaagcgatcggtggtgcttgagccaagcaagggcatggaggcaatgaccgaagcttacaggcagaggctaagctgggagagatgaaagcaggcaaggctgattggaaacctctggcctgatgtcacggtgtcttcccagctaggaaatcatcctcaaggcccctgcctgtgactggaggccatttccaggtagttgccacactgacccctgactgctactccttggcagtgcagtggggggggcctgnctcagacacatattccgaggaggagaagcagcaggtaccga

SEQ ID NO: 643241 - DNA, 221 bp, Homo sapiens
cgtagactgatagaatcgagtcggtaccgaattcgaaagttgtgcaaaaggtcaagtgtatctacccataagaggtacgagagtagtcaaatttatagggacagaaagaaggggggctgccaggggctggggaaaggaagaagggggaatgagtgtttcatggggacagagcttcgatttggggagatgagaaagttctggagatggatggtggtggtggc

SEQ ID NO: 643242 - DNA, 460 bp, Homo sapiens
gacatgaattacgtgccacaaggatggtggccaagtgctgggttggtgaggtgccggcggaaggatgagaatccacatctcaacctgacagtatgattttctaaccatccttatacacacttccaaagtgctgaaaactttatttcctcatgaaacacaaccattcatgagagattaaacttgcaggtgagaaaatacgcaggaaacacttatttctctatgaaaatatgagtctgaagaaagtcaagagactctacaaacatttctgcagccctctattggagatttgcaaaggtctgcatgtgcacccctttggatgtcaagggcttactgaataccatttccacacggtctatcgctatgtcaaagggcaactgctccaccatcatttctgatccacagacctgttagatgttagtctggagaaggagaaataaaactcaatgttgttaattgcaaa

SEQ ID NO: 643243 - DNA, 254 bp, Homo sapiens
agctgaaggctgcggggcctttcccatgtggcctgctgttgtgtatagcaacttcccagcagtcagcacggctactgtatctatggtcagtgtctcacctatttgtcacccgcagcttcaagtgtactcatattctccgtttcaaggcggtgtcaaatttctcgatttagctgttcgcaagtcttgatacgacaacgacatatcgaacgagcttgagaacagtctgcggattttcttggatgctgccgcgtgaa

SEQ ID NO: 643244 - DNA, 1975 bp, Homo sapiens
gcagaccgcatcttcttttgcgtcgccagccgagccacatcgctcagacaccatgcgggaaggtgaaggtcggagtcaaacggatttggatacgtatagggacgcctggatcaaccagggactgctataacaacatctgagataaaagtaggctcattgtaagccagtcacatgacccgcttcatctgcacctcgaacgtacactggtattacagtgtatccaagtcatgcattccacacccatgagccaaattaccgataggctacctgtccaatggcttggcagcaaccgagcgacagctatgtccaatcccaatgagaacattccccattcacacccaatcctatccacagaaaagccgaagccataccccttccccacacaaatacaacaggttgcgtggctcggcatagccttagagcagcccttgcaagctcaccgataccgattaggagaagtacccccaccttgggagctgattcgtaaacagaccccaaaccccattagcgacaagcaaacgcgccttagcgcagagcctacccaatccactgcacacgaggaagagagaagaaaagaacacctaaagaatacataatgaaggtaaccagtaaccacatagacgttactaaagagagcacacccaccaaaaccttagaggacttagaacattggaacacaacacaccccaactggatgaatgcacggactcacaaaactttcaaatctaccattctctctctagtacacaacacaaccccaacattaacacacagacaaaataatacatacaaattactcacacaccacaaaactccacaagaaaccacccatatacacaaatcttcacaacattccaacacaactccaaacatacaccaacaccatctactacccccaatatccccccattttaggaaccacacaaaccacaaaaacacaccaaaacaaaactccatattaggacactctataacaaacacaccacacaacccatcacaccacccaatatagtaagaacccaaccaataaatcaagatcgatatatcccaacactatacaccaacacaaaatatagaaaaaccaaacaaaccacagatctaatcaaaatcaagtagaccatcaacaatatcaccagagccacttgggctcgacaaactacctgggatggagacaatacgacggtgttaccccacgacgaatttgcgacactacaagccgctcaactatactcaccaagagtgtcggctcagccgccgcacaaacaagctggatgcatcccccaaaacataattacgcaacacctacactatgggagtatcgcacgccaacagatagcatcctccacaacataaagtggacaaaacaacggtcaaaaagacgacttatgcgaactacgaaagcgaacaacaattatacggaggagacacacaccacagcacaaataattacacccgaactgacaagtaagcagaaagaagtaacaaaaccacaattcgggaagattaagtcagcagaatctggtcaactagtcgcacaaacaataatagagagagaagacaaccaaccagctagatactacgacctagatactatgcatacgacacgcataattacgccacgttatagtaccacaccaaaccgacctacaaacaaaatccagaaagacaaaatattacacaacaaaattaaatccacactacctaatatttaaaataacacaccaaatttacgtcacactataaccacaaccacaaaaatagagagaatacacatagatagatcctacctaataagatgatcacacaccccacaaaaacaaaacacaacgatgcatacaccactcatacgacgataatcacagacgaatatacaacaacacaaacaaaagaagaagaaaaatacaacaaaacaattataccgcccactcctacaattataataaacatagaacacaattatagataaaacacacac

SEQ ID NO: 643245 - DNA, 216 bp, Homo sapiens
tcagtgtagtgactgctatggcaaaagaggttagtgatcttgaaggttagtggtaaacgatggctagttgtataacagaagacccggtctcactctgttgtccaggctagagggtagtggcacaatcatagctcactacagcctcaagctcctggacttaacctcctgagaagctgggattacaggtgcacgttgccagggccggcataaattatt

SEQ ID NO: 643246 - DNA, 116 bp, Homo sapiens
gtagaggtgtggaggctcattctctcatcaggcggacgcagtggcgtgatctcagctcacgcaacttcgcctcccgagcccaagtgatccgccaacctctacaacctccacaacct

SEQ ID NO: 643247 - DNA, 233 bp, Homo sapiens
gggttatgatgcctccgttacttcataaaatatccaactccatacaaatgagtatttaaaacaagaagtttactacattttaatttctatttcattagctttcatatagtaactacagttcaggggacaaaacaatattttggcctgtatccacataaatcccttctttaaaggaaggtctccgtgctttaaatatttaaactctaaacaactaaggggcatcgataaacacg

SEQ ID NO: 643248 - DNA, 267 bp, Homo sapiens
agtaatggttaagggggagggatttttttcaaatgatcagtcccctgtggaacagtttttccctgggcctagttcgccagcgttgtgctcctcatggacgggagcgcagtggggaaggtaggggaaaaatgaggcccagtgttgatggggcagtgaccagacagtcctgagacccaaaaggcccaggtggcccaagtgtttttggtggcccagtttggccagcacacactttcctcctatagcaccccctttaccccctttagagcc

SEQ ID NO: 643249 - DNA, 261 bp, Homo sapiens
ccggtattttaagaacatgccgtacccaaagtctcgctatctgccgaggttgtcctaatgccaagattcgcatttgttgacctggggcggctaaaggtataagtggataagtttcctgctttgtgggcacatagtgttcgattaatatcagcagctgtcctctgaagccctgtgaggctgtccgaattcgtgccacttcgtacatagtaaaaagttgtggccgagatggcttccatatccgggcgcagtctgtgcacgggc

SEQ ID NO: 643250 - DNA, 154 bp, Homo sapiens
cccagcttgaaactggaacttttgattgacaaattaataaacctctctatgcctcaggtctcatctgtaaacaggatgctaccgtatgggttggtgtgaggattaactgagatcacacttgatagtgccttgcatggcttggcatgtgggtgct

SEQ ID NO: 643251 - DNA, 217 bp, Homo sapiens
ctattcctgtgagggatcattatgagcaagctccatctgcctacgacaaacaggacctaaaatcgctcattgcatacgcggcaatcggccacatagccctcgtagtaacaggcattctcatccgaagacccccgtgaagcttcaccggcgcagtcaattctctatatatcggccaggggcttacatcctcattcactattgtgcctcaggtagagca

SEQ ID NO: 643252 - DNA, 305 bp, Homo sapiens
aggatttaaagtttaatggaaattttgttttttataccccccaatacaaacaagtaattccaaacagatcaatccctttcctttcagtagttatgctgggcaactttgtaatcatatttaattaatttttttcactaaggggaaatgttcattaacctaattagcagcttttttttagaagctaattaataaagggaagtgtcagtgatggtatttatgggaggtgttaaaaattctcaaaacttcttttgtttgcatacacaggaaaatttctatattttttggcgttagaaggggataaaagt

SEQ ID NO: 643253 - DNA, 544 bp, Homo sapiens
gcggaggtcagtgggcaggcaaagatggtacagtatcttgcaacgaaggatgcttaatcttaaacacggaaagactggaagaagggaatatacaaggaggaggtctccagaaaatagtcagacaaataacagagccttaaaattagaagcttgggggctgggtgggccaggttctcaattgctgcctctacaggaaagtcttagggttcggaggattccagaaacatgaaggagaagtgggaggacatggagagtgtcctcaaggacctgacagaggagaagagaaaagatgtgctaaactccctcgctaagtgcctcggcaaggaggatattcggcaggatctagagcaaagagtatctgaggtcctgatttccagggagctactcatggaggactcagacaagcctctcctaagcagcctttttaatgctgctggggtcttggtagaagcgcgtgcaaaagccattctggacttcctggatgccctgctagagctgtctgaagagcagcagttcgtggctgaggccctggagaaggggacca

SEQ ID NO: 643254 - DNA, 217 bp, Homo sapiens
  misc_feature (67)..(67): n is a, c, g, or t
  misc_feature (125)..(125): n is a, c, g, or t
  misc_feature (163)..(163): n is a, c, g, or t
  misc_feature (175)..(175): n is a, c, g, or t
tgacctcagttgatccacccaccttggcctcccaaagtgctagtattatgggcgtgaaccaccatgnccagccgaaaagcttttgaggggctgacttcaaatccatgtagggaagtaaaatgganggaaattggggtgcattttctaaggacctttctaacanatggctataatntaaggggtttagggtccttttttttttttcagggatacattt

SEQ ID NO: 643255 - DNA, 229 bp, Homo sapiens
taaggagtgcccacgagaaagaaacatctacactcaaaggaatggaaaaagatattccatgcaaatggaaaccaaaagcaagcagaaggagctatacttatatcagataaaattaagtcaaaaagagtaaaaagggctgggtgtggtggctcacgcctgtaatcccagcactttgggaggccgaggtgagctcagaagtttgagaccagcctgggcacacattatggag

SEQ ID NO: 643256 - DNA, 336 bp, Homo sapiens
  misc_feature (96)..(96): n is a, c, g, or t
cagggtcccctcccatggggtctggcctccgttccagcatgtccagcccctaaagttggagtgggggtcggtctgcctttgctccccctggcaggntttttcctcccccttcccctagggccctacatcgggattgggccccccccctgggtggtcttttgagtatgggccgcccctggccacaatggccggccgcagggggggtggggttttcccccaccaacgggtgccccctctttgcccccggacccccggccgcctacccgggccccccccttaccttgtgtgttcttggtggctgacgaatgaatgcgtggccaataaaaagcaaaccta

SEQ ID NO: 643257 - DNA, 168 bp, Homo sapiens
ggtctgccgccaagtacgttaatacccccgagactccggtctacaagaaatcacatgtcctgtacggactggatcctggtcccgggccaacatcggtctaagaagagccaggccgtcatcgtcgaggggtacaccgacgtcatggcggtgcacctgtccggcatagat

SEQ ID NO: 643258 - DNA, 183 bp, Homo sapiens
ccgtcctggagagatttatcagcccttagatagttgctatgacttaatcagttctacaaggcttattatgaaaagcaatatacacatccattcccctctccccagaggcatattggtagctatttttataaaccatcattatcttatgtgaaggatgggttaggcataaagggagttagggaa

SEQ ID NO: 643259 - DNA, 121 bp, Homo sapiens
atgtatacaagcaacaatttgttatttttatttttttggatttttaaggccacctctgtgggcatatggagtttcccagtctaggggtcaaatcagagctgggagctgccagccttacacc

SEQ ID NO: 643260 - DNA, 663 bp, Homo sapiens
  misc_feature (20)..(20): n is a, c, g, or t
  misc_feature (80)..(80): n is a, c, g, or t
  misc_feature (87)..(88): n is a, c, g, or t
  misc_feature (92)..(92): n is a, c, g, or t
  misc_feature (95)..(95): n is a, c, g, or t
  misc_feature (117)..(117): n is a, c, g, or t
  misc_feature (126)..(126): n is a, c, g, or t
  misc_feature (131)..(131): n is a, c, g, or t
  misc_feature (142)..(142): n is a, c, g, or t
  misc_feature (144)..(144): n is a, c, g, or t
  misc_feature (149)..(150): n is a, c, g, or t
  misc_feature (162)..(162): n is a, c, g, or t
  misc_feature (190)..(190): n is a, c, g, or t
  misc_feature (193)..(194): n is a, c, g, or t
  misc_feature (196)..(196): n is a, c, g, or t
  misc_feature (200)..(200): n is a, c, g, or t
  misc_feature (224)..(224): n is a, c, g, or t
  misc_feature (232)..(232): n is a, c, g, or t
  misc_feature (234)..(235): n is a, c, g, or t
  misc_feature (251)..(251): n is a, c, g, or t
  misc_feature (257)..(257): n is a, c, g, or t
  misc_feature (266)..(266): n is a, c, g, or t
  misc_feature (301)..(301): n is a, c, g, or t
  misc_feature (313)..(313): n is a, c, g, or t
  misc_feature (379)..(379): n is a, c, g, or t
  misc_feature (381)..(382): n is a, c, g, or t
  misc_feature (409)..(409): n is a, c, g, or t
  misc_feature (416)..(416): n is a, c, g, or t
  misc_feature (439)..(439): n is a, c, g, or t
  misc_feature (444)..(444): n is a, c, g, or t
  misc_feature (470)..(470): n is a, c, g, or t
  misc_feature (474)..(475): n is a, c, g, or t
  misc_feature (480)..(480): n is a, c, g, or t
  misc_feature (482)..(482): n is a, c, g, or t
  misc_feature (495)..(495): n is a, c, g, or t
  misc_feature (497)..(497): n is a, c, g, or t
  misc_feature (499)..(499): n is a, c, g, or t
  misc_feature (518)..(518): n is a, c, g, or t
  misc_feature (572)..(572): n is a, c, g, or t
  misc_feature (577)..(577): n is a, c, g, or t
  misc_feature (583)..(583): n is a, c, g, or t
  misc_feature (603)..(603): n is a, c, g, or t
  misc_feature (635)..(635): n is a, c, g, or t
gcctgcatacatctcaagtngggggacaaaaaagggggaagggggggcacgaaggctcaacattaaaaaaaaaacaaaanaaaaaannatanaangcgaagattcaacaaaaatttngcataacanaattnacacgaaagcnangcaannacctcccctgtntggacttgggagaggactgggccattcnccnnanaganaagtggggcggctataaggaaggnaagggacnannaataacaatgcatctnaaattntcgcgcaancactaccaaaaaaacaacaatgtgcaaacaaagtnctcggccacatngtgcaacctggggggaggcccgccccaaccgactgcagtaaccttcaccgtcccagtatttaaatncnnagtaaagccaaaaaaaaaaaaaaaacnaaaaccncccaaaaaaaaaaaaaaaaaacnaaacnaaaaatcaacaagtttcctgcgcaantaannttttntnaagaaagggtgtnangnaactaagtaatagttcgcntagaagcatttgcggtggacgatggaggggccggactcgtcaaactcctgcttnctganccacanctgctggaaggtggacagcnaggccaggttggagccgccgatccacacggantacttgcgcccaggaggagcaatgatct

SEQ ID NO: 643261 - DNA, 222 bp, Homo sapiens
  misc_feature (142)..(142): n is a, c, g, or t
  misc_feature (147)..(147): n is a, c, g, or t
  misc_feature (151)..(151): n is a, c, g, or t
  misc_feature (162)..(162): n is a, c, g, or t
  misc_feature (210)..(210): n is a, c, g, or t
gcagcattgtgtgatattctcagaggcaggggaaaatagagggaaaatatagagactatttgtatgttcttcccatcagcgaggtagtgtaacgtggcaccactgtgacgggaagtagaacagtggagatgggaaatgagangtccnaccnctgtgtagcangatttaggggccaagtgcgtagcagtgtgagacagagatcccttgganttttgtcatgtg

SEQ ID NO: 643262 - DNA, 940 bp, Homo sapiens
  misc_feature (3)..(3): n is a, c, g, or t
  misc_feature (81)..(81): n is a, c, g, or t
  misc_feature (96)..(96): n is a, c, g, or t
  misc_feature (107)..(107): n is a, c, g, or t
  misc_feature (110)..(110): n is a, c, g, or t
  misc_feature (127)..(127): n is a, c, g, or t
  misc_feature (135)..(135): n is a, c, g, or t
  misc_feature (138)..(138): n is a, c, g, or t
  misc_feature (144)..(145): n is a, c, g, or t
  misc_feature (148)..(148): n is a, c, g, or t
  misc_feature (161)..(161): n is a, c, g, or t
  misc_feature (164)..(164): n is a, c, g, or t
  misc_feature (171)..(171): n is a, c, g, or t
  misc_feature (175)..(175): n is a, c, g, or t
  misc_feature (182)..(182): n is a, c, g, or t
  misc_feature (216)..(216): n is a, c, g, or t
  misc_feature (237)..(237): n is a, c, g, or t
  misc_feature (254)..(254): n is a, c, g, or t
  misc_feature (274)..(274): n is a, c, g, or t
  misc_feature (309)..(309): n is a, c, g, or t
  misc_feature (336)..(336): n is a, c, g, or t
  misc_feature (385)..(385): n is a, c, g, or t
  misc_feature (414)..(414): n is a, c, g, or t
  misc_feature (450)..(450): n is a, c, g, or t
  misc_feature (543)..(543): n is a, c, g, or t
  misc_feature (549)..(549): n is a, c, g, or t
  misc_feature (574)..(574): n is a, c, g, or t
  misc_feature (583)..(583): n is a, c, g, or t
  misc_feature (585)..(585): n is a, c, g, or t
  misc_feature (588)..(588): n is a, c, g, or t
  misc_feature (627)..(627): n is a, c, g, or t
  misc_feature (715)..(715): n is a, c, g, or t
  misc_feature (878)..(878): n is a, c, g, or t
  misc_feature (898)..(898): n is a, c, g, or t
  misc_feature (915)..(915): n is a, c, g, or t
atncctattacaaatttcagctgtgggatattggctggtattctggcctcactggtaacttcaactgcggatgttatcaanactcatatgcagctntatccactgangtntcaatggattggccaancattgacnctnattttnnaanactatggaccatnttncttcttntaangtggcancccccgagccctccgcagaactcgatatgtcagnaatggcgtggacggtgtatgntgagatgatggccaagntgggcctgaagtcctgaccnagagaggactgggaacgtgcgaaatctttttcccngcttggcctctgccaagggctgctgcntcttactattctgcagtaagatgaagtcctacctggaaaaccaggcagnaattgtgttgcctttgccttcagtaatcnccttaaggagaaaatatatggacctgatttcagccntcagaatctccaaaagaggagtcatcaattcatagagcacactagggtgttaggagagagctttgtatactctgagaggctacttggaaaggnattttnccaggagagttctttcaggtgctgngcttcagcncnacncctacaccacagggtctctttgggtatgttcttgggcangcaattacaaagccagagaagctgtaagctgcctgccgggcttgaggagctccaaccagggaagactggatgtgaggagaggagttantgtcaccaggtcacagactgactgaggtgatggtaggatgaggaggaacagatgcccttctttaattggttctcagttaacttctcagaggctctggagaacgggacagtggctttctagcctttgaatgttccaaataaaattttttggtcttggcccctgnactgttttacctctaaattntggcattttttttcccngcaattaaagtgctaaactttaaaa

SEQ ID NO: 643263 - DNA, 364 bp, Homo sapiens
  misc_feature (325)..(325): n is a, c, g, or t
agtaaaccacaagctgcagagccagagcatgttttttatgcctggaacagctaacatccaaaccaaagtgcatgctgtcagttgaggacaaacaagcgaagaggagccaaaaaggagcacctgtccacccatccatcaaccgagtacaagagggtgcctgagggaccagtgcagaactggcagacctaggagagtggctcaaggcctgctgggcaggtgcatggacctagacctgcagggtcgctcccaggaacagcaagagtcagaagacccaggtcaagggaggcagagacaaatgtttccagatgaagcaggagagcactgncgccgatctccagggccctgaggcaatgaggagtgcaca

SEQ ID NO: 643264 - DNA, 903 bp, Homo sapiens
  misc_feature (7)..(7): n is a, c, g, or t
  misc_feature (280)..(280): n is a, c, g, or t
  misc_feature (305)..(305): n is a, c, g, or t
  misc_feature (323)..(323): n is a, c, g, or t
  misc_feature (331)..(331): n is a, c, g, or t
  misc_feature (338)..(338): n is a, c, g, or t
  misc_feature (359)..(359): n is a, c, g, or t
  misc_feature (361)..(361): n is a, c, g, or t
  misc_feature (365)..(365): n is a, c, g, or t
  misc_feature (391)..(391): n is a, c, g, or t
  misc_feature (411)..(411): n is a, c, g, or t
  misc_feature (440)..(440): n is a, c, g, or t
  misc_feature (466)..(466): n is a, c, g, or t
  misc_feature (470)..(470): n is a, c, g, or t
  misc_feature (481)..(481): n is a, c, g, or t
  misc_feature (485)..(485): n is a, c, g, or t
  misc_feature (495)..(495): n is a, c, g, or t
  misc_feature (526)..(526): n is a, c, g, or t
  misc_feature (539)..(539): n is a, c, g, or t
  misc_feature (561)..(561): n is a, c, g, or t
  misc_feature (585)..(585): n is a, c, g, or t
  misc_feature (597)..(597): n is a, c, g, or t
  misc_feature (601)..(601): n is a, c, g, or t
  misc_feature (610)..(610): n is a, c, g, or t
  misc_feature (623)..(623): n is a, c, g, or t
  misc_feature (631)..(631): n is a, c, g, or t
  misc_feature (634)..(634): n is a, c, g, or t
  misc_feature (665)..(665): n is a, c, g, or t
  misc_feature (687)..(687): n is a, c, g, or t
  misc_feature (771)..(771): n is a, c, g, or t
  misc_feature (790)..(790): n is a, c, g, or t
  misc_feature (794)..(794): n is a, c, g, or t
  misc_feature (900)..(900): n is a, c, g, or t
attactncattgtttacaatggaaaaaataagttttaagtagtgttatttttcattgctcaaattctattcaattcttatacaccaaaggagcatctacatgtcatttagcgtttagaggattaatttataaactcatggattccagagtagctgatgaagaaatgacctaagagtctttataaaaaacttatttttcttatttgtaaagtagcaaccacaaggtgaaattgttttttttttttatacaacagcaacaacgacaacaaaaaacaactacnagggagaaaaaagaatgattccccnctaatacaaattcattcnctattgtnctaaacncacacattcagattatagttncncctncatttaaaataagtcaattcacttcnggctgtcagtctgaattacngaaaaggtttaaactttttttttaattgnggacaagtccaattaaccagtaaaanattnccaacaatgcntggnaaatgtttcncccataaagcaattcccttaagatgtaagcnagtggcagaaaanagaaaaacaatgaaagtatggngaacactgtagcttcatttaatanaaaaacctcccngggngggggtttngcccatgtttganttcaaganatncttataagcagaacgctacttatctcttgtntataaagaatgtaacataacanaagttccaaaaatggtatctcctaaaactactaaaagacaaggtttaagtagctttttttcccaaccaggtagggaactattanagctgaggacacttgactnagtncttttatatgtatgttgtctcaaaactttttactgaatcaataaagaagattattttgattttttattgttgctgaaaatatatagcagagaatactacaaattanagt

SEQ ID NO: 643265 - DNA, 434 bp, Homo sapiens
tgttctcagtgcccttgggcacatacctaggagcggaattgctgacttatgtcataacactctgtttttgaggagctgcctgacgattttccaaagtggctgcaccattctactttcagcagtgtgtgagggttcccatttctccacatcttcaccagcatttgctattatctgcctttttttttattccagctgtgatgctgggtgtgaagtggtatctaattgtggtttgatttgcatttccctaatgactaatgatactgagtatctttccatctatttatctgccatttttatatcctttttagagacatgactatgtgaatccttgggctatttttaaattgacttatttgtccttttattgttgggttgtcagagttctttatatattttggatacaggttttgaatgatatatatgtgttgcaaata

SEQ ID NO: 643266 - DNA, 86 bp, Homo sapiens
cttacatgccatggccttctacgttgtgaaaatgtacaaacacctgaaatgtaaacgtgaccctcatgttaagatagaagggaagg

SEQ ID NO: 643267 - DNA, 1065 bp, Homo sapiens
ctctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagctactcaggaggctgaggcagagaattgcttgaacccgggaggcagagtttgcagtgagccaagatcacaccactgcactccagcttggacgacagagcgagactctgtctcaaaaaataataggccaggcatggtggctcaacgtctgtaatcccagcactttgggaggccgaggcgggcagatcacaaggtcaggagttcgagaccagcctgacgaccaacatggtgaaacctcgtctctactaaaaatacaaaaattagccaggcctggtggcacgcgcctgtaatcccagttacacagaagactgaggcaggagaatcgcttgaacgcaggaggcagaggttgcaggagctgagatcgcgccatggcactccagcctgggcaacagagtgagactctgtctcaaaaacatataactaaataattgaacacacttgctgctgagtccgaggggggcagagcagaggacagcgtgctttgtgtaccgttggaaagacttggtcctcctgtacagcaacatctgagccacttgtgcaccgcctgccagggaacatcaggacatggccggtgacaccacagatactgggagcagtcaagcctaccgaaaagccggattggccgatgatacaactgagagggcctgtgtaacattaccacgtattccaagggcaatgggctaaactgaaaaggatgagagcagtataaacatagtgatacaaacacttgtgaaagaacatcatgagagatagctgaacatcagactcaaaactcctacaactggtacaccactataacaaatacaaaagacaaccccgcactaatccaataatctactaatgacaatcatcaacttgaccaatataatgag

SEQ ID NO: 643268 - DNA, 1250 bp, Homo sapiens
ggccgaccacggatttgcattgccgaggatgtgaccccagggcagcgaagcagcaatggccaactatgcatgtggactggtggacaagactggaacgagctgtacagtcgcctggagtcagctgtctgcagagtcccacaggcccccgtgtcgcaactgcgtgggaaagtcaatggtgtcattgcaggtgtggcaccctccgatggaagcctttgaacaagctgatggacacgtatggtggccgagatgattaaagaacacgtaggatccttgctggggacgttggagacctcatgcatgatattgtgtgcacacgatgctttaccgaggtcccatgcggggcttaccgttctgatgtgcctctcagtaccagacaagcgccacgagaatgacgtggtcgacacttctgaaatccatatcgggaaagagatgcaggaacatcccgagagttcagcagatgagataagcgggggcagtaacgatgtaaagtcagtctttcgggctgccagcgaaaggcatccctgcccttggatggataggctgtgtctcccataacctgtatccttattgtcaaggtaggatgacatgacgctgacagcctttgacactaacagaggtcataaaacgagactacaaccacgagggatcggcgtcactgtgcattgggtcaaagccatattggaccatcgggaggtcacccttcacagccatacatcactggaaggccacaccacagtggcgcacgcctagtaagcaaaacaagggcatggcagaatccagccgatcaaggagagcgggcctcaccgttgggggcagggcttactgcacacccggaaagcaaggcaccacacaggggaccctactataacgagaagaagcggacaaagagagcaccagccaccccagagaattgagacgaaaacggggaacacgacagcaaggcgccccgcatcgatagatcagacgaactaatataacgaccacggcaacgagaggagatactccatagagtacacaagagataagaacatgcataatcagcggcgttaggcagtgggtagccaggtggctcaaaacgtatgatgagagtatgaagctttctacgtcatttgtcactggtcgtatggagagacatgagaaatcagaagagagaaacacaatcacgtacaacgagaaacacagagacgacgagacagtagacgagagagatcagagcgagaaaaggagataaggacaacagtagaagcaag

SEQ ID NO: 643269 - DNA, 187 bp, Homo sapiens
  misc_feature (3)..(3): n is a, c, g, or t
  misc_feature (9)..(9): n is a, c, g, or t
  misc_feature (39)..(40): n is a, c, g, or t
  misc_feature (85)..(85): n is a, c, g, or t
ttnagggtnaagaataagagggtgaaaggaaatgaggtnnagttgggtttaaaaatggagaagcagtaagaggcaaaacagtatnaaaagttaattaccacaggaatttagaagtgactataaaaaataaaatggcccttcttagaagactagagcaaaagatccagccatagttataagccttatt

SEQ ID NO: 643270 - DNA, 973 bp, Homo sapiens
  misc_feature (10)..(10): n is a, c, g, or t
  misc_feature (76)..(76): n is a, c, g, or t
  misc_feature (78)..(78): n is a, c, g, or t
  misc_feature (80)..(80): n is a, c, g, or t
  misc_feature (109)..(109): n is a, c, g, or t
  misc_feature (113)..(114): n is a, c, g, or t
  misc_feature (125)..(127): n is a, c, g, or t
  misc_feature (144)..(144): n is a, c, g, or t
  misc_feature (188)..(188): n is a, c, g, or t
  misc_feature (199)..(199): n is a, c, g, or t
  misc_feature (207)..(207): n is a, c, g, or t
  misc_feature (220)..(220): n is a, c, g, or t
  misc_feature (237)..(237): n is a, c, g, or t
  misc_feature (241)..(241): n is a, c, g, or t
  misc_feature (254)..(254): n is a, c, g, or t
  misc_feature (262)..(262): n is a, c, g, or t
  misc_feature (281)..(281): n is a, c, g, or t
  misc_feature (288)..(288): n is a, c, g, or t
  misc_feature (309)..(309): n is a, c, g, or t
  misc_feature (313)..(313): n is a, c, g, or t
  misc_feature (316)..(316): n is a, c, g, or t
  misc_feature (320)..(320): n is a, c, g, or t
  misc_feature (331)..(331): n is a, c, g, or t
  misc_feature (384)..(385): n is a, c, g, or t
  misc_feature (387)..(387): n is a, c, g, or t
  misc_feature (415)..(415): n is a, c, g, or t
  misc_feature (455)..(455): n is a, c, g, or t
  misc_feature (640)..(640): n is a, c, g, or t
  misc_feature (672)..(672): n is a, c, g, or t
  misc_feature (731)..(731): n is a, c, g, or t
  misc_feature (777)..(777): n is a, c, g, or t
  misc_feature (864)..(864): n is a, c, g, or t
  misc_feature (932)..(932): n is a, c, g, or t
atttgtttgnagtctccaaacgagaagacagaagaaaagaaacagaaaaaatatttgaagaatttggactcaaatntncnaagtatgcaaagaatacgaatgcagaatnaagnngatccatgaannntggccccgacaacaggntcacgggcatccttggaggtcgcgtagtccataccatagaagtngagccccaggnggcttttntttcgccacttgngctttgggtccaggtcntggncgcaggctcgaanccaggtgnggggtgcattagggccagngtgatgngctgtagagtagtggtaggtnatgnggntganaccatccagcntgggggccagctgctcaaactccttgttcgttatcatgcccagctggtcggtnntnggggttatggtaggtgggatgatttggngggccagcagctgggcctggtgcagagcctcggccaagtnggtgagcatgtggatgaggcccacgcgcttttggcttagcagctggttccagacctccaccacgaagccatcgaaatgctggttctttgccacctggaccacggtcttgctcagctcctctatctcatcctcactgtctaagacgttccggaaatcatcgtaagttcagttctcaaacaggagcngaggcactatgtgcaggcccttggcatgcttnctgacagctcgcatccacccttggtccacgtcgtggaggcccgtgacctcaaacatctnacggccacgtctcttcagctgcagccagacgggtgagaactgtgtnaacttgctcccaaagaccttggtgacatcgtagccatggctgttccatggagttacaaagcccagtacatccccagcaaagtgtctnttccgggcctttgccgagcagtagctgcgatgctcaagaaccacactctcagctttgaggtccgttancaccaaacccccggtcttgcaccggcttatcttaaaactga

SEQ ID NO: 643271 - DNA, 526 bp, Homo sapiens
cggcacgaggctggcgggccgcttcgacgcgcgttacaagatcctgctcgggctgggcctgaccagcctgtcgctgtgggagatgacggccttcaccaccgacatcagcgcctgcgacatcgtgcgcaccggcgtgattcaggggctgggcctgggtttcatcttcgtgccgctgtcgaccatgacttttgccacgctggcgccgcgttatcgcaacgagggcacggcgctcttcagcctgatgcgcaacatcggcagcagcatcggcatttcagtcgtcatcacctacctggcgcagcgcacgcaggccaaccatgccgtgttctcggaatacatcgatcccgcgagtctggcggtgcgccaggcggtggagagcggtgcgatggacctgggcacgccgctgggcctgagcctggtggacgcgcaggtcacgcggcaggcggccactctggcttacctgcaggatttccgcctgatgatgtgggtgacgctgtcggccatcccgctgctgttcctgttgcggccg

SEQ ID NO: 643272 - DNA, 974 bp, Homo sapiens
acatggaggcggaggtcgataagctggaactgatgctgtcaccactgactaaagaagagaaaactgcggcagagcaattcaaatttcacatgccagatttatgaacgaacatggacttggcaaaggacaattctaacagagaagagcttaacttccggagaacatttacggaacgatgtctctgttaacccttgatgtctacgagacttgggcggctggctgaacgggggttctggcttcaactgacctggataatgatatctttcactgagagagacttatacagaagaacgggcagataactatactgaactaaacgttcagccaaagaggatcaaactgacgaattaaaacgactttcaacactatcatgtacacagcgccatgcacacacacactatagctcttgataaatttcagcgcccagcaacatcctcaaccactatcttatgcactctgtaccacctatttagcttacagtcatgactcacatatagcatgtcctggtctaatcataaaacagcaactgttctactgtcacattcaccagcacattccgagatatcgtggcttaggtaacaattcaaaacgtatacgcgccaacacacattacggcgtcacaaacatcgcatactataatttacaatatcggtacaacagctagcagtcgcaccactatcggccaccatttacacgcttgacgacccgcctcttactgctggacccctggcaggatcctccccagcaagcaaacaccacaacaaggctaactaaaggcccgaacacttcttcctctggacaaattagcccaagatattggcggtaaattacacacagacccgtcagtcttcaccataggacatagccaaaggaaggaaccaagatgaacccttgccagcacgaagtccctgttacaagagcaggaccggagttggaatccaacataatatagcctgcgacactctaccggctta

SEQ ID NO: 643273 - DNA, 2667 bp, Homo sapiens
  misc_feature (10)..(10): n is a, c, g, or t
tttcttctgngagctttatttgtgaaccctcttgcagtgtcacactgagtccccgccagggcctcccgaggatcccactaaggggcatcttccagggagcgaaggtggtgcgaggccccgactgggagtggggctcacaggatggtgagtggaggcagaggggcggggtcagggctgggctgtggctggctcatggctcagccttagcctgctgggggggcctctttccccaggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 643274 - DNA, 889 bp, Homo sapiens
agacgatggctgaccacaagcctgacagcgactccacgccgcgcacgctgctgcgactgcgtgcgtaggatacagcggacccagtgcacgcctcgggcgaccccggagtgctcgggcgtggagcccggagtagccctgcgttgaaacggcttccgcccaggaagttgagtggccaagacatacggtagctgatagccacgtagtggcgttccccatggtacgccagtgtctgttggcacgagtcggcccgatattcaggccatgtgggcgacgttggcaaggatacatgacgaccgtctggactgctgacgtgagagaagcatccgtactaagcgtgcgcccagaagtcttccatcctgaatgccgtgaggtcggtacgtgaaggccagatgccagcaccgtcagggcggtccaaccctaccggagcagagatgatgcagattgcgggcagtcctgtgagtcatgcgaatcttgcctgaagctcgcagccgctcgccacaatccctggtctccgaggtcgtgctggtcccctggccgggaggataacagaggctgaggactgtcagtgtttcagcagcggaggtggcaccagggtgactgtcgtctgctctccaaggagcctcaagggaatgcttgatgccgtcttccctcaccagatccctcagcctgacctttgccaaacctcttcagccacagtcagtgctgaggcctggctttggcccgcagacctccagtccgccgagctgtagacgtgggtgcctttttgcgggatctgcgagatacttcgccgtggctcctccaaacattgtgttggaggacacccatgccgttctctcaggccatgggttggtcgccccaacgtgtatccattcccttgccttgaagccat

SEQ ID NO: 643275 - DNA, 274 bp, Homo sapiens
gtcgctcctccaggttttcccgctggggggtggtggatggtgtcgccactcggcggcgctgccgcacgccgttgccgtccttgtcgcccccgcggccggcctcgcggctctcctcctcgttgtccgtgtccttccatcttcctggccctcctgcccagtgcctcgtggccacatgtccccggggtcacagtgcccggcagttcgatccattttgtgccatctgtgtgcccatgtgcccaaccccggggcatcctctcacgtcgcactgcaggcc

SEQ ID NO: 643276 - DNA, 3698 bp, Homo sapiens
  misc_feature (360)..(360): n is a, c, g, or t
cgggcccgggtaggacggtcccggactggccgtgatctcagcggtgtccaggtccggcgtgactcgaaaccgccggataggcccgcactggtggagtcggcaagagctgacttacggcgcggcaagtgccggccagtgccagcgagcgcgacgtcgctcgccaagcccccgtctctatggcaaccgagtgcgtctctaggaccgccacggcgcaggcgcccggaggctaagccgctcggaacctagctgcgccacgcagggtaggcgacgcagacgctcccgcgtgacgcacttccggtgcttgccctgcccatccccgtgcggtgggcgtggccatggcgggggcgctccggccggcgncggcccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggacatggggcgccggctgctggggctgccaggtgccaggagacgcctccctcgggcctgccccggcgcccgccctcaccggcgtctgtcctgccgcccagctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 643277 - DNA, 244 bp, Homo sapiens
ttttttcaaaaaaaggggggtttttgggttaaccccccccccccaaaaaccccttcctctatgggggaacccccttgggggcccccccttcctttataaaaatttttttgggggcgggggatttccctttttgggggggggtttgaattttcccttaccccaatttgcccccacttgggggtgggggtttttgttccccccccctttggggttttgaggttccccctaaaaattttgtttttca

SEQ ID NO: 643278 - DNA, 3656 bp, Homo sapiens
  misc_feature (360)..(360): n is a, c, g, or t
cgggcccgggtaggacggtcccggactggccgtgatctcagcggtgtccaggtccggcgtgactcgaaaccgccggataggcccgcactggtggagtcggcaagagctgacttacggcgcggcaagtgccggccagtgccagcgagcgcgacgtcgctcgccaagcccccgtctctatggcaaccgagtgcgtctctaggaccgccacggcgcaggcgcccggaggctaagccgctcggaacctagctgcgccacgcagggtaggcgacgcagacgctcccgcgtgacgcacttccggtgcttgccctgcccatccccgtgcggtgggcgtggccatggcgggggcgctccggccggcgncggcccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaacgcagccctgatgtggccaccagtgtgttgctccttgatgttgctggtgttgccttgtgtgctgtgtactggctcattcaatcatgtcatccccatgaatgtcacgatgtcagcttgcactggtgtgcctgttgcacgatggtggcccttccttggcacgtgtggttgctggtgccctttgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 643279 - DNA, 260 bp, Homo sapiens
atttctaaattgtctgttctgttttctcagaatttcttatgaagcttttaagcatcaattcaaggaaaatttaaaaatatcgattgtcttccaagaaaactattccccacctcccgtttagttggaacaacgtaaaaacagacattttcaatcacctgaacatcattctccgagttctcacgctaattaaaaatacaaaaatcgatgttctttctgtttcgtgcacattaaaaattcgtttgaacctgaaaattttgtaa

SEQ ID NO: 643280 - DNA, 3417 bp, Homo sapiens
  misc_feature (360)..(360): n is a, c, g, or t
cgggcccgggtaggacggtcccggactggccgtgatctcagcggtgtccaggtccggcgtgactcgaaaccgccggataggcccgcactggtggagtcggcaagagctgacttacggcgcggcaagtgccggccagtgccagcgagcgcgacgtcgctcgccaagcccccgtctctatggcaaccgagtgcgtctctaggaccgccacggcgcaggcgcccggaggctaagccgctcggaacctagctgcgccacgcagggtaggcgacgcagacgctcccgcgtgacgcacttccggtgcttgccctgcccatccccgtgcggtgggcgtggccatggcgggggcgctccggccggcgncggcccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 643281 - DNA, 3564 bp, Homo sapiens
  misc_feature (360)..(360): n is a, c, g, or t
cgggcccgggtaggacggtcccggactggccgtgatctcagcggtgtccaggtccggcgtgactcgaaaccgccggataggcccgcactggtggagtcggcaagagctgacttacggcgcggcaagtgccggccagtgccagcgagcgcgacgtcgctcgccaagcccccgtctctatggcaaccgagtgcgtctctaggaccgccacggcgcaggcgcccggaggctaagccgctcggaacctagctgcgccacgcagggtaggcgacgcagacgctcccgcgtgacgcacttccggtgcttgccctgcccatccccgtgcggtgggcgtggccatggcgggggcgctccggccggcgncggcccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcggccaggccttgcccattttcggcaatccatcgggaccgatccgaatttcgagttagcaggccgtcagcggccggactgcttcggtccccgcctggtttataacgaagatctggcactt

SEQ ID NO: 643282 - DNA, 202 bp, Homo sapiens
actgctatccaacgccgcttgcaagctgatatagcggggccatttcacaaagcgcgagtgagagtctcttgtagggctggatgtactgttcaattgccaaacttcttacgcctatttctcataacatgggcgattcaccacatttcttacgcctcactgcttcttctatcgacagctagggtgccggagccaccattacttt

SEQ ID NO: 643283 - DNA, 3299 bp, Homo sapiens
  misc_feature (360)..(360): n is a, c, g, or t
cgggcccgggtaggacggtcccggactggccgtgatctcagcggtgtccaggtccggcgtgactcgaaaccgccggataggcccgcactggtggagtcggcaagagctgacttacggcgcggcaagtgccggccagtgccagcgagcgcgacgtcgctcgccaagcccccgtctctatggcaaccgagtgcgtctctaggaccgccacggcgcaggcgcccggaggctaagccgctcggaacctagctgcgccacgcagggtaggcgacgcagacgctcccgcgtgacgcacttccggtgcttgccctgcccatccccgtgcggtgggcgtggccatggcgggggcgctccggccggcgncggcccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgctggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 643284 - DNA, 275 bp, Homo sapiens
tgaaaaactagctagagactgaaggactcaaggaatgaacatggatttaaaatttttaaccttatacatcaaaacctcagaagctgaagaagcctgcaacccagaaatgccaactggttcagaacaaaaaaaccaagttccaacgaaaaggctgttctctctagtcaaaggaacaagaaaggggcagcctagaaagacagaagcaatatcattttgctctcgttgaacaccacaaagaattatggtcccatccccatgtacacctgcaaaggcaa

SEQ ID NO: 643285 - DNA, 501 bp, Homo sapiens
  misc_feature (4)..(4): n is a, c, g, or t
  misc_feature (20)..(20): n is a, c, g, or t
  misc_feature (103)..(103): n is a, c, g, or t
  misc_feature (108)..(108): n is a, c, g, or t
  misc_feature (247)..(247): n is a, c, g, or t
  misc_feature (438)..(438): n is a, c, g, or t
  misc_feature (450)..(450): n is a, c, g, or t
  misc_feature (453)..(453): n is a, c, g, or t
  misc_feature (455)..(455): n is a, c, g, or t
  misc_feature (458)..(458): n is a, c, g, or t
  misc_feature (473)..(473): n is a, c, g, or t
  misc_feature (475)..(475): n is a, c, g, or t
  misc_feature (488)..(488): n is a, c, g, or t
  misc_feature (492)..(492): n is a, c, g, or t
  misc_feature (501)..(501): n is a, c, g, or t
aaancaaaggtctaaccccnagtggcttaaaaaattggattggcaggaaaaactagttgcttggcctaagtttaaagctaggttccaaaatccggttttcttnatggnccagatatttggccaattcttccaactcaacagaacttccatcgatttccacattcattacagacaacaaatgttgtcattggttcatcagcactacgggttgtacctgtgtgtaagtgcaattcttctttttacattngccacatgggaacaagtcagtctgggtcccaccagtcttggccatctgatgctctctgatggcttctttggtcaagtttttccgcatctctttcaggtcatcactagccatttcctctgctgtcattctagcaaataagcaggaggatattccacagaggcatttttcctaaattggatttttgcatcttnagattgattccnctngnctnattttgattccgcanantcctcatcaaccnacanatcagagtn

SEQ ID NO: 643286 - DNA, 3599 bp, Homo sapiens
  misc_feature (360)..(360): n is a, c, g, or t
  misc_feature (3356)..(3358): n is a, c, g, or t
cgggcccgggtaggacggtcccggactggccgtgatctcagcggtgtccaggtccggcgtgactcgaaaccgccggataggcccgcactggtggagtcggcaagagctgacttacggcgcggcaagtgccggccagtgccagcgagcgcgacgtcgctcgccaagcccccgtctctatggcaaccgagtgcgtctctaggaccgccacggcgcaggcgcccggaggctaagccgctcggaacctagctgcgccacgcagggtaggcgacgcagacgctcccgcgtgacgcacttccggtgcttgccctgcccatccccgtgcggtgggcgtggccatggcgggggcgctccggccggcgncggcccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccgactgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggannnttttttttttttttttttttttttcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 643287 - DNA, 611 bp, Homo sapiens
cacgtgttcagcgctgataagcctaaatatgctatgcgcaccttagtgcttgcctgatccaactggtctttgctggcgtatgcatatctgggacgtcgctgccctgcacctgtgcgccgactctaaccggcatcctagaagcccgatactcactatatgaataatgtcacgctctagatgggcaaacgcaagcgcgtggcttcattatagagaatcgcactttctatagcagattgtgtgactatgaacatgctagtatcctgagggcgattggattatgcatttactgtgattcgtaggcaggttgctagctagaatgatgagttaatttgaccatattcgttgctatcatgtatgtgtacatatcaccgcatggcctgctatattaacatgtaggctgttcatatatcattagagcgcatcaagatgatctactgagacatctgtagaaggatatggatctcatacgatactgacatgcatgacgtcagaagtcatcatatgattgcttgatcaccgtaatggctcaatgttgattactgattattattgctctcagtatactacactgagttacattaatgctaattgagcgctgatgcaccagccct

SEQ ID NO: 643288 - DNA, 1559 bp, Homo sapiens
ggcctgggaggggcccggcggggctgagcctgtgcgtcctggggtcgggcctggcggggctgagcctgtgcgtccagccaccgggcccggcgccctccctctcccacttcctctcctgtcaggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 643289 - DNA, 773 bp, Homo sapiens
ccgaacggggtttgaacttttaacgcccttttggggttggggagcttctttgaacaacttctggtcccccccctcttagagttcttctgtagagcccccccccaatttggaatcccttgggaaagaacttccttatgctgtccccttttgtgcctgcggcccaccaccacgcgtgcttccacggccccgcccttattatggtgcacatatagtacttcgccccaccgagccacttataggaaaatgaacaccacctctttttaaggaaaatgttgtttaactaaaagccacaatttccacaaacaaaattgttataagacccctaagcccccttgtgtgctctccccatttctgactccttccccaccttcgttgccccccatactttctgaggtgcacactgggaaggctccccctctctatttttggggcttgactgagctttctttttgtagctggggctttgatgttccttcccgtgtcactttctcagtccaccactagccctgagcctggccccctcacggtgttgtcacccacgagtctgagtgttgtaacccccctgaggaggacccgacgagaaatatagtgccctctcccccccctcttcctactggtctctctatgcctctttacagatctcgtctcttttaacctggcccctctcccttgggctctgatgaaaaattgctgactgtagctttggaagtttagctctgagaaccctagatgatttccgttttaggaaaattaaaccccttgattacctatta

SEQ ID NO: 643290 - DNA, 1652 bp, Homo sapiens
ggcctgggaggggcccggcggggctgagcctgtgcgtcctggggtcgggcctggcggggctgagcctgtgcgtccagccaccgggcccggcgccctccctctcccacttcctctcctgtcaggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccaggtttcaccctgctgcaccatgcctccctcaagggtcacgcgctgtgagtgtggggtgggcacacagctgcagccggcctcttgctgtgctgcctgggggcagtcccaggtcccagaccaacctccctgctccacagagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 643291 - DNA, 1699 bp, Homo sapiens
  misc_feature (1628)..(1628): n is a, c, g, or t
ggcatgtgtgaagaggtgggtcactgagttggttgatcatagagtgatacttgataacggatagccagatatgagcagtcctgtctcaatctcgcttggctgtcagatggtactgtcgcaggaataagatctagctgtgatcctacagcctatgatatactggtctgatgctgctgctgtgatgaagaagctgctcttctacagatgatggtagtaattagtgagtgatagacaatcggcgcaacttctttaacttgcactacacatcgtcaagagggagcgcgaggagaccccttcggcctgagattgtgcctagagatgtatgcagagctaactctacattcgtgaggatattaagaacaaaagtgagaatttgtatccctagggcaagaggaatcaagcacctaggagagagttaggcgagcgcgaacccatgaacgcgaaaggccactcatcgtagttaccatccacgaactgtgccatggacatggctaacccaggaaaccgcttgtccgtgtgtatccctagcataattggagcgaatagttaagaaataacagactctcgctaatgaacgcacaatgcgcatgtcgtgtgcctgcaatgcgccgtcgcgcgtcattgagccacacatgtgagcgttcaacgtgcgcgttgtaaaggggcccatgaggccggtgacggggtggaagaagccgtgggagcccctgtttttagagctctgcaagggggggccctgtagatacgttgttattaacagcgttgggataaagaggacgtgaccgtatttccatcgccttttagtccatgagccaaacaccccaccgtttcactgttttctccccttagctttggttccttttttatataccggacgccaaagaacttgcttccattcctagtccctacatattctccgcgccggaggaagcgaaattcccccaaatggcatcgggaggcccttcaagaagggggctttgtgagggccaccgccttttgtgtggtgacaacacgcgcagacgcaattattaaacgggggcgagacattcggttgaacggcgagccagaagttcggccgatttaagactttggtaccttgtatacaagaccatatggccaggttggtcatggctgagatttgttaaccaccaagtttatttcgctacaacgatataagctcttattgtggcagaggtatgaggctacctacgggatatgacaaaagccccagatttagtggttacaacacacaattttccccacagtagttaaatatttcgcgacgagggatcgcgtgaaacatgcataaggaacattccggaaatttccctctattgtctatcaccttttcgtggctgagagcgagtggactctatattcaagccttttaaagttgacagttatttacccgcccttgcttccaattaggcacggaagcaatgtgacaagcacgagggttgttacggagcccctgagccctataagcccgtggatgagagccacgacaaccatggaagacccccaatggggacgagagcttctccgcctgtctgtgcgcgaacacgccccttcaccttgtggttcgtgtggtagcgagaagagcttcagctataagctatcaatccagnagaagaaggtgtgctatttcccaggagaaggaggaagattatgcgcacaacaaaacactaggtcgacagga

SEQ ID NO: 643292 - DNA, 440 bp, Homo sapiens
tgtctaattgaaatatttagggcagcaacgttgaaatcacctgtgtgatgtaaacccatgcattacttgggggagaactgttgacataattcagtgtcaacaggggaaggaacatgttctctttccagaagggtataaaggtactggccaggtgcagagagtcacgcctgtaatcccagcactttgggaggccgaggcaggtggatcacctgaagtcaaggagttcatgaccggcctggccaacatggtgaaaccccgtctctactaaaaatgcaaaaattagcagggcacggaagcaggcgcctgtagtcctaactactcgggaggccgaggcagagggatcacctgaggttaggagtttgagaccagcctggccaacatggtgaagccccatctctactaaaaatgcaaaaataatccaagcatggtggcacatgcct

SEQ ID NO: 643293 - DNA, 1114 bp, Homo sapiens
  misc_feature (16)..(16): n is a, c, g, or t
ccggggccagcggcgntggggtcggcgctggggtcgtcgtccgggccgggtgggctgcggcgcgcggcaggcgctctggcctggcctggccgccgctgagcagtcggggccggtgggtggcctcgaacgccgggacagaccgacagacggactggccggcggtcccgcgcccccgagcggagcgggcgggacggaaacgtccgggcaagttggggtcggcagggttggaagcccagcgaggctagaggccagtcccaaagtttccaggcatcagggctgcagcccaggagcctcaaggcggcccggcgggcgactggacggccggacaggtgagctcttgatcgtccgcggcctgatagtttgcacttggctctcccactttggggctccgtggaagccacgtcagagaggctgtgtttgtgtctgagcatgcatgcgagtggaggggagtggtgagtaatcccgcgtctcctctctgagttcggaacccatggaggaagaaagcagaggtgccagacaggcctctgataggcacctgcaggattggggcagagcggccgcagcgcaggagcgccggcaagcctggcccttcccgggaggccccctttgtccggttccaccctggcctgttgcctcacatgcaacaagtgtctgaatgtggcgctctcctggccgagggcagccctgggcggtgagtgggatgacaccccagcctgcagggtgcctgtaggtctccacccagatgggcaggattggaggtggccgcagcgctcgtgggctttccctcagcaggtgtctccatgctggcctccccgcctcagggcttcatcccactccgtgggcctgatctccctggggcacctgggatgtccatctgcgttagctggagctactccatggcctgtggcgtgccacacacagcggcatttcggtgtcattaggcacagctggaggtgcaaggaggagggcagcctcatgtccagttccatgtaacttgcttcttctgaataaaggcaatttgctaactttctcgctaaaaggatttggtttctatggcttttaaagcttctccgataaaatacttgcaacaagggaactctctcctcctacactc

SEQ ID NO: 643294 - DNA, 807 bp, Homo sapiens
  misc_feature (188)..(188): n is a, c, g, or t
  misc_feature (191)..(191): n is a, c, g, or t
  misc_feature (316)..(316): n is a, c, g, or t
  misc_feature (343)..(343): n is a, c, g, or t
  misc_feature (439)..(439): n is a, c, g, or t
ctgcgtggggtcccgcgctgcagccgagaggccccccaggccgcggttccggagcgggaaagtccgcgcgggggcggtggcctcgggggcgggacggggcgggggcgggggcgcgggcggcgagccgaatcccctccacgggacgccccgtgctgctcgggaagaggcgggccctgcgcgcctgcgcncgncatggcggtttgggcggcgacgtgagcggctccgcggaccccgagcggggccccggccgcgacctgagccgccgccgagcgcccggggccatgcgaccgacgctgctgtggtcgctgctgctgcntgctcggagtcttcgccgccgccgccngtggccccgccagaccctctttcccagctgcccgctcctcagcacccgaagaattcgcctgtaacaacgcagagcaggtcctgagttgggagccangtggccctgagcaaatagcacgaggcctgtgtctaccaagtgcagtttaaatacaccgacagtaaatggttcacgggcgacatcatgtccatagggggtgaattgtacacagatcacagcaacagagtgtgacttcactggccggccagtccctcagcaggcttcccaatggatttcaagtgtcactctacgccttcgaggctgagctgggaaccactccattctgcctggggttgaaaatgcctttggtttccacacacttatcggaattgtgatgccgggcctcacagaaaaactttgaggttggacccaggagaaggtcctcataatcaggtctcctctccctttgaaatgctgaaacaccacgg

SEQ ID NO: 643295 - DNA, 258 bp, Homo sapiens
ctccgcctcccgggttcaagtaattctgccttagcctactgagtagctgggattgcaggcgcccaccaccatgcccagctaacttttgtatttttagtagagacagggtttcaccgtgtcggccaggatggtcttgaactcctgacttcagatgatctgcccaccttggtctccccaagtgctgggattaaaggtgtgagccactgtgcccagcccagtatttttttgtttgtttttaccgagatggagtcccgcccc

SEQ ID NO: 643296 - DNA, 837 bp, Homo sapiens
gggtctcccagtgtctagatgaatgcaacatgatgatggtgaatgatgacgatgagtttagatcatgtgttcattgtattgcctattagggctgagggaaagggaaggtgtgttggatgttctccccattatgccccattctgtctttctatgaggtgactatacaccacatgtaatgacgctagtgagctaatattgacttcccaagacccttgtactcttgggctgcagtttgaggctcatgtgtcagatctgactgcattgcgttgcgtaggatctggtatctgaagtgttggattccttgttccaggaattcaacattagattctccaatagatgtatcatggggacttgtgactattgacaagacatgtaactctatgtgtcccgagtttatcggtcttactcatttagcctgctctagtacttatcgggatgggtgtgtgcgtgcgtgtgtgatgtcacggctgccacgtaacaacttgcgagaaaatatcttaaaaagcagatccagtcctgttcttaggatgctcgtatagcgtaagtagaattgttcgaagtggtaacctgtagtataagatggtcttgtttaacgatattttcagtgttgtcttcgagctgctgaaatatgctaaatctggttaatcacgttatcctggtattatttgcgttaacttgtgccggttacacagtggtttacagcgataacaattgccctgggttgatgcacatgtagtgggcaaccagaaggggattcttccaagctgttaacatgtcatggcacggcattttgtgagggacctgtgtatcctttacagacaaacatcagcggttact

SEQ ID NO: 643297 - DNA, 110 bp, Homo sapiens
gactacattacttagttgtgttttatacgtggctggtaatggctttttctttccatatttagcgcttccttcaacagctcttgtaagaacacagttctctacttttccgg

SEQ ID NO: 643298 - DNA, 354 bp, Homo sapiens
atataatcaaagcgctggtaaataatttaaagaattgcctcaaaggatttgcagactagaaagagactcccttctctggtttaaggtgggagaaactgttttcattgtctttcccccaagatattttattcaggagtgtcccacacgggcttgaacttataagtggctgcatttttctcactatactctcatcccctctttcctttattgattctttttaaggatgctgtcggcaacatttatgtccaactttctgttcatctcagatctgtgccccctgctctttagatcaatgagagagtgcagggtcttggctgctgagatgattcatcctattagctctttccagagggt

SEQ ID NO: 643299 - DNA, 314 bp, Homo sapiens
tttgggttttgggtccccccctcccccccccccggggggtgggttttgtggggatcaaactttgtggcttttttttaaaaatcccgacccctgctttgggggccgcccccccctccccagggggttctttttaagccctttgccccttgggcccagggaccccagtggttgggcccccccagggccggggggcttgggcctttccccttttccccggggtgggggggggggatgggggtttcccctccccccccctgggggtgtttccccctcccctttattttccccgggaaaattaaccggggggactgcca

SEQ ID NO: 643300 - DNA, 197 bp, Homo sapiens
ggggttttcccggaaattccaaaaactctttttaaagggtgggggaaaaagcccccccccttttgggagtttttaatttttattgttttcccccccgggcaaaaccctttttttccccaaaaaagttggggtttggggggggttttttttttttggtttggttttggtttttttttttttggggtcgggggggggta

SEQ ID NO: 643301 - DNA, 220 bp, Homo sapiens
ctgttttaccgtccttgtccctcgtgtacataactcctgctcgagcctataacccctcatccatctcccttgagagcgagaaccttattttgcgaacgtcagaatgcctgcacccagtaattatatcatatgactaattttttcaacccaattcacgccgaggtgtcagggatgatcacatcttggagtgtgagtgttaagattcagacattgcccttga

SEQ ID NO: 643302 - DNA, 336 bp, Homo sapiens
gaggaaaggatatgttctttcaactaatggggctgggataagtggatttccatttgaagggaaaaaatggggactttttttaccccaagcccaaaaatttaaatgcaaaacctaaacttttaaaccatttaaccaaaaccaagggaataaaatttgggaccttgagttacacaaagatttttttgtttttccaccaaaagtagaatttaaggctaagtgcagtggcttatgcttgcagtcccaacactttgggaagcaaaagtgggcaaattgattgaacccaggagttcaagaccagcctgggcaacatggcaaaaccccttctttacgaaaaat

SEQ ID NO: 643303 - DNA, 81 bp, Homo sapiens
tgtgccagcagccaagagggactagcgggagcgtcgcagtacttcgggccgggcaccaggctcacggtcacagaggacctg

SEQ ID NO: 643304 - DNA, 224 bp, Homo sapiens
  misc_feature (67)..(67): n is a, c, g, or t
gtttacaaaaaaaaaaaaaaaaggtcttttttttattaaaaaaaaaaactttttgtggggggggggnttttttttaaaaaaaaaaaaaaaaggggctccttcttgggaaaaaaaaaaaaaacaacccccccgcgggggattttttttttgggggggcccccccacaaaatattttaaacaaggtttgtttttataacccccggtttttttaaaaacttttccta

SEQ ID NO: 643305 - DNA, 241 bp, Homo sapiens
ggatccccaatacgcttgcgcacaggagcacaagctacctcctgccagctgccatcctgcatacactgagcattgaaggcccgtttcttggacttccgagaggatccaggcacatggcatccaggcttgcatctggatttgcagaaggagcccaccttgcgcttattctctacgcaccgggcgccctgcaggcctgcatggagcatggactgtggtccttcccagaggccctgggcgcaag

SEQ ID NO: 643306 - DNA, 170 bp, Homo sapiens
taatctactcattgcgcaggatgaaatcaatgagctccagttctctctcgcagaggagctggtatcgagtcgtgaggcggaccggcggagcaggggattagcaggtccagctcactgtcttagccgagcgaatgtcatcatcatgatgcagaagcctcgggtatcagggc

SEQ ID NO: 643307 - DNA, 423 bp, Homo sapiens
  misc_feature (69)..(69): n is a, c, g, or t
  misc_feature (221)..(221): n is a, c, g, or t
  misc_feature (335)..(335): n is a, c, g, or t
  misc_feature (337)..(337): n is a, c, g, or t
  misc_feature (357)..(357): n is a, c, g, or t
  misc_feature (367)..(368): n is a, c, g, or t
  misc_feature (380)..(380): n is a, c, g, or t
  misc_feature (417)..(417): n is a, c, g, or t
aaaccagatgggtggccctgaaaccccgggctctggaaccctattaggctgtgcctgccatagggaaanattggttccgttccatcctttcccaaacctcagtttcccctctgttcctaaaatggggattccagtcattccagtagtcctttatcgagcaattacctgtactcccaggcattgttcctaggtacatgagattcattaacaaactaaacagntaaatattcctgccctcacagagttcccattctaacagagggagacagtccaaaaataataaatatactacattagaaaattatataaaattacagaatgtaggccgggcgtgngngcacgcctataatcccagcnctttgggacnngaggccggcggntcacaaggtcaggagatagagaccatcctggctctcncggtga

SEQ ID NO: 643308 - DNA, 333 bp, Homo sapiens
cggcacgagggattgttatattctcttgctcagttgacctctttattattatatagtgaccttatttttctcttcttacagtttttgtcttgaaatctattttgactgatacaagtgtagctactccagctcttttttgcttttgtcgccatggaatatctttttttcatctgcttattttcagcctatgtgtgtctttataagtgaaatgtgtttcttgtagacaacagataattgggtcttgtttttttatccattcagagccactctgtgtcttttgatttgagagtttagtgcgtttccattgttattaagaagtaaggatatgttctg

SEQ ID NO: 643309 - DNA, 101 bp, Homo sapiens
agacacaccgacatctgacacaccgacattagacacaacgacattagacacaccgaccattaggacacacacgacattagacacaacgcacattaaacaca

SEQ ID NO: 643310 - DNA, 419 bp, Homo sapiens
acatgctgggaaagagggccgaggaaacgatcattcatgtaccatgctcctgaaaactacggccatagagcagcactggaagactgcattggcgagatgttcagtttgccttggggcttcccttctacccagcctacgaggggcagtaaactctggaggagaagagcctgtcagctgaaaatcatgcagtactttacccacttcatcagatcaggaaatcccaactacccttatgagttcacacggaaagtacccacatttgcaaccccctggcctgacttatgtaccccgtgctggtggagagaactacaaggagtacagtgagctgctccccaatcgacagggcctgaagaaagccgactgatccttctggtccaagtacatctcgtctctgaagacatctgcagggggatcctcta

SEQ ID NO: 643311 - DNA, 300 bp, Homo sapiens
gactcgaggatccccgcagcttctcccatcagcctactcaagcgtgagacaacaatgaggatgaagaccttaatgaagatccactttcacataaggaatagtaaatatattttctcctccttatgattttcttcaaagcatttacttttctctagcttacgttatagcaagaatacagcatataatacatatacaaaatatgttaatcaactgtttatgttatgggtcaggcttccagtcaacagtaggttatcagtatttaagtgggggggcattaaaatgcatacacagatttgacta

SEQ ID NO: 643312 - DNA, 421 bp, Homo sapiens
  misc_feature (10)..(10): n is a, c, g, or t
  misc_feature (54)..(54): n is a, c, g, or t
  misc_feature (415)..(416): n is a, c, g, or t
  misc_feature (419)..(420): n is a, c, g, or t
gtccccccanacctaagtttttttagcaaaaaattagaaataaaatatgttttnccctttgggaaggattggtataaatttcagccccatcccatactcctagaatccctcttcagatattaaaatatttgaaaaattaaatgtgggcccaggtgtggtggctcacacctgtaatcccagcattttgggaggccgaggtgggggcatcacttgagcccagttgttcaagacaagccctggccaacataacaaggcctcatctctacaaaaaaatagaaaaaaatagcctgtagccctagctactcaggaggtgggaggatcacatgtgcccaggagtttgaggctgtagtgagtcgtgatcgcactactgcactccagcgtgggtgacagagcaagatcctagctcaaattaaannttnnt

SEQ ID NO: 643313 - DNA, 867 bp, Homo sapiens
gacactcgcgcacactcgcgctcgggcgcacacggagcaggaccggcgcccggagcgagccaggagcggtaaccggggacccaccgcgcgagccagctagctgccaggagcccaacccggagaccagcccctgagccccgaagccggaccccgtgcgcggcggtgtccccaccgacatccctgacccatggcgctgaagaggattcagaaagaatggagtgatctacagcgcgatccacctgctcaccttgttcagctggaccgtgtgggagatgacttgttccattgcaaggccacctattatgggggcctcctgatagcgcatatcagggtggagtcttctttctcactgtacattttccgaccagattatccttttaaaccaccaaagatggtttcacaacaaaaatttaccatccaaaacataaacagtaatggaagtattggtctcgatattcgtgagggtcacaagtggtcaccagctctgagtgtatcaacaacgttttatggtccatatgttctctactttggtgatcctaatccagatgacccttagtaccagatattgccaaactctataaatcagaccacgaaccataccaccagaccttgccaagagaatggctcaggaatattgccatgttacaaatcaaaaccttttcatattaccagagtctgtgacacctaggttttttccacattagcggtaaatgaggcgggtgctgctccttgtccatgaaaccttgttttccctttatgtgttcgcgccgacacaattcaaaacctagaggggagcctcactggtgcggcaaacacttggtgaacgcgccgctctccacaagcgacaccacttgcggtctcaccgcg

SEQ ID NO: 643314 - DNA, 124 bp, Homo sapiens
ttgcaaatcagtctctacagatgagctagtttccgtttgaagtagctcggttaggggacactacagtcagtcttgggggagctctagagtttcgtggtggaggaacttttccacacaggaagct

SEQ ID NO: 643315 - DNA, 402 bp, Homo sapiens
gtctactactactaaattaacacccgctcgacatagagtttagctcttactgcacagctgggagtgccgcctcccaggttcaagcgattctcctgcctcagcctcccgagtagctgggattacaggcacccgccaccacacccagctaattttgtacctttagtagagacggggtttcttcatgttggtcaggcttgtctcgaactcccaacctcaggtggtccaccaccttggcctcccaaagtgctgggattacaggcgtgcgctcacacctggccacactggtttaaaacttaacacagtctgggagcagtggtcacgtctgtaatcctaatactttcagaggctgaagtgagtgaatcacctgcggtcgggagttggagaccagcctgaccaacatgg

SEQ ID NO: 643316 - DNA, 422 bp, Homo sapiens
tttttaaaattcttggcttggcatggtggctcacgcctgtaatcccagcactttggaaggccaagctggaaggattgcttgaggccaggagtttgagaccagcctggacaacatgagacccccatctctacaaacaaaagaaaagaaaacaaaacaaaaatacaccccctctccaagtactccctctccacatttgtacatctggagaaggaaaaatcagatatttctgatatacgtttattttaattttgaattatttgtgtcaccaagctcagcttttgggaagacaaactcaaacacctataatttcatttatatttctcattcacttggaacctttctgcttaatgtaacctagaaaatgatcatttgtgtaacccaaaacttctaaaataaatggcttaatccttgcaatatgttat

SEQ ID NO: 643317 - DNA, 152 bp, Homo sapiens
gaagatggcgaaactgggtcgcagcggtttggattctcggcgtgtcgtgaagatcggcgacattggtttggggcttcggcgtgtgcagtctggacgttcggcgtgaagatcggcgacattggcatgctcagtctggagcctcggcgtgtgca

SEQ ID NO: 643318 - DNA, 409 bp, Homo sapiens
ggcttttaaaaagtaaatttattaccccacataataagtccaaaaagttgagaaattccattatgttatcaaaacccatgataaatctttaaatattttgatttttttgaactttacactttgttactctcaatatatggggctaatactttggccggttcctttgcaaggccttaaactttgtcccctgagcaaaaagccggggctgtatttacccaaggggctttgcgctgcacttttcataattggctcacatttaggacaaagctgccggtagaaacagggagaaaaaagccgttggatatgtcccttggtttcacagctccttaaaaaacgcgagaattaattacctgggggatctacactattctgaatgccaagagggagccatcaccagccctttattatt

SEQ ID NO: 643319 - DNA, 1747 bp, Homo sapiens
  misc_feature (242)..(242): n is a, c, g, or t
  misc_feature (1563)..(1563): n is a, c, g, or t
tacgaggatgtcccgcgtgactgacaactgagctggatcacgcctgtgggtggtggtacaacctccatcgcacacgtttggctgctgcagatagaacaggcccggcgcggtctcatcgacagaagagagatccaaacagcaaggggggggaagatgagcacccgtcgcccctcgtgccccgacgatggggaggcacggcggggtctgtcacaacacaaccagcccgcgcctgagtggggggntgacccacctcgtggtccgccacgacgatcgacagcggtttcttacgccgcggggggagtgtaaataaattgctcgcgctggagaatgccgccccccaccggagaaccttcttggggggggagaagacccttcttcttccgcttgggggcggaaacaaaatatgggggccctaccaaaagtgtgcaccagaggaaagggtgttctcttgacaaagaggagaggttctctctcccgcggggggcaaaagccactgctgcttcggggtgagacccaccccccgcgacaaatgtgtggggctccccccccccctctgtgggggggaagcccagcaacctttggggttgttatacaacaccgtgcgtctactagcgagggtgagtataaatttctccgcggtcgagacccacttcctcaccggcggccccccaaatttattgggtcgccctcccggtgcggttaaatttgctccccccgctgtgtatatatttgggggagtgtgttccaccacccccccacgggcgggattcatcacaacttagggtgcaaatagacgagcagcaggatgtttgtgtgccggctaggagagtccttgtatgacggcgggatatacaacggaaggtttgtagttctcccccgcccttcttctctgggggtgtaaacagaaaagaccgtgtggagacagaatttggggcccccccctcataaatttctctgtgaaaagcttctctgggagagattcctgccccccactgtggcgttgagaaaaatggggttctccccctgggcacaacaggcgccacatgtggggtgtgtgtttgagagagagacccttttctctcacaggagacgtatagtccccaccccctctgtggggggtctccctcttatttgtccgctgtgtctccgtgggagagataaggagagacacacagacacacagctgttccccgctgtgtgggggcgtgcacacccacacaagcacacgctggggagcacacaaagagacagggcctcgcctcgggagacgcctcgcgctcacacgagtgccaccgcacacagtgtctcgcgcctcaccagagacaggctctcacagagagagggctcatatatggagagtaatttatatcctctctattatacctcggccacccccccacactctctctatgatcacacagtggggtgtggagaagacacacggtgtctccacagagacactcgtgtttgtgtattcacaattggccacatcttataagtgttaagtatggtgtaataagagctcggtgtatatcgagtaaccacacagcacttcgttaaacnctctcacgaaaggaaaaggagagaaagttttgtgggccacctcttggtgttttctctttttgcgtcgtggcaccttttaaagtatctaagtgttttaaacaatcacggacttttttatgggaaccaccttggccccaaatttgtccccaggattttggggccccctttaaaaagtttaaagaga

SEQ ID NO: 643320 - DNA, 1402 bp, Homo sapiens
  misc_feature (360)..(360): n is a, c, g, or t
cgggcccgggtaggacggtcccggactggccgtgatctcagcggtgtccaggtccggcgtgactcgaaaccgccggataggcccgcactggtggagtcggcaagagctgacttacggcgcggcaagtgccggccagtgccagcgagcgcgacgtcgctcgccaagcccccgtctctatggcaaccgagtgcgtctctaggaccgccacggcgcaggcgcccggaggctaagccgctcggaacctagctgcgccacgcagggtaggcgacgcagacgctcccgcgtgacgcacttccggtgcttgccctgcccatccccgtgcggtgggcgtggccatggcgggggcgctccggccggcgncggcccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtgagctcttgatcgtccgcggcctgatagtttgcacttggctctcccactttggggctccgtggaagccacgtcagagaggctgtgtttgtgtctgagcatgcatgcgagtggaggggagtggtgagtaatcccgcgtctcctctctgagttcggaacccatggaggaagaaagcagaggtgccagacaggcctctgataggcacctgcaggattggggcagagcggccgcagcgcaggagcgccggcaagcctggcccttcccgggaggccccctttgtccggttccaccctggcctgttgcctcacatgcaacaagtgtctgaatgtggcgctctcctggccgagggcagccctgggcggtgagtgggatgacaccccagcctgcagggtgcctgtaggtctccacccagatgggcaggattggaggtggccgcagcgctcgtgggctttccctcagcaggtgtctccatgctggcctccccgcctcagggcttcatcccactccgtgggcctgatctccctggggcacctgggatgtccatctgcgttagctggagctactccatggcctgtggcgtgccacacacagcggcatttcggtgtcattaggcacagctggaggtgcaaggaggagggcagcctcatgtccagttccatgtaacttgcttcttctgaataaaggcaatttgctaactttctcgctaaaaggatttggtttctatggcttttaaagcttctccgataaaatacttgcaacaagggaactctctcctcctacactc

SEQ ID NO: 643321 - DNA, 1053 bp, Homo sapiens
ggagagagagagagagaactagtctcgagttatttttttattttttggggtgttaagcttaaaggtctataaaataggtgggaaaaacaggccaagtgtagggacctgattcctgcaaggggcctacgggaagccctcgtgcactcaagcagaagccccatccaaaccaggagtgtggtgttctgattctccgtggcaggcagggctgaatagggtgtaggagtggcgtcgtgttctccttggcagtgtgggctggctcagaggagaaacagcaagcttccgtgctccgttctcacgtggtgttcgtggggctcaccattagaaccagcgttccgtgacaattcccgtcgtgaattctcttcagtggggaaaagcccgtggaaccttcgtggtgtggttgttcccagcgtgggttgggttctcaaggtgtgcatacccacgtttggggaccagctaggccttgcagggaacagggccagaagggacacctctcagtgggagactggaatcttaccttccttcaggaggtctgcctccagggaaaaacctggggtcctatcctgcgctcagggctggctggactgtacctgtaacatgcagtggaagacattccagaagaattcatacggagaggaacatgaagcctgtgcacgagggcagcttcacaagctgggggacaggcccttgaagaagcccagggcgcctacctttggtagcacctgcttgggcacagtacattgaggcccttagtaatctccgataccttgggcaaaagggcacgctctgagcattgctcaaacccctcaaactctgtaagcccggttctcagcaacacgtgccccacggagataatgctaccggggactctgcagaagtgaaccacacgctccccagtggccccaaaaacgacaggattctgggagcgaccccacataaacctaccccaatacggggtggacatggggcccaatgtgtcacagaggcctccaacgcacacctgtacacagaaagaactgcacaccgcgcagcacggcgacaacatgccgaccacaa

SEQ ID NO: 643322 - DNA, 297 bp, Homo sapiens
ggcagggcacgcactggccccggcgcccacccgcacccctccccagagcactgacacggctcccgggacctcggcaggatggaagagaagctgaagaaaccaagatcatctttgtggtgggtggcctggctcaggaagggcacccagtgtcgagaagatcgtccagaagtatggctacaccacctttcaccgggacctcctgcggtccgaggtcagctcaggctcgccagggcaaagagcttgcggaatcatgaagaagggcagcttgttccattgagacagttttgacatcgtccg

SEQ ID NO: 643323 - DNA, 1071 bp, Homo sapiens
  misc_feature (360)..(360): n is a, c, g, or t
cgggcccgggtaggacggtcccggactggccgtgatctcagcggtgtccaggtccggcgtgactcgaaaccgccggataggcccgcactggtggagtcggcaagagctgacttacggcgcggcaagtgccggccagtgccagcgagcgcgacgtcgctcgccaagcccccgtctctatggcaaccgagtgcgtctctaggaccgccacggcgcaggcgcccggaggctaagccgctcggaacctagctgcgccacgcagggtaggcgacgcagacgctcccgcgtgacgcacttccggtgcttgccctgcccatccccgtgcggtgggcgtggccatggcgggggcgctccggccggcgncggcccctgggctcccgcccttcgggtcccacagtttccagccgccgctctcctcagtgcccggtggcccaggagggcctgggagcccgaagccgtccccgagtcgctcctaggtcactggcgcgatgcgggccgtcctctcggctgatgggttggaagcccagcgaggctagaggccagtcccaaagtttccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgcctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggaaaactacagacaacaacg

SEQ ID NO: 643324 - DNA, 481 bp, Homo sapiens
  misc_feature (481)..(481): n is a, c, g, or t
atttgaacgtagacggtgtatatttccttcacaacacaccgctgataagacgtggtggtgggaagtacttttgtacccatacctcatgaggtgatagaggaaaccggccgggatcttctaatgacctggggttggttaaagcggtcttagatttggcgccaaatgcacagcggacaaaagaagcaaaagctgttgggcgcgacatgaaacgggaaatctgttgtgcagcaagggacacaatgattaggagcgaagggcgcgatacatgttgggcaacacgcctttacgaggaaactccttaggcattcttcccacaggatagcaagacctcgccacctgtccgcacggagaagggattgtaacagctagactgaaaagtgggtaaaagatctgaagctttctttctcgagggaatgatcccattcggctcagaacctttgaaaagggcgcccagcccttcaactccccaaggagaaccccn

SEQ ID NO: 643325 - DNA, 197 bp, Homo sapiens
tgtcgtggctgctgaaatggtggtggagtcggagatgctcatgccgacggtgttcaccaggtatttctgcatataggtggtgtaggtgtagaacgccagggtaccgcccatggtcaggccgacgactgtcatcagttccttggggtggcgcatcaaggtgcgcatcgcgctttccttggctttttctttcttggtga

SEQ ID NO: 643326 - DNA, 205 bp, Homo sapiens
tgtcgtggctgctgaaatggtggtggagtcggagatgctcatgccgacggtgttcaccaggtatttctgcatatagccaaggcaatcagctgaatatgccggttcttcaggccacgcttgaggcccaccgggttaaccatgtcatccgccattaacattcccttctacttgtttttttcagggttgatcgcacaccgaaccagcc

SEQ ID NO: 643327 - DNA, 1594 bp, Homo sapiens
  misc_feature (145)..(145): n is a, c, g, or t
  misc_feature (219)..(219): n is a, c, g, or t
  misc_feature (432)..(432): n is a, c, g, or t
  misc_feature (450)..(450): n is a, c, g, or t
  misc_feature (571)..(571): n is a, c, g, or t
  misc_feature (648)..(648): n is a, c, g, or t
agggcgttcgtactcctacattgttcccatactaattcggcggtggagtgcctaatggttactgaaaaccgagcatacacttctgtatgcttagtatactcatcgtactgaagatatcgagcccgcaaacctcgtatgtctatgngctcgccatagcgcggtcatacgtacgatatccctattcggcatgatctgccgactataaacctcgtatcaagncgcacacagaagcacactttgaaacagcactggactagaatcgtactactccacccgtcgtatacttgaccgtgctgccgaacccttgaggcgtcttcaccagtctgcatcatgtatacgtagtgcaatgctgcctgttcctattgaccgataactcactggcgtctaaacacctagaatcctctcaagaatccctaattgtattcgggtgancacaagcccgcgtggccntgtggaagccgctttatgtgcgaccactgtacatgccgtgcgggggcatcaagcgatgcgagacgcgtgcgaacctgacgctgcacgtgcagtcgtgcgtacagcgtaaacgcactgctancgagcacgcaaatccagacatatgtagctcgcattctcaacgcattcacgtgaatgcgatttgcactaggtgatatngaccatttgacccaactaacccgttgcgttccaactctcaggcatcggcgcgaagggctttggctccctagacaagctgaggcgggcgcctgggagttgaaatggacctgtgtgcgatacgctgggccgcttgtgttgtcatttccttcaatcagagtactaaatctttgccccttcttaactaaacttttaagaagtaaacaacccgaacgcgcaccaatattgggaagccccccggaacgggaaattcatgacctcccccttaggactgaaatttcttggaagggccattcccggaagaaatgcggtgggtaaccggaaccccgcccccgtggaaacactctggaaacttgtcttttgtatacctttttaccattcactctcaaacaaaacaatgtgggtgcatgcttccatccaaaaagtccttggcaaaaaactgaaggctggacagggcgcggaactgtggtgagacgcggaaatccccacccatgtgtgtgtttacccggactcactcgggtgatccccgaatcccaagggaagggagcacaaggaccagagatgtggacccagggttccatcccaaggggcggcagttgagattgatgtaaccccccattctatttaggaaatctctgtgccgttcaacgaaaacaaagacgggggagaatttagtctctaccagaaaaaaaagccccgtgaagggagcctgtaaatacacatgtatgcctccccaaacacactattaatttatgacgggcgggcccccgcccttggtgttgcggcaaccccgaacgatgagggcgactgactgctacccgtgtgaagaaataaaacccctcgatgatcggagtcggataacagacgggtcgtaatgacatgctgaacaaacaaaagagcgggctcggagtttacagcctgatgctacgataacacaagcgatatgagt

SEQ ID NO: 643328 - DNA, 163 bp, Homo sapiens
gccgggttaggaaattattttttaatttacaagacaggttttaactccgccggggtgggaaatggtgtccctttcccccccaaagcacagggcccagaaatgaggccgtttacatggcgggtctccgtgctggtgtttaagtcattaaaaagatacccaaaga

SEQ ID NO: 643329 - DNA, 142 bp, Homo sapiens
gggaaaaaaggcttccccccccggggggggaatttttgaaggggtttttccgggggggggaagggtttttttaaaaataaccccaaaaacttacccgaaaattggcgggttttttgccaaaaaaaacccttttgggggccca

SEQ ID NO: 643330 - DNA, 546 bp, Homo sapiens
  misc_feature (239)..(239): n is a, c, g, or t
ctctagtcagaagcaacagagttgagtgggtatataagatatagtgtctatttttaatgctatttttaatgagaaattcaaagttgcttgctaaaatggttaatgtgatagaaattagttggaccagttaggtgaataaatatcattctaactcattaggagaaaaaggtcaaattataaaagactaggaccattctgttttagaagatattgcttttgatctgaagaaataatttggnttttacattttcatgccacctaaagtatgctgaattatttcttcgatacacagattacttgtgggtgaaatatcctccagaaatattacaattacatgagttgtttgctggtagaaattgtagcctttttctgattaatgccttcatttctttgattttatttataagtatactttgtttccatttatggccttgattcatctgcaggttttcttgtgcccaagtcctctctggtgattctgatagtacatttgtttttcccctctgatgattctgatagtacatttgtttttccccttagtggtca

SEQ ID NO: 643331 - DNA, 306 bp, Homo sapiens
tgggaggctagcagtgcaggagctatgatgcaggctctcaggagctacctaccctgcccccgccaggcacccaaggctgcactgcaaacaggcactgccaggctggggccctgggagaggccagcagactgaagcgtgctcaggatctgactgaccctatctcatgcgcaagattactttgcagggttcagctctgatatttcccctaaagacaaagtctcctatgggagcaagttgaccctagggaaatgggtgtccctggccatacaccactaaagatgctcccgcacaaaaccctctgagctc

SEQ ID NO: 643332 - DNA, 796 bp, Homo sapiens
  misc_feature (1)..(1): n is a, c, g, or t
  misc_feature (67)..(67): n is a, c, g, or t
  misc_feature (69)..(69): n is a, c, g, or t
  misc_feature (99)..(99): n is a, c, g, or t
  misc_feature (168)..(168): n is a, c, g, or t
  misc_feature (173)..(173): n is a, c, g, or t
  misc_feature (182)..(183): n is a, c, g, or t
  misc_feature (200)..(200): n is a, c, g, or t
  misc_feature (212)..(213): n is a, c, g, or t
  misc_feature (216)..(216): n is a, c, g, or t
  misc_feature (224)..(224): n is a, c, g, or t
  misc_feature (227)..(227): n is a, c, g, or t
  misc_feature (229)..(229): n is a, c, g, or t
  misc_feature (233)..(233): n is a, c, g, or t
  misc_feature (235)..(236): n is a, c, g, or t
  misc_feature (238)..(240): n is a, c, g, or t
  misc_feature (255)..(255): n is a, c, g, or t
  misc_feature (260)..(260): n is a, c, g, or t
  misc_feature (284)..(284): n is a, c, g, or t
  misc_feature (297)..(298): n is a, c, g, or t
  misc_feature (303)..(303): n is a, c, g, or t
  misc_feature (306)..(306): n is a, c, g, or t
  misc_feature (312)..(312): n is a, c, g, or t
  misc_feature (314)..(314): n is a, c, g, or t
  misc_feature (325)..(325): n is a, c, g, or t
  misc_feature (349)..(350): n is a, c, g, or t
  misc_feature (355)..(355): n is a, c, g, or t
  misc_feature (362)..(362): n is a, c, g, or t
  misc_feature (367)..(367): n is a, c, g, or t
  misc_feature (382)..(382): n is a, c, g, or t
  misc_feature (393)..(394): n is a, c, g, or t
  misc_feature (400)..(401): n is a, c, g, or t
  misc_feature (403)..(403): n is a, c, g, or t
  misc_feature (405)..(405): n is a, c, g, or t
  misc_feature (414)..(414): n is a, c, g, or t
  misc_feature (417)..(417): n is a, c, g, or t
  misc_feature (420)..(420): n is a, c, g, or t
  misc_feature (424)..(425): n is a, c, g, or t
  misc_feature (428)..(428): n is a, c, g, or t
  misc_feature (436)..(436): n is a, c, g, or t
  misc_feature (439)..(439): n is a, c, g, or t
  misc_feature (451)..(451): n is a, c, g, or t
  misc_feature (454)..(454): n is a, c, g, or t
  misc_feature (459)..(459): n is a, c, g, or t
  misc_feature (476)..(476): n is a, c, g, or t
  misc_feature (634)..(634): n is a, c, g, or t
  misc_feature (637)..(637): n is a, c, g, or t
  misc_feature (642)..(642): n is a, c, g, or t
  misc_feature (644)..(644): n is a, c, g, or t
  misc_feature (649)..(649): n is a, c, g, or t
  misc_feature (654)..(654): n is a, c, g, or t
  misc_feature (658)..(661): n is a, c, g, or t
  misc_feature (678)..(678): n is a, c, g, or t
  misc_feature (774)..(774): n is a, c, g, or t
nccccacatcaaccccttcagcccccttcaggcccccagcgcaggcccagggcctggagcttctgcntnaggtagctcttgagctggggcaggcctctntgggactccagttcctcgaagggtagcggcaggagctggtagcccatcaggcctaggtgccgctccctnagggncctcgagcnnagcagcacccgggggtnccggagaaatgnnagngttcccgnaanancagnannannntggagggggagggangtggnttagggcatggggggcaaggtggnagggctcccccannctgcntcntttacntntggggagggtntggagtagtgggggtagagggagnntgggntgtgggnaggangttggtgggtatggnaggaaggggtnntgggtnntnangggaagganagnaanaganntgntggcgcanagnaggaagtctggnggngagcngggcgggccgcttagcnagggctctgttttttcgggcttgctgcttgttccttggttatttgtggagtagcttggaggcacagtcaggtcctggcggtatttctcctcccccagcagctggcgcaacccctcacctactatgtccttgtgactgaggagaaaggacaccagtagnagnaaaanancggcnccccncccnnnnttgttccagtttagtgncaccaccctggggaaagcctctgctgcttcagggcccagttttatggtggccgagagctccttagctttggcgcttcatggtccctctggcttttncactctgctggtcccaggctgg

SEQ ID NO: 643333 - DNA, 445 bp, Homo sapiens
  misc_feature (21)..(21): n is a, c, g, or t
  misc_feature (27)..(27): n is a, c, g, or t
  misc_feature (46)..(46): n is a, c, g, or t
  misc_feature (63)..(63): n is a, c, g, or t
  misc_feature (75)..(75): n is a, c, g, or t
  misc_feature (138)..(138): n is a, c, g, or t
  misc_feature (333)..(333): n is a, c, g, or t
  misc_feature (434)..(434): n is a, c, g, or t
  misc_feature (437)..(437): n is a, c, g, or t
  misc_feature (439)..(439): n is a, c, g, or t
cgtaccaaaatttgaccaggnaaaccnaccgtgccgtcccaggaancctcttgccaatggcgncgctccgttctncctgggtccgtcgtccggcacgatgaatcgcgggtagcaggccgtgctgggcttccagcggtncgtgtcattctccgacctcgtccttgatttcttcgcgggcctgttgatactccgatatcaaggtgccgaagtaggtgagtatttccgggtcccccaccggctgccagtccggcgcaagcagtttggtgtaccgctcgacatagagcagctgcttgcccaccaggatgaattccttggggaggatagcgtccattntcgcgccccaacgcggtgagctgccggccgatcgtgccgtaagagatcttgcccaatgaggtacccatgggacgggtgaccttccggagcgactcggcganccntntgcggg

SEQ ID NO: 643334 - DNA, 1228 bp, Homo sapiens
  misc_feature (337)..(337): n is a, c, g, or t
tctttttccggcccgttcttctttcttccttctcttcgtgtttttctcctcttttgtttttcttttcttctcctactgccgccttgcttttctatctcttgctcgcttctgttggcacctctccttggttcttctctctctttttctgtcccattttctgtgtggtctttctggtccgtctttcttggtcgtgttgttgccgctatttatctcttttttgttttgcttttttttctttgttttgttttttttttttattgtgatttttttttttattttttgttttttgttttgtttcgttcttgtctgttttgctttttttcttttttatgaggangagagatttagaaacaaaagaagagaagcgaatacaaggagtccagtgtcgctgaggcttcttctgcacaaattctgtcagcgcctgcccgagccaacaacgggtggggttttactcccggtctctcctgggttgtttccgcaagttcgcctctcggccacacacctcctgttgctctgcatggtttttccccgccagctatgaactccggtgtttccgacggccagatagaaaactggggtgggtccacaggcctgattcagatgggactggaccgtccagacctggtgaagctggaaaccagggtcctcggatggagaagtttacacctggcccagtggggcaccccagtgtgatgagccctctgcaccagatggaaatggagagccccgtctgaatctggcaccgagccagatttctgagtggatcgcggggctttgtgctgggcctgctcttccttggggcccggttgttcatcgtaacttcacggagatcacgaaaaggacacactctggaacttcacgcccaccacggagtttctgagctgaaagtgaagatgagccaaccactttccaagggaaaacctttctgccccagctttgcaggatgaaacactttccccgcttggctctcatttgttccaaccagagagaccttttctccggacctgggtgctactggttgcagccactctgcaggaaaagtgcctcccctcgtgggctgcctcagctcaagcctttggcctgaagtcccagccttgatggcagcccctcattttcccagattttgttgcgtcccctttacactaacagctttctgcctcccaagcatctgttactcctcctgtgcccaccaacaccattaccattattaaattgtttttccaaacca

SEQ ID NO: 643335 - DNA, 170 bp, Homo sapiens
ggtttaagcagcttcgtagatttattgatctacatggcattgattgatttgaccattatacctgacataattcttcagtgtttgcctttgagcagtgataggttgtgtatttttggattgcctagagagcatatataccacacactacacacacttcatatctacagcgc

SEQ ID NO: 643336 - DNA, 186 bp, Homo sapiens
tggagcatgaagaaatttcgggggtgattatcctatcttatttggggtgatatttacatagatgcatatatttgtcaaaactcattgaactgtacattcataaacataaaatacataaaactggtatattttattttatgtaagttatacttcaagttgattttttaaaacatgcccggttacatg

SEQ ID NO: 643337 - DNA, 165 bp, Homo sapiens
  misc_feature (3)..(3): n is a, c, g, or t
ggnttcagcatgtctgaaagctggttgtccccggtcctctaggtgtgaggacactctgagtgttatcccaggggcccggtccattcttcccatactgaactgtcgtgcattatacaaggtaccctggctgcttacccacttcaactactctgcaaggaacccacg

SEQ ID NO: 643338 - DNA, 112 bp, Homo sapiens
gaaactgggtctgtctgagtcacccaaattagtaatgtctgtgagttaatttactcatctgaaatgaagggtaataaaacctacctatttcacaatcggggtaccgagctcg

SEQ ID NO: 643339 - DNA, 891 bp, Homo sapiens
cggcatccatatgagacgacaataatggggaggtgaaccggctcctggagcggaaccctcaaggtgaatagtcaagaacaggggccctgctacgctggagagccctaccccgcaggaatgtacaacctcttcgggagggcaccttccgccactacagagaaaggtccacgctgaacatgctgactcccggagggcgcgacatgcaagccggcttctgctgtacggcgccttccggtgccattcacccgctacatgacctgactcctgagcaggacctgggcccggtgtcagctccccacaaggacttctctgtatggagacagccccagacccttttgtgtcccaatgcccaccctcccccagcgctgcagtgggcttgtgtgtgactgtgcagtcctcgtcagccacaccctccctgtttccactcactggaactggacagttcatgtgcacgcgactcgtgggatctcagccctgctcctgggagctggaagaacgcacttggagataccataagggaccacaccacttccgtcacttaccccctgcccacagaggcagagggcacagggaagaagccgggccaagcgtcggaattaatgtgccacaagtgttgtggccattcctgaactgggaagtccctggctggcccccgggggagaggggcaaatgcctcacgggagctgacactccaggcagactttgccttctctcgcctgtcatttccagatttcattacctcctgacttgccatgtcacccatcaatgtgaaagtcagggtcacagctggtctgtgtgtcgcagttccgctacaagcctgttcgttgttgggcagcctgaggctgttgcccgaatcatagttcagtttttgacttaactgccgttttccct

SEQ ID NO: 643340 - DNA, 311 bp, Homo sapiens
tctgttcggtaagtcgttgcgttcttccgcatcgcccagctctgatttgagatggagaggggcgctatgcggaatgtgccatccgatggcaggaagtgtgcggtagagtacgtttgggcaggagggccgatagcacatggcctgccagcccatcacagcaagggtgatgccagccctgtgatcatttaggacaacaggtctaaggtccttggtgaaccagagaacacagggacacagtacagaaccgatcgcttgtagctctcctggtattctgcttgttagtttccacccaaattattgctaatcctatc

SEQ ID NO: 643341 - DNA, 741 bp, Homo sapiens
  misc_feature (80)..(80): n is a, c, g, or t
aaagcacataccaaggccaccacacaccacctgtcaaaagggcttcgatacgggataatcctatttattacctcagaagnttttttcttcgcaggatttttctgagccttttacactccagcctagcccctaccccccaattaggagggcactgggcccccaacaggcatcaccccgctaaatcccctagaagtcccacgtcctaacatgacagtccgtattagctcgcagtcaggaggtatcaactcacctgagctcaccataggtctaataggaaaacaaccgaaaccaaataatgtcaacgcactgcttattacaattttcactgggtctctattttaccctcctacaagcctcaagagtacttcgagtctcccttcaccatttccgacgggatctacggctcaacatttccggtagcccacaggcttccacggacttcacgtccttcattggctcagactttcctcactcatctggctttcatccgccaactaatatttcactttagcatccaaagcatcactttggcttcgaagccgtcgcctgatactggcattccgtcgatgtggttagactatttctgtatgtctccatcctcttgatgagggtcttctatctccgttatcaactctcgggctcccctttcgggggcgggaggaggttgtgcttgccggcccttttgtgttccgccccgttttgtccctgggaatcgcggcccccttggggcaaaactggagc

SEQ ID NO: 643342 - DNA, 373 bp, Homo sapiens
atattggatgttagcttttaattaagatgacttttaaccatttgagtttctttttaaaaaatttttaagatctcgtcaacatatttcagctaggacaaatatctgctatttcagaagtaccaagtatcaaaccagaaaggtcttgatttaggaaccaaacccaggctgtcatggaaaaaagaagacagaaccttagctatggaactgcagttggggtgacaatcctttctctttcagtttggcctggctagcaaaaaggtggccttgttatgtaaataaatccccttaagtagtcaaaatcaatgaaactctcacccacccctttaacctcttgtctccagaccttctgggtatgtaaaaacacaacacaaca

SEQ ID NO: 643343 - DNA, 296 bp, Homo sapiens
  misc_feature (66)..(66): n is a, c, g, or t
cgcgcagagggtatagcctcggttgtctaggatagcctcagacgagtgtacagaacgtgtagtgtntgattcgtacttcatatgtgctccacgtggcaatcatcagcatgtgaatctcgtgctgcacgtctacgcgtcgtgctgccgattccacatctgcacctgcaacagagcgcctgatgtatcttgttgtgtgttgtttgtcttgtcatctgcttgtgtattcttgatgtctatagttatatatattcttcaattgtgtgtctctcgcgagagcacagcgcagaatatagttg

SEQ ID NO: 643344 - DNA, 129 bp, Homo sapiens
  misc_feature (23)..(23): n is a, c, g, or t
ggggggggccccccccccccccnccccgttttttgggttcggggggggggggccccaaaacccccccaaagggggggggggggggaaggacggtttcttttcgtttaaaaaggggctttccctttttta

SEQ ID NO: 643345 - DNA, 673 bp, Homo sapiens
cccggtttgaatgagcggggctgggagtgagcgggcggagcgcgagctcgaggaagagacaggcagcgcgcgtgagcgcgccttgtgtgcgcgcgcggcctgtggaggtcggacctccgcctggcgcggccgggggagggggaggggcaggttgttgatccccaccatggccatcacccagtttcgggttatctaaatttggtacctgcctagcaaccagttattctcattcctaagcgagatttattattgcagatctggcagaggacggaaatcatgtggagaccaaattaattggccaactacagttgattattcatcagttcctaagcagacagatgttgaagatgtggacctttccttgggatgaagatgcacccaaccagtgtaaagagatcgaaggagggactgggaattgttggcaacacaacaaaaatttcttgtggaacaacctggaaaccgtgacgtaattaagaggactttgacacccaacttattaggaaaacctcagaacactgtggtcattacaggacacgacgagaacccattgaaatttgtggcatcccagattgggacgcacaagggtttctctagctagattagcagcctacacaagattctgccttttattccatcagtcttctgaattaggggactttaggatcccttggag

SEQ ID NO: 643346 - DNA, 262 bp, Homo sapiens
atcttcgatctgtgttaatctgtaatttatagaccagctaactccctaacttggatctaggaatgcattagtatatagacctatgtacccatgcccagactttcatggcgcatacgtgggtatacgtctagtagatatgaaaacacacagaacagaagagatccatgctgacaaaagacgtgatacctcaatatacctagactaaactggtcctcgaactacaagcaagagtattctatacactactaggcactagtgctca

SEQ ID NO: 643347 - DNA, 425 bp, Homo sapiens
ataattaataccttaggttcccatacacttgtatactagggtaaatgctggacacttcctactgctcatttaaacagatccttgtgggttgaagggtcagctgattttcttgctgcaatatttacaaagaggcctggggctgggatgggtggctttattggtactctgccagcaaacgtatccaaaagaactttgggcctggcacggtggctcaccctgtaatcccagcactttggcaggctgaggcgggcggatcacttgagcccaagagtttgagacaagcctggacaacatggtgaaaacctgtctttactaacaaacaaaaaattacaaagattagccgagtgtgtaggcaggcccctgtaatcccagctcactgggacggctgcggcaggagaatcacttgaactcggaatgcgcaggtt

SEQ ID NO: 643348 - DNA, 100 bp, Homo sapiens
  misc_feature (1)..(1): n is a, c, g, or t
ngttcaaaacagagcaaaaacaaaaatctgaaaagtctaacccccatgttatggaccaacactggaattacattttaggggattcctcctctcaagaaaa

SEQ ID NO: 643349 - DNA, 324 bp, Homo sapiens
  misc_feature (145)..(145): n is a, c, g, or t
  misc_feature (212)..(212): n is a, c, g, or t
  misc_feature (237)..(237): n is a, c, g, or t
gagacagagtctcactctgccgcccaggctggagtgcagtggcacaatctcatcgctgcaacctccgcctccccaggttcaagcgattctcctgtctcagcctcctgagtagctgggattacaggtgtgtgccaccataccaggntaatttttctgtttttagtagagatggggtttcaccatgttggtcaggctggtcttgaactcctggnctcaagtaatcctcgtgccgaattnggcagggctctcagccctaataaataatatttttacctaatgtcaaatctttttccagctaactaaaaactgtgtacaaaagggttg

SEQ ID NO: 643350 - DNA, 1422 bp, Homo sapiens
gggcgcgccctgttggactacaacatccagaaagagtctacccatggagctggtgctccgtatacaaaggtggggtatgcagatcttgcgtgaagacctctgactaggtaaagacgcagtcatgcttctcgaaggtggagccgagtgacaccagtatgacgaagtgctcaagggcaaagagaatccaaggacaatggaacggcagtcccgaccattgaccgagcagaggtagagtcctagggccgagaagaataagccaggaagactggacgggacccgtgatcatgacgatacgagacaatcacaagacaagaggtccaacatgtgcacccatgggcatgcgtcacgcacgtgcaagcacgcgtggggcatgcacgaatacgtatgcagaggaagagaacgcacatagagcgtaggagaaagaggaacccagtcaccttcctgcgacgcgtagggacgcccagagttgaccaagcgcgaacaagacgaaaatgtaccacagggcgggagaagagtacacaagggcacgaagggggaacgagcgagtcgcgcgtctctgggtaataggcaggcaaacgaaagcgttgggattacatatggctgcgttagtgtgcatacaccaacgcaatgggcacaagtcattgtgggacagcaaccgcgatggtgacgttagaacctaaaggaaccatacgccaaggaaagagcaaggttccggaccgcgttggcgagcgcatagggataggcttaccgggtcgctataaggaacggtatggggaatagcaaagaaaatacgtagtcggcagagagggaaacccggaaccatagggcgtaaagggacagcagcgtgccaacagtatcaatgcgaccgagatagcgacaggcgcggaaggtgaaacaagccaagtagtgaacgagccgggtacagaggggaccaaaggaattcgcaagagcaacgagcgggaaagggcaagtacagcggacgcgtgaaacgcgaggcacagagaggggtcggaacacaatcggaggcagtaggcggggaacacaccacggctgaggggaaacgcgaaatagggcagcgcgacacccaccatggataccggggaacgtaacgaagagcaggtcgcaggaaacagaggcaggtcccgacaccgccgtggagaacacacatagagagtggcacggccgggcaactattaaacgaaaggggtaggggcgaaatgaccagggcatacagatcgcggggagggaagaggaagcaccccgagtgaaaacatggggtgcagacaggcacacgcggatcgcaagcataccaatcgggacacagaggggaagggccggaagcgtggtgaggacacccagtcggagagcacaagtggcaacgaaggacacgagagagaacgcccagtgggcaagcaggcggca

SEQ ID NO: 643351 - DNA, 127 bp, Homo sapiens
tgtcttcaagctccaagattcggtcctggactcggactagttctgtagttaatgcttcaaaatgtattaggtaattgtggtagtagttttgacaattccagaagttccatttggttctttcttaaag

SEQ ID NO: 643352 - DNA, 213 bp, Homo sapiens
tcaatttctacacctcgtaggcagcatatgattaggtcttattttttatccattcagctactcttttttatattggagtatttagtccagttacatttaatgttattagtaataggaaaggactcactactgccattttgttactttttttctggggttgtattgttggtcctctcttccttcctttctgtcttcctttgtgtagaaattgaa

SEQ ID NO: 643353 - DNA, 163 bp, Homo sapiens
ttagaccaggccgggcttggaaaaccctgtggcgggtgacgctcgcctctgcctccccatgtgctgacatgagccatgggtccctgcctcactatgcaagtttttaaaactttttttgtaaagacaaggtctcaatatgttgcccaggctggtctcaaactcc

SEQ ID NO: 643354 - DNA, 928 bp, Homo sapiens
  misc_feature (437)..(437): n is a, c, g, or t
ataaggataagtatggagacgaccccaacgatacttgtccgatcgttttaggagccgtccgtacgtcctgccatttcgcgggacgtgtgcggtaacaccaaggacggttcgcccccccgggttagacctcgggcctccccatgtacttttttgggcccgcgcccggtgactcttgtggtacccgagtgcgtttccaaggggtgccctcaggaactgcccaagcagcagggtgtctttctgtgtgccaccagccctggcaatctgctcccccgggctttaacccgggtgtactacgccccaagccccgtcgcgggggtatcctgaattcctcccttccacaaagccatttgtcgcccaccagacaccggttggccccccccggggaaatttcggtgaccatctcatggcccccgaccttttcaagcaagtggtcttcntcagaggccacccccctgcctgtgcgagccgccgcgtaagagaacaagttttcttcttaggtagttcgggcgaacgcccccgcaactatccaacagtggagacaacaacgcttttgctctcccaagaattcgtcgcaaataaatccgctgtaaatatagcccaagtggtatgaacgcctggtcctctctttctttcatgattcgtggagcaatagcaaccccccccgctgtcgaaattacctgccgatataatatgtgatttcatcgatgaatagtaatctggtaaagatcattaatctatccggccggacgaaactatccgcccgtcaataattaaatacaaggcgacaataaagaaaacgcggatatcccccctgggtgtaaatcctggtaagaagaaccttttgtcccgagcaccctgttgtgtataaaaaccccccttccaattttccaaaaaacccttaaaaaaaatttcccacgccccacaaaac

SEQ ID NO: 643355 - DNA, 492 bp, Homo sapiens
gcacgaggttagacttggtcgagtggatgatcaggattgccgctaatgatgcacctgattttgattctacaaaagtagaagtcaatggggtttcaatggaggcacgtttatatgctgaaaatccattgaaaaatttcagaccttctccaggtttacttgtcgatgtgaaatttcctgattgggcaagagtcgatacttgggttaagaaaggtactaatatttctcccgaatatgatccaacattggccaaaattatcgttcatgggaaagaccgtgatgatgcaatatccaagttaaatcaagcgttagaagaaacaaaagtttacggatgtattactaacattgactacctgaagcctatcattaccagtgatttctttgctaaagcaaaagtttctacaaacattttgaactcttatcaatatgagcctaccgccatcgaaattactttgcccggtgcacacactagtattcaggattaccccggtagag

SEQ ID NO: 643356 - DNA, 165 bp, Homo sapiens
gtcatcagccagcggctcccatttctcctcacctctctgggccagctgaggacagtagctttgactcggaaggctgaaggatgagaagtcagtcctgattggcagctttcagagtgggggtaaggaggccaacttacttcttcctaaacttgggcaggtccttct

SEQ ID NO: 643357 - DNA, 737 bp, Homo sapiens
ctgaaaggaagttgttcatggatcagaaatgtgggaggcccttccttgcccaaggcaagtcgctgtagatggttaaactgataccaaaaataggtaagggaaattccaaattccattggaagatggccttttactgacactgcagacatgtagatacaatagtttaatgtcctctgaaaaggtaaaaattccataaatccttgcaaacaatttttagcaatattgtttattgctaccacagccaagaatgggtatttcaaagccaggttttttttatttggttggttgtttttttttttttttttgggctacactttttggggggggaccttttaattggggaaaaaaatgctgagtatacttttctttcacaaccattgcaaacccaggtagccctggagtttcctttttcctcatcatcatggtgtggtgttttgtagggtccaagactttggcaatacttgatttaaaaataagcagttctttaaagcatagcgctctaaaaactattcttagtttataccctcaaaagtggggtctttcatgaaacacaggggtttgattttgaaccccagtagcattctcgtcgttgtagggtaccgagagtttggtaagaatgatctccaaaagaagcagtcctcaaagggcttttaccagtgatatctttaatatccatgtctattcaatgatgtcagatacgaattataacctactaggaacttacacacaaaaaaagg

SEQ ID NO: 643358 - DNA, 898 bp, Homo sapiens
tatgctgtctcggcctgcctatgtcgttcggcgcggtgcaaatgttttggtgttggtgctccacatatggcgcggggatgacctcctcacgtggggccgtcatatgcgcccctatgttgaatgctgcgtgcctctatcaaggtgggggtggccccctccagtttgtgtccagcgggtcctggggtccccttaataaataacggacctcggttgtatgcaggaccaaatttgtcccccgttcgaacttgataccgctatgggttgtcccgtctgaacgggggacgcgttcatccagtgtgggcaaatggtggccctatctacaggcggcccttcctgtaagcgtgggtttttcccctaaaccccgggtccccgcattggtggcgaatggatcccgattggacccgcacgctgaggagtgagtgtcaataccccgtttgttgccgcggagaaacaccctggataaataaacacccgttgtttgaggtggcgacacgattttattcattcttgcagaatgatatgcccgcgcccgtcatcgtcagcagccgcacagctttttgggcccccgccctcccggccttctagttagtgtttggcgccctcagtcaccaggctgtacactggcgtttacaccacctggtggggtccgcccccgccccgctctttctcgccttgggggtcgcttgcccccccgcgttccccggtgctctgttgccccaaaatagggcgcgctatgtatgctgagctaattccccggatccaagtaacggcgttttctttcgccccgcctgtttatgcgccgcacggcgccagcctctgtgcctcgagtttttcaccacgccgctttagttcccccccccagcccccatctcccccaattgtcccacgcaacataaca

SEQ ID NO: 643359 - DNA, 242 bp, Homo sapiens
ctggtacgatgcctaaggaactcagaggaagaggctgaatgttccaggctctagtgatctgtgtgacttttctcattctaagtaagtggggttatccaggtaactttgtattcttaaagtaggcctcccagtttgcatgagtttctaggacccacaactctgataagttaagagataaaagcaaggtatctacctccatatacccccagggttgggggaaccatatcctccctaagacccta

SEQ ID NO: 643360 - DNA, 362 bp, Homo sapiens
gtgctttgggacggcggatcgagcaatggtctgcatagagcacggaggtctacgctcgggcggggcagctctcggggctgctggtattactgcgctacttcttctcttcgtctcctcatccaattcctcatcatcctggggctcgtgctcttcatggtctattgcaacgtgcacgttagcacagagtccaacctgcaggccaccgagcgccgagccgagggcctatacagtcagctcctagggctcacggcctcccagtccaacttgaccaaggagctcaacttcaccacccgcgccaaggatgccatcatgcagatatggctgaatgctcgccgtcccaccagcgccgtcccaaagcacag

SEQ ID NO: 643361 - DNA, 504 bp, Homo sapiens
ccctttctgtacatgtttctcctgcttagagtggggtgggcatcctctatacagcaaatgctgacttggcggtatgagatcttggatacagtgtgacctctgagctctgaaccaggctgcccctgacaaaaaaatgtgtcccctcccacaggtaaacaaggaagaaggcactgcaaggagctcggggccgggctcaggggaggctctgccacctttccaggatcaaaggccaagggaggtgacttggcaaggaaaagatctaggggggtcagacaaggaatattagacccacagtggtcaaaaaaaccatggggctctcaggagtcacagattataacaaactggcagcatttgagaccaaaacatctcatgacttagagcaccttaagcctcagggggtgggcagacattacatgggacgggaagagtcaaaggtgtgcttctccactgataattctgatgggttcggggcccggggcatcttcggtgagggagagagccggg

SEQ ID NO: 643362 - DNA, 151 bp, Homo sapiens
tgctgggatggtaggcgtgagccaccgcgcccagccacctcagtgttaaacggtttagatgcagctgtcacagaagctttaggagaacctcatcggttttcatattagaagcggttttctggttctcgacactcggtatcccaatagctca

SEQ ID NO: 643363 - DNA, 147 bp, Homo sapiens
atcccgggcgtgcggggttacaggcgtgagcatctagccagccccctacatatctgtttgtgatttaaataatttgaatagtctcccttttttctgtcagtgtagctaaagattcttcatattttcgttgactcttttcaatagaac

SEQ ID NO: 643364 - DNA, 405 bp, Homo sapiens
cgcacaaaacatatagcctgtaccaggggatacaaccaggccgagcccatttccagtgatatagctgtcaggtggcgctaagccaaacaaatctgggtttccctgagactagacctctctttctgggagagatggaatcacagggacaaggttggccaccttggggtagtgagaattcatcctgcctaaacagggagaattcaaacaagtttctagaaagccaaactactttctagaaagtcaaagataattatattttttgccatgactgtaagaatgcccatttcattgcacactttctaacatttttaccaatctgataaataaaagctggtactgaggtgaaaaaaaggctgggcacagtggctcacacctgtatttccaacattttgggaggctgaagtg

SEQ ID NO: 643365 - DNA, 1178 bp, Homo sapiens
tcaatccccatttattttgggccctgggggcgatgtcatcttttcaatatgaaaaaaagcagcaagttcaacataaaataaaatctctctcaaagtgttgaggataaacacaaaaccaagtgtggtgttgaggggggaagcaacagcaaagaggaaaaatgtgagatgtgtgcaaaaaagagtgggaggagggttccccttctcctcgggggactgacttcaaaccacgtcattggtggccagttttaccaccactctccagaagctcagggggtggtccattctttttgtggggagttaagaaaagagggtggggaatttagaaagagcgtttccgtggagaggctatagggcaccaaagggcgggctcttcttttccccccttccaaaaccccctttgaatcccttttctcgtgaatcgagggggacaaggaagcttgaagttgaagggaaggttaaagtttgggaaggggagaggtattccatgtgtagacagacgtggggagacaagatctccctttccaagaagttaagacgctgtggcagggacgcatttgacaccgggggaagaataaatacctggcgttgacacctctccctttagaaaggcttgacaatgttgcggaaacatcgtgggaccatatacttttaagaacatctttcacgaggagacctttaaaattcagcgcccgtgggatgtttccgcccttcctcccaaaaaaaacttgttctagcgacacgttgcgaacaattcccccaatttccgcccgtttccccttttattattacgggagacgtttctatacccccaatataaccttttcttaaccacattttcctacaactttgagggggccttacaggattacgatgggagccattaatcctaaccgtcgtggctcttccacaagcaccccgtgggtgtgggctcctaaaaacgggggaccctgtgggaaagacccccacggctttcttggggagacgaatctactcaacaacagagagaccattataagctcggggaccacaactgcgggagattgggcgccccaagcaagaacaaacaccggggtgcccccaaaaatggggcggaaacaccattaatgggccccccaacgtgatgcaccaacaaagacaaggggaagccactcccccacacccccagctttattttttgg

SEQ ID NO: 643366 - DNA, 1031 bp, Homo sapiens
  misc_feature (107)..(107): n is a, c, g, or t
  misc_feature (109)..(110): n is a, c, g, or t
  misc_feature (112)..(113): n is a, c, g, or t
attaagcaaagatgatatgaaaatatggttaaaaatgcagagaaatatgctgaagaagaccggcgaaagaaggaacgagttgaagcagttaatatggctgaaggaancnntnncgacacagaaaccaagatggaagaattcaaggactaattacctgctgatgagtgcaacaagctgaaagaacgagatttccaaaatgagggagctcctggctagcaacaagacagcgaaacaggagaaaatattagacaggcagcatcctctcttcagccaggcactcattgaagctgttcgaaatggcatacaacaaagatggcatctgagcgagaaggctctggaagctcctggcactggggaacaaaaggaagatcaaaacggaggacaaaacagtaataactagcagaacactccgaagccacgaaggacaacatatgaagcttacggagtgaagagacttcctgagcagataatgggcgaacttcagctcttttctacctgtgtcccgcagctacttctatatatacatatccttaagttcgtaacactctagtgaccattacgctagtgatcacttctaactggacagctgattctaacagctataaagcttcacaatattctatgtccctagcctgtcattccccagcctgcactgtaacacaggaggctaggattgcacactcgactcatcataacagattctcaactatcccactgctgaacagtgaccactatcccccacggggtgcacagccatctcgcacacagcaacgaacggtacgccactccacagcactccgacaccgacgaccacactatgggccactgacaatccttcataccccacccgtcacccaccgcctgcacacgcccctgccatgcaccagcacggccccccaacgcaggcccctgcccaccccaccctgcccgcgccccgcccgccagcacggcaacacgccaccctacacccacgcccaaactacaccagccgcgccacgccacgcccctcacaccagccccgaccgccccag

SEQ ID NO: 643367 - DNA, 733 bp, Homo sapiens
  misc_feature (308)..(308): n is a, c, g, or t
  misc_feature (376)..(376): n is a, c, g, or t
tcctggaaattcatgaacggagtattatgaggtgaaatccacaaatggggataccttcttaggtggggaagactttgaccaggccttgctacggtcacactgtgagaggagttcatagagtagagacaggggttgatttgagcctaaagacaacatggcacttcagagggtacgggaagctgtctgaaccacggctaaatgtgaactctcctcatctgtgcagactgacatcaatttgccctatcttacaatggattcttctggacccaagcatttgaatatgaagttgacccgtgctcaatttgaanggattgtcactgatctaatcagaaggactatcgctccatgccaaaaagctatgcaagatgcagaagtnagcaagagtgacataggagaagtgattcttgtgggtggcatgactaggatgcccaaggttcagcagactgtacaggatctttttggcagagccccaagtaaagctgtcaatcctgatgaggctgtggccattggagctgccattcagggaggtgtgttggccggcgatgtcacggatgtgctgctccttgatgtcactcccctgtccgggtattgaaactctaggaggtgtcttaaccaaacttattaataggaataccatattccaacaagaagagcaggtattctctagtgcgctgatggtcaaacgcaagttggacatcaacgtgtgtcacggtgaagacaatggtttggggca

SEQ ID NO: 643368 - DNA, 1052 bp, Homo sapiens
caagtgacccgctatgaggaattggccatgtcaaaagatcgacgcctggataatgcaacgtggctctcggagtggcccttcaacaggctaaatcagagtgagactattccaatgaggcattggcacggacaggaccaccttgcgggactaaaagctaagaacggggaccctatcatgttccgggacgcaagtagcgttggccctccagacaccgtttccgtgaaaacccggaggggtgagattccagtccccctgccattgaaggaagactttcggttgatcctcgtcaagcccatccctttctgcctctaacgtccttcacgaggctatctggcctcttactttcctttctggggggctgacacatggaccagaaggcctgggtaggccaggtgtcttggtacccacctgataaagcagctaacattctgaagtgactctactggagatccttgatagaaagactcttttgaggctatctgacacctaggtcgctcaggtgaaatagtaccaccgcacagcgaaatagattacaagccttatgaggtcaagaaatgtgacctccagccgggcgcggtggctcacgcccgtaatcaccagcaactgttgggaggccaaggcgggcggatcaaccgaggtcgggagttttgagaaccagcccgacccaaacaatggagaaaccctgtctgcgtacgtagaaaactacaacactagccacggtgtgagagggacaagcctgtaaatcccagcataactagggaggctgaggacaggagaatcactcgaacccgggaggcagaggttgcagatgaaatcaagatcacgccatatgcatctccagcctgggcaacaagagcgaaactccatttcctaaaaaaaaaaagtgtcttgttcactgcagcatgcccagtgcacacgcacaggtgctgacctatagtaagtgcttaacatttgtttgaataggggaaagaaatttccggaagtaaatacagcaattaataatgtttataaggctgggcatggtcgctcaggccagtaatcccagtgactta

SEQ ID NO: 643369 - DNA, 395 bp, Homo sapiens
  misc_feature (107)..(107): n is a, c, g, or t
  misc_feature (109)..(110): n is a, c, g, or t
  misc_feature (112)..(113): n is a, c, g, or t
attaagcaaagatgatatgaaaatatggttaaaaatgcagagaaatatgctgaagaagaccggcgaaagaaggaacgagttgaagcagttaatatggctgaaggaancnntnncgacacagaaaccaagatggaagaattcaaggactaattacctgctgatgagtgcaacaagctgccattcagggaggtgtgttggccggcgatgtcacggatgtgctgctccttgatgtcactcccctgtccgggtattgaaactctaggaggtgtcttaaccaaacttattaataggaataccatattccaacaagaagagcaggtattctctagtgcgctgatggtcaaacgcaagttggacatcaacgtgtgtcacggtgaagacaatggtttggggca

SEQ ID NO: 643370 - DNA, 605 bp, Homo sapiens
gagcacagtagcagtctgcttagatgttaaaaaaaaaatcataaaaagccatggtgctgtaacgacaataatcggtactgaagtcataagcatctatcctcttcaaggattttatccaagataaaagaccttgtagacggtacacctgctgtagtctcctcaaacagggcctccccgtgtctcttctgcagcaaacatgcctgagctgtttccatcaccttctccatcaacagttccctggtcactgtcttggtcatcctccctctcctcctgcttcctttcttcccgtttgggcacttctgcatgtatgtcctttccttctataatcccatttgtcagaccgggagacggaaaaaggatgctatgggccaaatgagggcccttgatggctcttatgctctgtgcatggttctttcccagttcttccagattgaagccgctttccatgtctaccacaatactctcattaaaatatggaggaggagtccaaaatgtagggggatggcaatagtcaagctaatgaggcccctgtccactccaaccacagaagtttggcagccccttcaaaatgtgggatccacctttgtggtgcatcctctactcta

SEQ ID NO: 643371 - DNA, 106 bp, Homo sapiens
ggacttcgaatcatcatcctgctcgcacaaatgtgcgatattctgctgggcagaatctgtgactaatcttcctcaagtcataaaacaaaagctgacacctttatat

SEQ ID NO: 643372 - DNA, 170 bp, Homo sapiens
gtgatgtcagctgttcattttgtgcagagtgtaaacattactgtgcagccgtgactatctgtctggtcgattttaacacgatgattgtaggctagaataccttttatagcctgtcagaacttggaatctctaagttcttgacggtggtaccggagtctcgatattcggta

SEQ ID NO: 643373 - DNA, 431 bp, Homo sapiens
atcatcgggaaacgctattacactctggacacatgcatatacacagggaaacaatttcaacagatatatgacttagatcctagtgaaggagaaaaagtcgatatatgttaaatactaaaaacagaatggctatcatgacctttttacacactcagagatatttaaaagacttgaagagacaatactatggttgacgacactggcttcctattccagccctacttaagagaaaaaatagctagtatgtttctaattgaaactagagtgaactgggcatcttcacagttatcattttcttggatatcaaaaaacaaaagacctgggaaagacaaacaagtgtttcacagaaatgaagcaaacacattttcacatgacataatcattgacttggtggtacacagctcaagtccagctttcactgatatttcctc

SEQ ID NO: 643374 - DNA, 703 bp, Homo sapiens
  misc_feature (1)..(1): n is a, c, g, or t
  misc_feature (65)..(66): n is a, c, g, or t
  misc_feature (68)..(68): n is a, c, g, or t
  misc_feature (70)..(70): n is a, c, g, or t
  misc_feature (72)..(72): n is a, c, g, or t
  misc_feature (74)..(74): n is a, c, g, or t
  misc_feature (151)..(151): n is a, c, g, or t
  misc_feature (153)..(153): n is a, c, g, or t
  misc_feature (163)..(163): n is a, c, g, or t
  misc_feature (166)..(166): n is a, c, g, or t
  misc_feature (171)..(171): n is a, c, g, or t
  misc_feature (178)..(178): n is a, c, g, or t
  misc_feature (180)..(181): n is a, c, g, or t
  misc_feature (187)..(187): n is a, c, g, or t
  misc_feature (193)..(195): n is a, c, g, or t
  misc_feature (201)..(201): n is a, c, g, or t
  misc_feature (210)..(210): n is a, c, g, or t
  misc_feature (213)..(213): n is a, c, g, or t
  misc_feature (216)..(216): n is a, c, g, or t
  misc_feature (271)..(272): n is a, c, g, or t
  misc_feature (274)..(274): n is a, c, g, or t
  misc_feature (276)..(277): n is a, c, g, or t
  misc_feature (283)..(283): n is a, c, g, or t
  misc_feature (307)..(307): n is a, c, g, or t
  misc_feature (345)..(345): n is a, c, g, or t
  misc_feature (411)..(411): n is a, c, g, or t
  misc_feature (425)..(425): n is a, c, g, or t
  misc_feature (436)..(437): n is a, c, g, or t
  misc_feature (457)..(457): n is a, c, g, or t
  misc_feature (473)..(473): n is a, c, g, or t
  misc_feature (482)..(482): n is a, c, g, or t
  misc_feature (587)..(587): n is a, c, g, or t
  misc_feature (680)..(680): n is a, c, g, or t
ntaagaggtggaaaagaggtgagtaaataaaatagattgtaaagaatatgtgggtatggacagcnntngntngngaaaaataagggtgggggtagggattggggttgggggttggggtggtggggtgtatttaaaaaaatgttttgggagntnagtgtttatnatntgggnatggganannatgtgnatgtgnnnatattngtagggtanagnagnagtagatgggtggaagaaggttggtggtaggggaggggagaaaatatttgtgggnnangnnaggatnggggaggaaaataaagaggaaggngggggggttgagtgaggtggtgggtaggggtgagtggnagattagtgtggtttgagaaagaggaaggggatttgtttgggagtttaaaaatagaggagtgaggnggagtggagagggnagagaagatannaaaattgggagggagagagnatttggggggagtggngtaggagangggaggagggagataggtatgagggtagggggtaagaagagtaggaggggtggagtggaagtgggagggtggtgaaatggggtaggaggaagaggagagtgagtntaggtttatgaggtgtggataggggttggagaggaggtgggtagggacgctggagggtgggatgtgagcgtgtggttatgtatagtgtggaangtgtgattgtaggagtgaagtgt

SEQ ID NO: 643375 - DNA, 588 bp, Homo sapiens
attcttagagaaaggggggagaaatggtggttatagattcttccttggggtagtactttactagtttattaatgttatttattttattctcaactcaaacatgtgagagtaaaattattttcttcaggtctacaaatgatgagggttagggttggggaaattaaataatttggttaagaacaatcagttaatagggagtaaagcctaaagccttcaatctggctgggtttaaacactgggtaaatataccttctagctaggatatgtgggaaagggatcaacttggattctcctatatagctttcctgaaaggagagaaaactcctcccttttttctttctcccattcttcttcctttttcttcctttctttggggctctccttacttgctctttctctccttcctttccctctccttcttcctttctttcattcactccaaaacattcatcaagcacattctatgtaccaagaaatgtgctagggatataacgataaataagacaacttcttggcctggtgctcacattccgaggtgggatcccgtggcccaagttaggagcagaggttctcggatcttatgacatc

SEQ ID NO: 643376 - DNA, 201 bp, Homo sapiens
agcggatctgcccctgaaaaccgacaaaaatacatgctgctgattcatgagggggactgagagtgtcagaaccttccagatcgagcagagctggacccagagcccttctttgagtgtcagcgctgctccactggttcctggcagaagatcccgcatcccctctggagataaagatcagagagggacgagcagatgtgactg

SEQ ID NO: 643377 - DNA, 322 bp, Homo sapiens
  misc_feature (101)..(101): n is a, c, g, or t
tcacggtgggctgggagcccagtgtccccccactcccttcatcatgcagcttttcccagccgcccaccagcgccagcagacaggtgtccagcctcctagtncaggccatttcactcttgtcgcccagatggagtgcagtggctcgatcgtggttcactgcagcctccacctcccgggttcgggtgatactcgggaggctgaggcaggacaatcgcttgaaccttggactgggaaggtggaggttgtggtgagccaggatcgcaccattgcactctagcctgggcaacaagagcaaaactccatctaaaaaaaaagtcgacgc

SEQ ID NO: 643378 - DNA, 341 bp, Homo sapiens
tgtctagcaggatcttggcagctgcaggatcatagatactatagctcaactcctgtgctcaatgatcctcctgctttggctctcaagtagctggtgacacaggcatgtcgcatcatacctggctaatttgttgtattttttgtaagagacgggatctcactatgttgctcagactggtttcgaacttgtgggctcaagcgatcccctcacttggtctccctaagtgctaagattacaggcatgaaccatcatgccggtgtgatgaccctgttaaatttttttttttttggagatggagtttggttctgtccactcaggctggagtgcaggggcatgatctt

SEQ ID NO: 643379 - DNA, 310 bp, Homo sapiens
aaaaggcccgggcaaaaccccccaacggtgttttggatggagttcccccttaccccggagggcccgctcagccctggccttttggagccttcaaaccccaagggggggttttgttggaaccccccctgcaagcaggccgtttttttttttagccctgccccagatcccaaagccctgttgggtggcccccgggctgtcagctatgcagtggggtttcccccccccccaggggacatcttcatggggttcaggcatgcaaatacccccgactgccccctttttagcaataaagtggcctgaggggtgggga

SEQ ID NO: 643380 - DNA, 258 bp, Homo sapiens
  misc_feature (52)..(52): n is a, c, g, or t
gaggatccgagttagggctaccaaatgcggctctgcctgctgctctgacatntctctactacttggtgtgctgtcatcctgctactgggaggctgaggtgggtggatcacctgaggtcaggagcgcgagaccagcacagccaacatggtgaaactcccgtctcctaaaaatgcaaaaaattagctgggcatggtggcgcacgcctatattcccaactattcaggaggcagaggcaggagaattgcttgaacccaggag

SEQ ID NO: 643381 - DNA, 1830 bp, Homo sapiens
  misc_feature (29)..(29): n is a, c, g, or t
accgcgctgtgtgtttgtgatgtctgtangtgccgatcatctggtatttatgtgtttgtatgctcttgttgcttctggtgctgccgtgtgttggtttgacgctcgctctggcgtcgttttgtctatctccctcatgcttctggtctgctctcgctgcgtggtggtgttgtttcttactcggggggtggcttcgcatgccccaccactcatcctgcgcaccgggtgttgtttgcgagtgtgcttccttctctttaccgggtgatcataaaagttgtggggtcccctccctcctggtggttctcgctatgtgatcggctggtctctctccggggctactatacaagggggttcccttcctctcctccccgcggaggggacacaccccctctcttggaaggcttttgtggtgtggttttgtctcacgaacacaccacgtgcgggtccccgacgacatgtgttgttgtcccccgccccagttgtggtggaatgggccccctcccccccccttgtgttgctctctcacgagggggccccgttgtgtgatggggagcaatccatacttcttctggtgggggaatttttggtgtgcgccgcacacacaaaaggcggccaagatggtgcacccaacgagccgttattggcgggcgccctctttgtttggtcgaccggccccccttctcttttcagtggcgtgtctcccaagacgacacccaaagggggggcgatttcggtcgtgcttgagccacaccggcccacttgtggtgtgtgtggtgtgcccccatattgggggagccccacaagggcccaacgggcggggatgtgctccccccccgctgtgtgttctccacccacgtttggccgcccccccgggggtgttttatgatcccgctgctcttttggggttgtttcttcttggtgttgttttctgtgttgccccaccccgacggggggcacacattttggtggtggttctcctacaaaggggaggagatcttctcaggttctgctctcggccccacaagaggggcgccccctcttgtgtgtcacctgttgcggcccttctgtgggggtcgcacacacggtgtgttttttttggcgagaagcacctctgagccacacagtagtgtcactgctcgccccccttctgctgcttcacagagagagagagttgtgtggggcgacacactctgggccgcacacgccccactggtttgttctcccctgagagagtcccacttcacaccactctcacacccccacctgctctgtggtgtgcgccacacttttcacttgtccacaccacagtctgtgcacacacaccacaggggtgtcacagagcgctcaccactctccacagtgtgtctcttggggaccacatgtgtggcacagaggtggagaaagagtccacacaagaaatgttttgctgggtttcctaacactcccacgccttcactcttaagggcgcacaccctccccttcaattccaagcccttctccccgcgagaccctcccacactctccctcgtctctgtggagagtgtgcccctctcacccacgccagaccccttatagagacacactattccacatttttgaggagcccccaattataatataagggcccctgtcctccgtatactgagaagaaaaaggggagagcacaccaaggccctttaatggagcacattgagaccttgttggaaaaccgcccacacacatgaaatatggttggagggaccctggatttagaggagggtggacctggggaagagccgaggctggccccctggtgactgcccacacatataattaaaatggtgatttgggaaa

SEQ ID NO: 643382 - DNA, 281 bp, Homo sapiens
ttcctctgtcagatgcatgggagaacagaaacaaggcccgtataatgtctaaactgagctgggcagagggcatggaaactatgacgcaacatatctgtaaatgtgctcacctcagctggacacagggggggtgaaaatacgccaggcctcacggagctcgtcgctgcgcacgaagtgcatctggctcccgcagaagacgtccaggatgaggcgctcgtaggcgtcagggagcttcacgttcttgtatctgttgccgtaggtgctggactacttcgactcct

SEQ ID NO: 643383 - DNA, 179 bp, Homo sapiens
  misc_feature (33)..(33): n is a, c, g, or t
gctcgacggtggccttctcaggaggaggcctgngggagtctgctgggagaggcacaccccaccagtgctgtttccttccctgctgtgcctctaccagcagactcccacaggcctcctctgtggcctcttggcagagccccatgccccgtgatttgctggtacgctttttcttgctccac

SEQ ID NO: 643384 - DNA, 174 bp, Homo sapiens
aataaaacaagcaggtacttacaaataattactcggcagtaggttataattggtggtttaaaataaccattggatacaggactgttgccaattgggtaatttcaatagttgtttgttgtttgatttgaactggaatcagtaaattgactgttaaatgtggccaaaatcagatta

SEQ ID NO: 643385 - DNA, 377 bp, Homo sapiens
tgacttttggcaccaatagtcctagaaatagcattcccaaggtaatataaaaggtcatggataatagcatccaaggatttctgagaaagattagaatagctagtccactaataaaacacatttccttctttcccaaaatctttttcaatccatttacataccttctgaattggtagaaaactaacaaatcaataccaaataagaaaaaagaaactcggaagaaaggcttccacagatccttctacggatgtatttcctacaaggatatgttctatgacaattaaagctaaacccaaaatgtttactaagagtaacaaagtatacaagagttgtttcttatctgctctaaaaactgaataagattgatttcgctggct

SEQ ID NO: 643386 - DNA, 159 bp, Homo sapiens
acagatatactcgtttgttttttttacttttaatttttctatctaaccatatttatacatgtactttataaaatattaaaattatctatcaagcttgtcttattcatatcattatattatcatatttacggacaactcattgaaacttcttgaataatg

SEQ ID NO: 643387 - DNA, 434 bp, Homo sapiens
gaatacataccggttataaagcctacagtagtatacagtaatgccctaggctttcacattcattcaccactcactgactcatgtggagcaactctcagccctgcaagctccattcgtagtaagtgccctgtacaggagagccaattcttatcttttatgccatatttttactttcctttttctctgtttacatatgtttagatacacaaatatttcccattgtgctgcaattgcctatagtattcagtagtcacatgctgtacaggtgcgtagcctgggagcaataggctctcccatatagcctaggtatgcagtaggctatgccatctaagttttgtataagtacaatctgtgataatcacactacaatgcaattgcctaatgacacatttatcagaatgcgtccctgtcaccaagagatacatgactgtatt

SEQ ID NO: 643388 - DNA, 703 bp, Homo sapiens
gcatttaagaatttgctggctgggcgcggtggctcacacttgtaatcccaacactttgggaggccgaggtgggagaatcacgaggtcaggagatcgagaccatcctggctaacacggtgaaaccccgtctctactaaaaatacaaaaaattagctgggcatggtggcaggcacctgtagtcccagctactagggaggctgaggcaggagaatggcatgaacccgggaggcagagcttgcagcgagtggagatcgtgccactgcactccagcctgggcaacagagacagacttcgtcccccaaaaaagaaagaaaaagatttggggctccccagtctactacggtgaggccattataggcaaaaccctggaccgaccatggggcaatacctaaagaaccacagaaggttctgtgcatggaccccttccagagtaatatggccaattccttggtcaggacagagagtcccaccagatctagtaacatagtgacacactataggcctatgaccttctgttagcataaaagcgcctctaaagatgaacaacggaaccatggaaccttcaggctgtgtgtgttactttcccccagtggaaagcgaaacgggccccataggacgctgaaatctgaccttgggggaccctcagggggtgaagggtggtgagcccgcagttgaccgtatgccaatgccctgtcaaacacgg

SEQ ID NO: 643389 - DNA, 529 bp, Homo sapiens
gagccgggagctgagtcggaacagtggaggtggtatgggtgctctctgcaaagctcttgctcctgggttcacgccattctcctggctcggcctcccgagtagctgggacttacaggttgccaccaccacgcctgggtaatttttggtatatttagtagagacggggttcaccgtattaggctggtctcgaactcctgatctcaagtgatttgcccggctcagcctcccaaagtgctgggattccaggcatgagccaccacatccagctgaaggaggtcacttttgcactgagacttgaaagaagtgagagagcaagccattgggttatatccgggaacagcattctaggcagtaggaacagcccacgagaagtgcctgaggcaggatagtgactggctggtttcaaggaacagcgaagggtctgtttaagtggagcggagtgagcatggggacaggtccacacagggcgtttgtagccaccaaggagtctggtttttattctaactggaacaggaaggatttcagtcca

SEQ ID NO: 643390 - DNA, 1279 bp, Homo sapiens
  misc_feature (369)..(369): n is a, c, g, or t
  misc_feature (405)..(405): n is a, c, g, or t
  misc_feature (526)..(526): n is a, c, g, or t
tggggagggggagtttccgctttggggtcacacccagaggctgggagtgtgcaaggggtgcgaactcctcagagctctcaacgtgggaaccttccaacctctccggggttccaagagcaaattctcgcgtgccttcaagcctctcccgaagttagcgtgggaatatacgaggcgccacaccaaccagcgccccagctataattttgtgggtattcttggggataaagaagtggggtttccaccagcgttgcggcccagggcgtgcttctcaaaagatctcgcgtggaacctcgagggacaattccacgcgtggcctgcggaccctcccaagaggtggcgtggtgaataaccgggctgtagagcgcccanttgtgttcgccccgggccttggtgggaatctcccantttttatattagaaggggtttaactatatcaaagtggtccctcgtggtgtagagaccatataggtgtctcatataaaaagaaagaagcgctcctatattcacagggtgggcgcatacgttnttaaaaacaccagttgtgcggggagaagaacacactttggtgtgagaacccggattgtgttgcggggggtgatacgcataaaaaagggggagcacgtgggtacttcctgtgtggaggacccctggggtgtgtgtgtaagaccgcggtgttatttggcgggcccccagagtcttcttgcgagatgttcaaccagggggggggagatacccctccccttagtggggtgggggggtgggctacaccacaactcgccggccggggcgctgtgggcgaacggccaacaatttgttgccacaagaagaaaacgtcttcctattaaacgaaacggggggcatcgtgacgttggcggtacccccccacttgtgtgttgtttgttctgtggcaccaagcttctacacctctcctgttggtttacccaacatatttcaccaagaagaggacacccgggggggggaaccattataaaggaggaacatgtgtgtgtttgtatcgtggggggccccactttttaagaaagcgcgagggtggtgtgttgggggcaaaaagggtggtttatacaattaagaggccagttgtgatgaaaatggtgtggccacgtggggggacaaatttttgtttaacacaaattgtgcgcgaggaatttttcgtaggaagttgcaagggcaatatattgtgggggaaaaatgggggggtatcccctgaggagagaattttcgaggagaagaggtttctgaaagaaaaagcgagccgccc

SEQ ID NO: 643391 - DNA, 887 bp, Homo sapiens
  misc_feature (887)..(887): n is a, c, g, or t
tttttttttttaactgtgtggtttttcttttcaaaagtatttaggcaatatggcccgtgatttccagttcttttttcccttttttggaaatggagtctcactctgtcacccaggctggagtgcagtagtgcgatctcagcctcactgggaacctcgtgcctccgggatttcaagcgattctccttgtcccagcctcccaggtagctgggactataggcacgtgccaccacaccgggtaatttttggtattttagtagagcacagcgtttcaccatgttagctaggatggtctagatctcctgaccttgtgatctgcctgcctcggcctcccaaagtgctgggattacaggcgtgagtacactgcgcccggccaagtttcagttctatatgaaagtattggatgtttggttggaacacaatacaggcattagagaacccaatgtttttcaactatatcatccatcttcagttgggatgatcggttggctgcatctaggtcgggtggactcatctgaaaaaacttttccagtgggaagaaatgcataaatgcctatagaagtagcaaaagttcctggaactggcgtgtttgttgcaactacagagggatgtaagaacatagtttttgcaacttgtcttaatgcacaagttgtgtggtaataaattccttatgatttccacataccagatcaaaggcaggttcctggccgaaacctggatttattccgaatacagcgaaatttgagggacctacaccccaattaatgcaccgggaatgggctaaacagaacaatatacaaaactgaaaaggacaagaataggacagatagtcacaaaagagagtgagaacagaacacagagaaaacaatatttacggtcttacacattcn

SEQ ID NO: 643392 - DNA, 106 bp, Homo sapiens
agcgggggaggggcgtggcctcggtccggggtggcggccgttgccgccaccaggcctcttcctgcgggcggtgctgccgaggccggactgcgcggcggcagctcat

SEQ ID NO: 643393 - DNA, 662 bp, Homo sapiens
aagaggttgccagctgtataacaaaactagagttagtaaactaatatattttgtacattttgttttacaagtcctaggaaagactgtcttctgaaaatttgagcattcttgcccactgggttgatggagatgggaagggttctaggccagaatgttcacatttggaagactctttcaaattataactgttgttacatgtttgcagtttattcgagactgctgtgtacatacatagtggacaaattaactccttacttgaaacatttagactatctagatgtttagaagtgcccgatgtatattaaatgtagaggtagtaaaataccaatttgtaaatatctttttgctaaaattcataggaaatacttttggaagttgaattgtgaagccacctttgtgagcagtatattactgtctatacttgctcaatggtttagaggaggtgggagggaagaaattgcaaaagataatatgctagtgtgttcatacttggacattttcagacaccatttttctgtatgtttgtgcatttgtttgctctgtatatagtgtatataatggacaaatagtcttaattttttaaacatctagaggttgccagtgtatgacaaaagtagtaaaattagcatattttgtatgcttgtgttgaaattcataggaaa

SEQ ID NO: 643394 - DNA, 115 bp, Homo sapiens
tcaagcttctaacgatgtacggggacatgctacttcatttgtatcaacccattgagtcctggcaattactgctggacaaggcagacagaattattatactgtctttctacaaaaa

SEQ ID NO: 643395 - DNA, 421 bp, Homo sapiens
  misc_feature (224)..(224): n is a, c, g, or t
  misc_feature (360)..(360): n is a, c, g, or t
  misc_feature (379)..(379): n is a, c, g, or t
  misc_feature (386)..(386): n is a, c, g, or t
gatctcagctcaccgcaacctccacctcctgggttcaagtgattttcctgcctcagcctcccaagtagctgggaatacaggcacgccaccatgcccagctaatttttgtattttcagtagaaacgggatttcaccacgttggccaggctggtctcgaactcctgaccgcaagtgatccacccgcctccgcctcccaaagtgctgggattacagggcgtgacatncgtgcccggcccaaagggggaaactcttgtggggaggagcagaggggctcacattttcccctctgatttcccccatggcacatttgcctttatcttttcccccattttaggccaggggatctatttgtgttttttntttcttgggcaattttaantatgganttgttgttatggtggcccgtttaaccaccaccccc

SEQ ID NO: 643396 - DNA, 82 bp, Homo sapiens
catctattttattttattgaatactgtctgtaactttggttcatcctgtttgaagaaaaaggacaaataaaacatggccagc

SEQ ID NO: 643397 - DNA, 135 bp, Homo sapiens
gtagtgtgttcatgcattgcaaactgtaattgccttcgggttgtgctttagtctgtacaaattctcacaggcagcagctgctcaccattgttttctatcaatccacaccatttttactccattgtgtccaccaca

SEQ ID NO: 643398 - DNA, 109 bp, Homo sapiens
tcctggcttactcaggcatgcatgcccccctcatcattcaaaccccaccctagtttccctgaaggaacattccttagtctcaagggctagcagacctgagcaagccagg

SEQ ID NO: 643399 - DNA, 367 bp, Homo sapiens
ggggaccaggacgacgggacgactggtgtctctggtaaacatgtggatcctctgaaaattttctgactgattgttgcaaacttggggtctgggtgtggaactgtcgagaagctgagtgaccctagatctgatgtagatcatacctaggtccttgtttaacaggcttatggtggacgggttgcatgagatgtgctgagtcatcaaaattacttgacctgggtccactggaatcccaatactttctgataggaccattctgaaggtcttcaatgtcgtttggtcttcctaagcaatgtccccggcacctattgaatccttcaattgcatcatctggcctcaggccttctacatcaatcaaatatctgca

SEQ ID NO: 643400 - DNA, 447 bp, Homo sapiens
  misc_feature (14)..(14): n is a, c, g, or t
  misc_feature (20)..(20): n is a, c, g, or t
  misc_feature (175)..(175): n is a, c, g, or t
ggacaatgtcctgnaggctnacggttttaatagacctaaggggtcccccaaccccctgggctacagaccggtacccagaaccgggccacacagcaggaggtgagcagcaggcgagcaagggaagcttcatctgtatttacagccacccccccattgatcccacagcagccttgantccgcctcctgtcagatcagtggcggctggagattgtcataggagctggaaccctatggtgaactgcgcatgtgaggaggttgcgcgcttcttttgaaaacctaatgcctgatctgtcgttgttgcccatcacctccagataggactgtctagttgcaggaaaacaagctcagggctcccacgggatcctacattactgtgagttgtatatttcactatatgttacaatgtaataataatagaaataaaatgtacataaatgtaaaaaaaaa

SEQ ID NO: 643401 - DNA, 1413 bp, Homo sapiens
  misc_feature (292)..(292): n is a, c, g, or t
  misc_feature (1291)..(1291): n is a, c, g, or t
ggccggttgggctgcgcgcgactgctggcgatggctcgctgggaccttacgctggttccccttcgctctcctctccctggcccgtggccactatgagagtccgctgacgccgctgttaactgagcctgccgagccaacgattgccggtcgctattctacacgagagctccgcgaaaatgcgcctcagatactgccgccccacgatatttcattgatggttcggcgcaatcagctatgtctgcgtcgtggattgttctattatgactgacattgtaaaacgttacaagaacantagtacatcaatgagacgacaatagcataactacggatacccacatttgaatggtatgataaatgatcttttgcgaaacattttagcagattgtggatcctttcagctataggagctcaatatctgtgcctacaagtgcaggggcgcatcttagtaccccagtttataaacgcaaacaatttttgttcaaaacagagagtgtgagagcaatattgataacctccgtcctagaggcaggtggagattgcttcgcgcattaaatgggagaaccaataaacttatttgacacatactacatgtggggtcctaagaaaagcggaaatagtaagccactaaccttgtacccaaccccttggactttacaccaaagaaaacattgcaaaaactttcctttaccaagaaccatatcggaaaaattggtgtgttcctaattaaaaagacgcactatttattattaggacacaggttggaacttcccttaatggtaaaattaaaaatttaggttaatccgaccaagaagcttttcaaccggatgggaacgaaaaccacacattggttattatccgttgtccgccgatcatcaatgtgacattgtgtcatattggttctaaaaaaagagcataggggctgttgggcaaaacgcgcacaccacactccacgtttcaacaactgtgggcgaataccttcaggtaaatatactgtttgacacatcaccacagggcaaagtatttataagccgtggttatttatatataaacacgtttcaccccaaattattgaggcgggttggttcataacacaaactttttccccccattggaatatgggacgggcaagcgctattccggtttttgaaaccagtgagcgtgccaaaggttcggattacaatagcgggaaaacgcccgcttatctccctttgtaagaggaagacaaaagcccacaacgattgttccgttaaaggaaaagggctcacaggaaatgacccggcccccgtgtggnattatacccccaaggttgggaacaactcacttattgtgcccccccgaaggtcccacacgggtcctttttgtccaagaacaaacttttccgttggactccattatcccaaagagttaacacag

SEQ ID NO: 643402 - DNA, 257 bp, Homo sapiens
attcctttccattccattagagtccataccatttatattccaaggcagtaagttccactgtattcaattcgagtccatgccatataattcgattctattggagttcattcctttcgtttcgaatctaaccttcattgttccattccgtgccaatccacaccatggttacctattctagtccattgccagaccactaagattctattcggtgccattcatcactatcgcatgccagtgtaactacagacccttcacag

SEQ ID NO: 643403 - DNA, 907 bp, Homo sapiens
  misc_feature (376)..(376): n is a, c, g, or t
ttcggcacgaggaaatctttattgctaacgaaggtgtccacactggtcaattcatttacgccggtaagaaggcttctttgaacgtcggtaacgtcttgccattgggttctgtcccagaaggtaccattgtctccaacgttgaagaaaagccaggtgacagaggtgccctagccagagcttccggtaactacgttattatcatcggtcacaacccagacgaaaacaagactagagtcagattaccatccggtgccaagaaggttatctcttctgatgccagaggtgtcatcggtgtcattgccggtggtggtagagttgacaaaccattgttgaaggctggtcatgctttccacaagtacagattgaagagaaactnttggccaaagacccgtggtgttgccatgaatccagttgatcaccctcacggtggtggtaaccatcaacatattggtaaggcttctaccatctctagaggtgctgtttctggtcaaaaggccggtttgattgccgccagaagaactggtttgttacgtggttctcaaaagacccaagattagattatgtaaaatagtcattctttaagcaagatctaaaaaaaaaaaagataactcaaaaaattcctcaaagcaaacaatacaatataacataacacttatttttaaagaaaaatttctaaattagattctgttctgtagtaatagaatatttcttcaaagtaaactttaatatactctcataagctccccccttctcccctgtgaagcattgcttcatggagggggttgacttcttgaataaaatggctttctgccttacgcgtttatagtgattaccgtgttgcgtggctctgatgatgggcatttctaattttaagatcaacaacaataaacacacggtgcagtcaaga

SEQ ID NO: 643404 - DNA, 128 bp, Homo sapiens
ttttaatttaaaaaggggcccccgggggaaccaacgccttttggtttggccggggcataggcccaacctggggggggggcctaaggtggtttgggggtaaataaaaccagcccggttttggttttcca

SEQ ID NO: 643405 - DNA, 409 bp, Homo sapiens
catgctcgagttccagctctagttatcagccttgggaggttttattcatgacttcctctgagttttggcatgtgagagacactcctataagagagagtcaagcctgtgggagtagaatcatctcattcccagagtcagaggagaagagacatgtacctgtgagcatcgtaccttcctctacaagctagaccagagaggtgagagccataaggtaagcgtgggagtagcagattggagctaatggctcacgcaggatccatgacccgactcccataaagctctagacgttgccagagctaccctattctctctcttccgccagtgtcacttcctctaaggatctggattagttgcaccagtctgcattggttaggcatggacgcgtgacatggggtaccagagctcgata

SEQ ID NO: 643406 - DNA, 659 bp, Homo sapiens
ggagattggactgggggccttcgacgcggggctgttgtgggccctggccttttcagctgcggatcagtggtgccttctctttgtggtggtggatgacttccaatgtagcacatgctgtcggtgtgggactgcagccggaggaacatgaacctggctgagatcagagagctacaaatgactcagtcctgggccgttggcttcaaccctcgatgacaggcaggctgcatcgctcaccgagtggtgaaactctcacgtccacgttcttggaattggagtggtggagtaggggttcctgggcaagtgggacccttacccggaaacagggtgtctttgggaaatacaagaaaccgcaggtctatcccttgctttagtgttccttccggatggagacattctcactggagactcagtaggggaacattctcacctgggggcggagcccttcagattccaagacccccaggctaggggtggcgccgattgagacctatggtgattgtggcccaggctcacggctcatgaagggttctatcgttctgccttgtgtctcccggaagggacgggacatgtgctgagtggtggcgggcgggaccgccggttgctacagtgggggcccgggttggtggccctccaggaggctgacatcccgacacttcggg

SEQ ID NO: 643407 - DNA, 99 bp, Homo sapiens
gcggccgcctactactactactgctcgaattcaagcttctaacgatgtacggggacatgttgaaactagtacttttccctttaaaaacaaaccaaaaaa

SEQ ID NO: 643408 - DNA, 146 bp, Homo sapiens
cgctcgtgtcccacatgagtctcgctccgtacttgtctgtacctggggtcgacgacactactgggacatgtggacttttaacaaccggggactcctctacgacgtcgaccctgccggcctgactgcttgagacctggccgtcgttt

SEQ ID NO: 643409 - DNA, 282 bp, Homo sapiens
gtgagaaactaaaggttacaatcctgactgggggagctgcaagacacgtgaggcacactgcccagcaccgtgtactctggagcccccgaaccccatactccctcacctccctcagggcttgtgggaaggccttccgtgtggaccaggatgcacacacatcacctggccacctgcctgcaggaaattctgagcctccctgtctttcaagacctggacacttgagacgcactggccaggactgtggtgagcatccctcagtatgggtgcagcattttctcatga

SEQ ID NO: 643410 - DNA, 261 bp, Homo sapiens
tttgaaaccatccccaaccccacccgcaaccaatgtccatggaaaaattgtcttccacaaaacttgtccctggtgccaaaaaggttgggaactgctgccctaggactcaaagtcagagacctaatgcctgggggaagggagtttgctttccatcctgagaaatcacccttagccatattttgctaatttgacccataatcacccctatgtgttttttttatctttattcagctaacaaagaacttgcttactttgctccta

SEQ ID NO: 643411 - DNA, 192 bp, Homo sapiens
ctagaggatcccctcgctattactcggcacctgcattcggtaccactgcgttcttcatagccccagtcatgcttcgagtgggaccatcaacagaccctgggccctctgcctcttcgtccatctggtccgtcgcttctcgcaagatcgatcacgtagaaggacacaagagctctccatacacgagcatttcct

SEQ ID NO: 643412 - DNA, 246 bp, Homo sapiens
atagtaagagtaatatgtaagtctgagttataaacctgtcatagtatgattaactgctaatgttctgtttctgtatccttgctttcacatcactacactttgtgccactgtaggcttgtttcaagttagcccaccctctttagaagtgtatgtaaaagttaaatgctgtctttgtccttggcccagtctctggatgttaatccactgggtctgagtgcactcaataaaatcctccttttctaccta

SEQ ID NO: 643413 - DNA, 714 bp, Homo sapiens
gtggcacctcttggtttcccctgggatttatttaaacccctttaggggacgccacttgtcccacccctcgagagtttctacccccggaatatggttgaaatgtaaaaagggaaattattgggagtataaaggggagattcccgcgttctttgaaagcccgtttcccctcgtttcccgggttccgggcctccccaagagtgggcccacagggaaaagagaagggggccacatgggttgtggcgccaaaaaaggggcgccccggccacccgtgtcacgccttattttcgctggcacactaaactggtgccccgaattgggtggcccacaaggccacaaggccactctataagaaaattttcgtcacattctgaaaaaataagtgagaggccccaccccgctcacgggaaccattttctgaaagcgaggccgttttctgaaagccataatgggcttctcccacagctgtaatgtgagaagggaacacaataactgtggtgaagattgggcacaatcaccacgccacaagtagtcacggagatcgattctcgtgagagcccgccagggccggacaccccccacccccggtgttagagacccggcgggggctgccccacacgtgtcccccaccccacaggcccactgtaaggggctgagtttttaaagactgaaaaccggctattttttggggaaaaattaaatgggaattgtacttta

SEQ ID NO: 643414 - DNA, 432 bp, Homo sapiens
  misc_feature (26)..(26): n is a, c, g, or t
  misc_feature (32)..(32): n is a, c, g, or t
  misc_feature (42)..(42): n is a, c, g, or t
  misc_feature (62)..(62): n is a, c, g, or t
  misc_feature (64)..(65): n is a, c, g, or t
  misc_feature (70)..(70): n is a, c, g, or t
  misc_feature (83)..(83): n is a, c, g, or t
  misc_feature (93)..(93): n is a, c, g, or t
  misc_feature (119)..(119): n is a, c, g, or t
acatagtgactctccatactagtttngtggcngcccttgctnaattaaaagatcctgtaaangnnttcancattgatctgaanccaataattngagaatcgtctgctgagaaactcagnattaatatttttttgtctttcttccaatgctcatttagctgaataaataaagcacttttacctgtccctcgtctaccaacaacaatggtcctgtcatcagtttcaattagagtcctaaagtcagcagtttcaatgaaagcattactcaacatctttttatcattttctgctgcgtatcaccaaacggattagactttgaagtaatattcaattccatattcaaccttttatgttagctgctttcatttattactttatatactggcgaacgagcaatattcattggttttgatatatgtgaggcacctaaccc

SEQ ID NO: 643415 - DNA, 319 bp, Homo sapiens
caggccgatgaaggcgatgcgagtcatctgcgcgtttcccctatggattttggccgagggttagcgccgcccgtcccgccttcgccagtcaccaatttgagacgagacgcctcagttcggtttgcggaagcggtagacgaactgatccgtcttgccccggatcgcctcgtcgaagacgttcaggctgtgatcgtcggccgggttggcgacggctgtgctctctccgtcgaagacgaaaccggcggcctcgacctccttgcggagctgggcgccctcgatgcggctcaggctttcgaccactgtgttggcggcgcccgcc

SEQ ID NO: 643416 - DNA, 186 bp, Homo sapiens
  misc_feature (62)..(62): n is a, c, g, or t
  misc_feature (105)..(105): n is a, c, g, or t
  misc_feature (118)..(118): n is a, c, g, or t
  misc_feature (149)..(149): n is a, c, g, or t
cgcacgccgcgccgcacagagctctcagcgccgttccagccacagcctccgcgccttggttnagcttcaacatggcaaaaatcttcagccctacagagactgaancggggcatcgagnccctggatgctgctttcaaaagtatgctggnaaaggatgggtttaactcacttttttcaagaaagagt

SEQ ID NO: 643417 - DNA, 154 bp, Homo sapiens
tcagctgtcgagcatggtctggaatggccatccactggctatcgctgacagcgcatgctctgcacctgctctccggcaccacctggtccactatgcccacctgcaggcctccgccggcgggaagagcagccccagctgcagggcacgccgccgc

SEQ ID NO: 643418 - DNA, 777 bp, Homo sapiens
gtctcagcaaggttataatagagccctgtcaggtccacttgcaacatggccttgctacttggattagctccttaagcctggaaataacgttagcctgggtcatggaagaagtggacgcatcttttaacttagtgaaatagaagttgaacttgaaaactacttgtagaaagaagtccgtggtttagcagtgacgagctacataagtgaagtgtctatatataagagtagtagtctgacattggcaatcttgagaatcagattgccaacttcttgactttcaagtgttagacattgtatccttaagtggtgagcgatatatgtagcatgctgtgaaatgtctgttatagctctttaattgatcaggattaatacagaattatcatttgcgtttcttggtactttttatatcaagtgtaatcagaagctgtgatgtttggcttggtagtcctgtgcttagttactgtaattattatagggtttttaagaagagaggtgactggccataatgttaaggacaagatgacaggtgatacttatgagaagcggatagtcatatatacagcgttagaagtctatagggttaaagaattgagaacatccagtccccttgaatcgcaatgtagatacttgggacgcaatttataggagattatacgcagaagttgatggtggtcaaatggggggccatcatatgtggcgcattgttgcaagtgggactctttattaaccatggccttgaagattgtcttgggcagacgcgaacctgctggaagattc

SEQ ID NO: 643419 - DNA, 381 bp, Homo sapiens
cttcaaggcattctttggctggtcctggcggcttctagctttgaagtgtaggtgggcctgctgttctctgggcgttccctgcatcaccagccatcacactcattgcctcttaggctgctctttgggagtcagaggggcccatgagcgggggcagctgaattctcatctagcagggcatctatccactcggctgttgctaaggatgaagacaggaaggttcccaggcaccccttgccttgggacctttagccaccgcatctctgcagggtcagggaggcatctctagctgcctagtaccaaggcttctctgcaagagcaaaggtactatatagataatgctgaggtcagaagctacccatgtataatacagtcacgtgctcc

SEQ ID NO: 643420 - DNA, 113 bp, Homo sapiens
ctgaagggacgtgtacagttacaccacctagacccaccagggccccactggggcaggagcacttgttttgaagagatccagatgatgggggttactcctggacaaagatgctg

SEQ ID NO: 643421 - DNA, 679 bp, Homo sapiens
gtgcagtggtccgatcctcacggaccggcccggtgttcgattcgatatctcgatcatgaatctacctatactatggttacactgacagcagtatgcccgcgtaatcgagtctaagaagttactaagcaaaccgcctgtgaggaatgcagagcagtggagagactagatctttgtgcgattacagtaccgagtggtctctcgtgcaacatacctgtaggtgaccgtattccgtgagtggcgagtgtcactgcattcagttgcatagttagcgcccttcgtaatatcgtagtccgtccagcgtgcgcatggtaaatcttcaatacccaagtgatacgcgacacggggacactcgaagcgagcccgacagcgacatgcacctcaaatgccacacattgtgagagcgctgtcgagagagacaagaagatgacataagtggcccagtgactagttaacgatgtgacagaggagcttgaaccgccatgagatcgtacttatgagttaccttcactgatagtacccttgtaaggtccaatctatttctaactttatgacccatggaaaagacttaagggacatatcctgatacggagaatctttccttttggtgcattgcgactgaacacatataaagagcaaacaaaaagaaagaccacaaagcatatactcattctaaatgagg

SEQ ID NO: 643422 - DNA, 297 bp, Homo sapiens
  misc_feature (167)..(167): n is a, c, g, or t
cccaagcaatgaaagccgctgacactagcgctgtctttcggcaacattttggaagtccttacttttagacacattgtggcgactttttttaaacacaaaagctcctgagggtgaagtgatgtgatagattgtgcagctggaattgctgaacttcaggtgcccctggnttggaggacccccccgtatgacttggtgtgtgcgggattggcatcggtgtgacgttggggtgtgtgctcttggaatggtgcgagatttctcttgcagcccgggcgcggtgacgtaatacgccctatagtg

SEQ ID NO: 643423 - DNA, 337 bp, Homo sapiens
atttaagggatcgggtatgcagtgtattgggcagctggactgttgaacctgggaaaggtgttataggggtgaatgtctgagcctacaggaagttggggatcatagtgatggtgttgggggtcatgagtgggatgtcatcctggggagtgccgcagtgtcagggtgtagtcgggcaatgcatgtgaggcgcagtgttgtcatgtggggggacctggcctcacactctgtggtgggtggggcccacgttgtaattgctgccagttcctcactctggagcagctcccaactccggggccccggttccccgatgagggctaggcttgcgcagtggctccat

SEQ ID NO: 643424 - DNA, 139 bp, Homo sapiens
gaccatgtggtggaacaggtccttgaaacctggagcactaagcaactcagaaagtatacccacaatacgatggattgcgccatagtggtggtgcctggagcggctgtgcccacaagtttctccagattagccaagtagc

SEQ ID NO: 643425 - DNA, 286 bp, Homo sapiens
atgtgagggcgatctggctgctacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagagtatacgagtagctgcgctcccctgctagaacctcccatgctctcacggtccatttgtcggagaacgtaaggtcgtcaagcttccaagactccatccca

SEQ ID NO: 643426 - DNA, 385 bp, Homo sapiens
  misc_feature (20)..(20): n is a, c, g, or t
  misc_feature (50)..(50): n is a, c, g, or t
  misc_feature (82)..(82): n is a, c, g, or t
  misc_feature (96)..(96): n is a, c, g, or t
attggaataacaagttgggnaaaaaaaggcccccggccccccaagtcctnaggttgaacctgtaaatcctgcaaatgttggnagggtggggccccnggtgggaggtggttgggatccatggggggcagatttcccatgaaatggtttaacacccatcctccccggtttgtccctcatgacagtgagtgagttccttgagagaactcatcatttaaaaatgtgtggcacttcctctctttctctctctcctgctctgggtatgtgacatgcctgctccccctttgcctactgccataattcagagtttcctgaggcctcccaagaagataagccgatgccagcaccatgcttcctgtaagctggcagaaccatgagtaaattaaac

SEQ ID NO: 643427 - DNA, 184 bp, Homo sapiens
  misc_feature (32)..(32): n is a, c, g, or t
  misc_feature (56)..(56): n is a, c, g, or t
acgactatcccattacagatcatgcaacaggngctctgacagcagtaacctccatntttactagtaagagacccatgagaaatagggtatttattttgatgctctagttattcttagcaggacttcatgatactgtacatggtatgtgtgcagctacgtgggtctctatcatgatttttccttc

SEQ ID NO: 643428 - DNA, 489 bp, Homo sapiens
atttgggctgtgtgtgcgacgcgggtcggaggggcatgtcggtgggaaccgcgtaagaatgccgagtgagcccggagccccgcgtgacgctcctctctcaggtccaaaagacggcttttggttcgcgcgcagagagacccgggggtctagcttttcctcgaatagatgcgccgccctgcccttggccccgataacagacaaagagcaccgcagggcctgatcactgctgtggggctggctgatggctcgagccatggctcactggaaggtggtgcaccgctgtgatcgctggtagtgccgtgctgggcgctgctgtggggagcgagcggcgcaatgcctgctgctggactgccgctccttcttcgctttcacagcgccggcctacatcgccggctcttgtcaatcgtgcgcttcatgcaccactcgtgcggcggccgggcgaaggtgcgccatgggcctggagcacatcgtgcccaacgccgagctcct

SEQ ID NO: 643429 - DNA, 409 bp, Homo sapiens
gtagagatggggtttcaccatgttgtccaggctggtctcaaagtcctgacctcaagcgatccacccaccttagactgcactacgaggagctcccggcacaggaagagcctccagagccccccttgcagatcggcatctgcttaaggtacatggagctgatggtgaaattgaagcaaaatgaggccttccctggccccaaggggggtcccccagccccctgggtggggggggatggcaatttattccctatccttaggggttaggggtttccccccctgggttagatttacccgtgaagattcattaaaagaaatttcgcccccctgggtaatcttttactttgccactttagggggaatgacccggaaaatattttttttccttttgggaaaacacatattccccgcgg

SEQ ID NO: 643430 - DNA, 131 bp, Homo sapiens
atactctactcctgtgcccattttagcaccacaagcgacagtactctgaatttactgatgagtccagcatttctcatgcttcagtccgagatggatctgggagttatttcccaggaactagagctttgcca

SEQ ID NO: 643431 - DNA, 493 bp, Homo sapiens
  misc_feature (493)..(493): n is a, c, g, or t
cgtgggcagcagtcattatatggcaatggttcagcaccatgcagtattgcgatagaaaggtacaaattaaatagaactttattgaatttaacaaaagactcaatgtgaatgctagcactttcagaacacatgactgggtatttttctacatatacatatgctccatcagtcctgcttttaattttttactttcttttttctttttgttttttgagacggactctcactttgtcgccaggctggagtgcagtggtgcgatcttggctcactgtaaactccacctcctgggttcaagcgattctcctggctcagcctcccgagtagcttgaattagagagtgggttcggggtggtgagagtgagagagaaggaggaagaggctgaggggtgtcacattattataacttactttggtggtttcaggtccctgtgaattagcgctttgggttgcatgctgtgaagataagccactccttgggaacactgtaaacacn

SEQ ID NO: 643432 - DNA, 164 bp, Homo sapiens
  misc_feature (139)..(140): n is a, c, g, or t
atagtggtcatgcacgccggtatgtagggttgtacggtagaactgtattattcatcctatgtgggtaattgaggagtatgctaagatttgcgtagctgggttaggtttaatccacctcaactgcctgctatgatggatnngatgagagagtgaggagaaggctt

SEQ ID NO: 643433 - DNA, 119 bp, Homo sapiens
atcccctcccaggatgagaaattgctctaaggatagaaactctcccattaacaacttgagcttcctgacaatttctaggttggttttaatgggaaaatccataccagaaagatttgtca

SEQ ID NO: 643434 - DNA, 335 bp, Homo sapiens
tttaaaataaaaggcctttttcccctttttggggaagccccttttgtttttgggcatttttaacaaatttttccccttggggtttttggggggggtagggcccgtttttgggggcccccccccccttttttttttccgggggggggcctttttgggggggggatttaaaaaaaaacccagggttttttttttttgttccctaaaggggggagcccccctctcttcccgggcccccccttttgggggggggcccttccccttttttttcccccccccgggggggtttttttgggggggtttcccccgggatttaaaaaggcccctttctgggggga

SEQ ID NO: 643435 - DNA, 744 bp, Homo sapiens
ggcttccataccccgtttgcggggtccaagggtctcctggaggaggagatgacttctggtgcacagtcaaaccaagatgtgtgctccccagtagctgacttgtgatgctgtccggcccctctgctattcacccctagtctgcccatgtacaccatgcagcatgaggcgacagccactgcaggctgtcagccttgtccttttgctgtctgatgtctgtgtcaagagtgaatgagattgataaaaccacggagagcagtgatgcctggtgaaacacaagttcaggcctgacccatgctcacactagaggaagctaggatgcctagcctgaacaactgaagggtgcagacacccacgaaggcgtggattatcgtaaatcaactcagtgcaccttggcgctggtgcacgtaattggacaaaagaattgaaggaaattgcagaagcctaaccttgaggaaagaactgttaccaatgctagatggtcacagtgccatgtcttacttgaggtgactctcagcgtcaaggctaccaaaggatgctggaactattgctggtctcaatgtacttagaattattaatgagccaagctgctgctgctattgcttaccggcttagcaccaaaaaggtcggagcagaaagaaacgtgctcaatcctgatggaactgggagggtggcacttttgatgtgtcaaatcctcactattgaggatggaatcttcgcaggtcaaggtctacagctggagaaccc

SEQ ID NO: 643436 - DNA, 478 bp, Homo sapiens
tcggatgcaaaggtcagggtaaaactctaaaaggttaatttctggtcaaatgcaggtagatgatgagagaaaggtgggtattatcaggaaatgttttctgtaagctattcctttctcttagagcctgccatgcctcaccaaatggggcatttaattcatctttaaactggtcgttctgttagatcgctaacttagtaagtgcttttcttatagaaccccttctgactgagcaatatgcctccttgtattataaaatctttctgataatgcattagaaggttttttggtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacacttggcatccagag

SEQ ID NO: 643437 - DNA, 309 bp, Homo sapiens
  misc_feature (203)..(204): n is a, c, g, or t
  misc_feature (234)..(234): n is a, c, g, or t
ctttttgggggaatgggccccttttttctccacacccgggcccctaagcagcagtgtacgccacgacccctcggtgggaggtcggcctgcgctggtgccgcagatgcctaaggctggcggcctttgattggcccacgctttgcccttgccacgcccctctgcgctgggattggcttagtgctggattcccacccacccacagnnccccatggcgtctcagctccagaaccgacncctccgcactggccttggtcacaggttgagggggttctttccccgggcggtttggggtattggagtgaggtacag

SEQ ID NO: 643438 - DNA, 925 bp, Homo sapiens
tattcctccatttaaccttcattatttaacctatcaagatttttaataaactcatatgttactccaatttattcatcaatcaaatttatagggtgctactgtatgtatgaaatacaagtgattataacgcacagaatactctactaatcctttattgccgtctatagtctacatcaccgtctatgacagttctttccattcacatggactatgctatgtgtgcttaagtgtgtataatgttcacgttgtctagtgtgaagtatgccttcagtgtatggggctaactggtgtgtgtgtgtgtgtgtgtgtgtgtgttacgtgtgaacaaatctctctatggctgaatcgcggtatttatcacatcgtaggatatagggtcgtgctgatggcttatataaaatcatcaattagagccttcctaatttataccacatcattatatccattatcatgcattatttgtagacaattggtgactcaatccccagatccttgttctgactgcaagaagctagtgcacgcgagaacatactctacatctcgccattttcaagaaataccatttatttttacaacgactgacgcagattatttcctattctttaagacacttgacttatgctcaattttacaaatcacctggtatcagaaggttataccggagggccttcacttgcgagccactcaatgcctagtttggcatcagggcaatagttcatacgcaagggctgcaggaggcatacaagaggtactctatcaaggcacccaagttacaggttgtgaatcacaacgacacagtgtacaacacgctacccaagagacatgccacacacacaccccaccacagtgctaagcgaagatggccacagcaggacaaaacacttatcttcgttctgtctctccttagtatattagggaccagagg

SEQ ID NO: 643439 - DNA, 114 bp, Homo sapiens
gtgaaaaggatgtgatgtttctgattgagggctccgagggtgtgcggagtggcttccccctgctaaaggagtttgtgcagagggtagtggagacgctggacgtaggtctaacgg

SEQ ID NO: 643440 - DNA, 93 bp, Homo sapiens
gccagcaccaaccagacatctatgtacctctgtgccagctgctacgtgtggggttatgagcagttcttcgggccagggacacggctcaccgtg

SEQ ID NO: 643441 - DNA, 1601 bp, Homo sapiens
ccgctcttctgctgctgttatgtctacttcctcctgcttccccgaccgccgcacgcacgacatcatgaggtgaaatctgtgcacttgcatggcctgggcatgtgctggcaaccaaactcggcagccaatgtttttggtgactggtgatcagctgatgagcactggcatctgaccccacagggcacctaccactgtgggcacagcagaccatgcaagcatggcaactgcatcgaacgatgtactcacaatgtcatgtgccacctgtgctggcaaagtactgtagccccagctgcctgttgctctgtgtgatcttgtgagccccggacacccaatgggaacatccacagaggcagcactcagagggggcaccctactcgcggggccgaccaatcacttcacccggagagacaggaacaacacaataacaaacgacacaagaagccaacacacagagcgctgactagacagagcacaaacactgggagtgcaaacggagaacataccgaataacatacaccacgacgcaaacgaggaagcccgaagcgaaggaagtgaggaacagcgcaacgaccgggaatcggcaatgtgacagtgcgtccggactgcaccgcacacaaagggaaagaagacaatgcagacaacggccgcaggccggacaccagtagggccgctgaacaaaaggggccatctcaacccaaccagactctgcaccctcccgacaaattaccctacattgtaggacgacttcgtataaacagtgatcgacaagctaggtctagctttctatcttgcagacaaatggcgggtgttaccacccacttctccatacctaattccacgagacaacacgcaactaccccatgagggccaacaacggccgagtatagcgccccaaagcaacaagaggtggcactcccacaatgtaacaaccccaccacgtcttctataaacagagattgaatgcgcacgtgacccccttatcacagcacaccccaaacagatagactggtcgcacacagcacgccacacgcacgagcatggacgattgatagaatcgccccaccaataacccaaccagacatggccccaaacacccgcccttaccattacacaacgcacacacactacccacaagagcatccagcagcaacaccacaacaacccaacacgacccacgaacacaagcgacacgacgcacccattcaccaacgagggcgcaagtcacgcgcgaagcacaatccgagcaacacaccatacaacgccttaaccacaaaacagactcagcagagacagtatccacaagacgacaaccaccgctaaacgcaagcactagtgataaccaccaacgagcccaccgcaacacccgactaacatgtgcgactgacgacaacacatacgatcacaacaccacacacactggagatcgcaggcgaaggaaacgaacaaccaccagttacagaatgggtaggagctaacaaccaacaaccgagctacccaccaggcacacatcgagtacacagagcgggcgacaagaaccaccaaacgcggatggaccacgagcgacgagacaagaccaggcgccgcagcgaacaacgctaggg

SEQ ID NO: 643442 - DNA, 433 bp, Homo sapiens
tgtcacaacgttctagggcaaaaaaggtttcgtagacaaagtcataccttttaataaataaatgtctaagctaagatagtcatatcacgtttacaactagtgcttagtcacacataacttttaacacacacatcacagttttgcacaaaatcacatttacattcacacagtagttgttttcgacataattttttaaaattacaaaacaaaaaaatcaaacccattcctaaaatcgattaaaccacaaacatactagcacgcatccccacaaataacctgtcccagtccagttcaaaatatttcattcatgtgcagaatgccacacattttagagtgttcagcagtatctctttcaaagtgctttctattatgttggtgggtaaatcgattttaggcactgggttgattttttggttggtaattttccaaaatt

SEQ ID NO: 643443 - DNA, 815 bp, Homo sapiens
gctgacgaggaggagccatgtactgaggaggactgggagcgcctgcgtcagtgccctgcagggttatgcgcactttacagactatggctgtgatggcgatgagtgacgacgggtagtgaagtgtgtcctccagtgtacgtgatgtcctggcagggctgcctcgcgcgagtctccgtcagcactcaggacgggcttccagggaccgctaacacgtgcagtgccccatgcgccagagactccgtggtagacagggtggcaccttgtcctacagccctcgtcccatgtggaagttaccacttggtcattgtgttgctattcagcacatgggaaatctggaccaagcgtctgcatgtgtgtgatcagatgtgggccgggtgttgttgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcatgcactcggcgccagcagcctctgccagagtggaagccagagccctgcaggtgtccggcgcagccgtgggagctgaggatctggcacttgagaggcagcagcatcctttgaaggtcctctgcctccagcttgtggccctgcatccagataccttgcctcgtccgaggcagaacaccccctatcccttgaatctccaaaaacccactacacaggtgattgcaacggattg

SEQ ID NO: 643444 - DNA, 514 bp, Homo sapiens
  misc_feature (13)..(13): n is a, c, g, or t
  misc_feature (22)..(22): n is a, c, g, or t
  misc_feature (60)..(60): n is a, c, g, or t
  misc_feature (258)..(258): n is a, c, g, or t
  misc_feature (260)..(260): n is a, c, g, or t
  misc_feature (262)..(263): n is a, c, g, or t
  misc_feature (283)..(283): n is a, c, g, or t
  misc_feature (285)..(285): n is a, c, g, or t
  misc_feature (287)..(287): n is a, c, g, or t
  misc_feature (297)..(297): n is a, c, g, or t
  misc_feature (304)..(304): n is a, c, g, or t
  misc_feature (313)..(313): n is a, c, g, or t
  misc_feature (385)..(385): n is a, c, g, or t
tgggggaggagcnaagcccttnaacccaaaaggggcaggtgggggcttggttgctgaccnggccccaagtcccccacagagcaccttctgtagctccagcttgtctcccctggcttctctttgaaggagaaaaatgtaaaatatgcactgagaaagccagccccgcctgcttagtcagccccggcagcagggcagccatgggaactcaggaaaagcaggaaccctttccaaaaagcccagagatccccggggctaaanantnnaaatccccccggaatttgtnananagggggccanaaaaagnccctaggcntccctgttgcctcccccagatgcatgtgatggcatcaccattccccaaattgaatatcagcatgcggcctgnccagggactctttagatgcatgaatttatttatatgaaggctctcacagagacacacacagcacttcagtagcatttgcattcctggttaaagaatcaccaatatttaaaataaaaactttcctgaaaa

SEQ ID NO: 643445 - DNA, 1532 bp, Homo sapiens
  misc_feature (320)..(320): n is a, c, g, or t
  misc_feature (601)..(601): n is a, c, g, or t
gttcactcattccttgcgtaccctcgtaacaggtagctattccaggctacatatacttagcaacgaattacgactctgaggtaaccttccatacatacatgtcatatctagcagtttccaaacacatgtccccatagactgaacctcctcacttgcgtgaacagtaatctcactaaatctctttgaactgattctatctgtatatgctacacgatcactacatcattcctcatctccccacgtgcctcaacttatggtctcttcctcaccaggcctatccagtgtgtcactctattgagtcaatctactaaggtcaacantacgcagatgtctggggccttttgagataggttgatcattactatctcattctcacgcgtactgaataggaaatgtacgtaatgacatcacctcgtgcatttttggaatgtgagaactcggttcgactcgatccagaagagaagtacttactcataaggttgaactgttgacctatgaatcggtgtagacaactcctaacttatgcctcatatgcatacacaggggctagcgaggagtgtgtgggttagtaccaatatgaaagctgctagccctctcccangatgacaaacagcgttggactttgcattctaaaaagcctagttgcgagcccgttgaaaccatcgtcatcgtagagcacactagtcgtcttactaatctcctaagtggggactctagagtgggttgcccttatgactatcgatcttgtgggggaaatctagattgttgggaagtccgtgactcccattccccctgtatttccaaggacgtacacacgattcaacttctaggggccagacacttcaatgataaagggccccacctaatatggctgcctagtacactcttgaaacagatccgaggggtatctaaccggatccttgtccggcaaagctataactaatagttttaagcgaatagtttttagataaaatcaaccataaaacatttgggaacgtggggtggaaatttaacaattgggcgcgctcttaaggaaaggccgggacaaattttgttaaccttagtgtccctggcatttccatgggcgaaaggagtaatgatttccaaattaagaagcgatgtgcgggacaataacaaatgtgttttgcgccaagagggcaaagcgggtccaatcggacaggcgattggacaatcccccgtatatcaagcacaacgtctgggggagcgcctcgggggaaaagaacaccgaatcgcagagggcagcgcggggaccacttgcgggaaaagttccctttcagagattcttgtgggcgaagaggcccagaaaacgaacatttacccgccggggagagatggcacaacggggaactgcggtgcccccggagatgaaccaactctgcttgaccgcggtctcatcccaacgagagagagacacactcgtcagcacacacgatgtcgttgtcaaccagcagccgggatgctatcctcctttctaggacgcaccacagcggtcgtcgaccacacgggcgcac

SEQ ID NO: 643446 - DNA, 489 bp, Homo sapiens
  misc_feature (67)..(67): n is a, c, g, or t
  misc_feature (70)..(70): n is a, c, g, or t
  misc_feature (72)..(72): n is a, c, g, or t
  misc_feature (141)..(141): n is a, c, g, or t
  misc_feature (143)..(143): n is a, c, g, or t
  misc_feature (146)..(146): n is a, c, g, or t
  misc_feature (266)..(266): n is a, c, g, or t
  misc_feature (291)..(291): n is a, c, g, or t
  misc_feature (392)..(392): n is a, c, g, or t
gttaacctggggtcaaatgcacggattctcacctcgtacagttacgctctcccgcggcacgtccganggntntggaaggtcctgagcgctcaagtttgtccgtagtcgagagaaggccatggaggtgccgccaccggcgcngngantttctctgtagagcattgtgcctatttccccgagtctttgctgccgaagctgtgactgccgattcggaagtccttgaggagcgtcagaagcggcttccctacgtcccagagccctattanccggaatctggatggggaccgcctncgggagcttgtttggcaaagatgaacagcagagaatttcaaaggacctttgctaattatcttgtaaagacgggcagcttacagcagggcattcatttgggntggggtgtattggggggaataaccagctttttatttcatgttaaaacaacaatacattgagcagagccagggcagaatttatcattaaccgttttat

SEQ ID NO: 643447 - DNA, 254 bp, Homo sapiens
gctgtgtcttgaggatccccgagatgggtccctgccgattacgaagataataaaaacgaacaggatttgagtgtggctgccaattaagaaggccgaaaaccagacaactctggctcttacaagacagtttttggccagtgtgtagaaggctgatgtccttgctccttttaaaagtagcagctttgttgagatgcagtttgacacaccagtggggttcgcccgtttgaattgtgcagtgcagggcccactcgggt

SEQ ID NO: 643448 - DNA, 291 bp, Homo sapiens
ttggggggggggtggggtcccgtttgaagacccaactggttttgcttttaaaacagggctgtccctgttgggggcccggcccccggggggggggttttttttgggtttttccttccaaggggggggggttccgggtttttggtgatccgggaaaaaaaaaacgggcccggcggggggcccccctaaggttggggtctccggggggggtttccctccccccccccccgggggggcctttttttcgttgggggttgggaatggttcttttattaacccccctgttttgtttca

SEQ ID NO: 643449 - DNA, 2406 bp, Homo sapiens
  misc_feature (83)..(83): n is a, c, g, or t
ctttggggtcttttgctcatgttggagatcttgagcctcaaggtgcttgcttcagaattttgctgattctccctctccagacntattctgttcttgggacccaagcttcttggctccagcccactcccccactagaggagctggaaagtttggtgctgtggtcataccaaagatgggcaacacccagactcctcacccttttccccagcacattgtgagcgccatattcagagcctgcagacccgagtgttagagctacagcaacaattagccgtggctgtggctgccgaccgcaagaaagataccatgattgaacaactggacaagaccctggcccgtgtggtggagggctggaaccggcatgaggctgagcggacagaggttctcaggggacttcaagaggaacaccaggcagcagagctcaccagaagcaagcagcaggagacagtaacccgcctggaacaaagcctttctgaggccatggaggccctgaatcgtgagcaggaaagtgccagactgcagcaacgggaaagagagacactggaggaggaaaggcaagctctgactctgaggttggaggcagaacagcagcggtgctgtgtcctgcaggaagagcgggatgcagctcgggctgggcaactgagtgagcatcgagagttggagactcttcgggctgccctagaagaagaacggcagacctgggcccagcaagagcaccagcttaaggaacactaccaggcgctgcaggaggagagccaggctcagctggaaagggagaaggagaagagccagagggaagcccaggccgcctgggagacccagcaccagttggcattggtgcagtctgaggtgcggcggctggaaggagagctggatacagctcggagagagagagatgccctgcagctggaaatgagcttggtgcaggcccggtatgaaagccagcggatccagctggagtcggagctggctgtgcagctggagcagcgggtgacagagcggctggcgcaggctcaggagagcagcctacggcaagcagcctccctcagggaacatcacaggaagcagctgcaggacctgagtggacagcaccagcaggagctggccagtcagctagctcagttcaaggtggaaatggcagaacgagaggaacggcaacagcaggtggctgaggactacgagctcagactggcccgggagcaagcgcgagtgtgcgaactgcagagtgggaaccagcagctggaggagcagcgggtggagctggtggaaagactgcaggccatgctgcaggcccactgggatgaggccaaccagctgctcagcaccactctcccgccgcccaaccctcaagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgtaaaaaaaaaaa

SEQ ID NO: 643450 - DNA, 205 bp, Homo sapiens
gtgcttctccagttctcttgctgtaacagggatgcccgttactcagtgcaggcggacacggcattggtcaagacaccctgcttcatggggacacttgtttgtcgttcccaccactgattcggaccacagtacccttccattcttcacccagtgcgtcagcggccacttctgtggccatacgcttctcagagaaagtacggttgca

SEQ ID NO: 643451 - DNA, 243 bp, Homo sapiens
cgactgagttaatatttccgctagtaacttgatctatacataagtatacatgtatatatacacataaacacatatcaaattacctttagaagttcaaagtaagctgccctggatcatacacttttgttggagtagcactttatagtgagtaaagtgacatctatgcaaaggcattcacatctcacctatgaacttaatcttgctaattaaccctactttatttagcctgataaactgggtgat

SEQ ID NO: 643452 - DNA, 1476 bp, Homo sapiens
ggcgggaggctgccaacggttttgagcgtagggggaggcgtgagagggggatctcaggggaggaggtcaatcgcttgccccccactttggcaaattggggactgaggactggaagggtggagagtaggcggaaccaggtggtcgtcggggcagaggatctcgggctaggcttgagggcggcgtgcttcttagggacgacttagggcgtgactgagggttcacaaggtttcttttggggtggtcgggagggagagattctagggaacaaggaagctcgctatggctttcttgccaggaggggtcgaagggaaagtacaagggagctgaccctgggtagaacgggtgaagggatgggggagcgtgaggttccgccctctcttgagactggaaccaattgagggactagtagggcagggggacagaaattgggctcctagtggatttgggtccgtttccgttgggacgttttgggtgtgagaacttaagagctcagttgaccggggatagcctgtgccggagttgatctgcagcttccagcactcgtagtcgggaagaggagcttcagcagcgctgttgtcccacagtaggtcttctgtccgcacccgctctgcgctgcaccctcttaacgctgttcccaggagctggggaaagggatgcttttgcccactcccatggcccctggaactggtggaaacctttcctctaaccagaaagcctcgatatccttaattcaccaaggatccttggcgtggagtcttcctcccttctcccaagtctttctccgtgaacttttcctcctggactttgctaaagcagaacctcccagctctttgctgtctccggttgtctcttccctgtattcatggcaacatcagctgacagccccagttcacccctcggggcggaggatctcctgagtgattcatcagaaccccctgggctcaaccaagtgtcgtctgaagtgacctcccagctctatgcttctttgcgcctcagccggcaggcggaggccacggcccgagcccagctgtatttaccctccacctccccgcctcatgaagggttagacggcttcgcccaagaattgagtcgaagcttgtcagtcggattggaaaagaacttgaagaaaaaggatggttctaagcatatctttgagatggaaagtgttcggggtcagctccagaccatgctccaaacctcacgtgatacagcctatcgggatcctctcattcctggcgctggctcagagagacgggaagaggactcctttgacagtgatagcacagccaccttgctcaacacccggcccctgcaagacttgtctccatctagctcagcccaagccctggaggagctgtttccccgctacaccagccttcggccagggcctccactcaatcccccctaccctctctcctctttgttctctcattgttgttattttaataaatgctcattagtctgtaaaaaaaaaaa

SEQ ID NO: 643453 - DNA, 440 bp, Homo sapiens
tctgggtactctagaggatctcaaattgaggtctgggtgggcgctgtaatccagctacttggaaggctgatctcgaactcttgactacagtgatccaccttccttgtgctacccaagtgctggaattacaggcatgagccaccgcacccagcctcctttttctttagtttcttgcttgcttctgcactcttcttttttgtgtgtgtaaatactgaatcatgcatattcttttctttttttattttcccgttggctaggtctatgctgttggcatccagggcattgttttgtcctccctgataatgctcgggatccagggtctcctaatttgtggggaggcaggctgcccattggaacggtttatagtgtgtttcccatccctggctcttaaatctttgtaggcatacttctccgctttcccacaacccggacctcatttt

SEQ ID NO: 643454 - DNA, 1359 bp, Homo sapiens
  misc_feature (608)..(608): n is a, c, g, or t
ttctaccgctttcgccgcacatgggtaacaacgctgtttccccagaattgctaagttggcgataggtaagggggccccttggacctactctagcaggacgctctcgtcatatgccaagatagtcttacagcggctctcggtataggtagaccactccttgagtctgcgtgctgaacagggtgcctgccaagttgggagcactatttgtgcgtaaacgcgtcctctgggggcagaaaaaaatagggactagtagtgggctcttaagtctggtcagtttcctcagaagttaatccataccacattcaacttggtaacccgctcacttaaagtgacctgctcctaagggagtcccccctcgagataaggcctaaatgccagtgtggatcactcctggagaattcttgggccttgtacttaaattcttggcctggggtattgcgtcggaaatatgtggcggcgattcgacccaagatttggggacttgatgaaccttgcccgttgccttgggaagctcataccttacactattacagcgcagggggcatcaccccgtaacattatgccttctgtatttctcatagaacggcacacttgcatcaactcgtagnttatgcaacgccactgcatcatggagtgcactgttgtgaattcgtcgggcattgcgctctttcagtcccaagatattgggtggggcacaaaaagggtgaattggcatggctcccttattgtttgagacatacgggttttgtcgctcggagaatctttattcgaggattggcaaactcgcgcactggtgagaagttggtgagccaccttgtggttccattcgggtccattatgatgcctctcgtctaattggaggaatcctcaatgctcttcatgtacctagcctttacgcgaactcgctgagacatcggttgacctacttacgtggtaacgtccagttggccaatagataacggatggacttagctctctttcgtacagacaatggttccttcatgtatcgactacgccagaacagtacatgcaatgcgttgcaggaacgatatcagcgcaagtgtaatggagattcaaaaaagtatgatctccaattaatcttcgatgactcgagtatactatcagtggatacgaggtataactatatatgtagtgcgagtatgcaatctactgcgtgggcaagctcggatggcaatcacgaaacgataagtgaacgtgagctcagcttctggcttctctgctagcatcaaatatcttgtttaatggggcagatatgcattgaatagttagtacaagcagctttcgttgaagtatgtagaagataagaaacatgtcatcatattaatatcgttccggtaa

SEQ ID NO: 643455 - DNA, 1285 bp, Homo sapiens
tataaaacgccaggcgtttttaaacactcgacgtgccagctaacctactacactggctccataccgcgctacgctgatgtgccctgcgtcgctgtgctgacactttctgtgccaccgcatgtgcacgcagcgggtggagctggtggaaagactgcaggccatgctgcaggcccactgggatgaggccaaccagctgctcagcaccactctcccgccgcccaaccctcaagctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgtaaaaaaaaaaa

SEQ ID NO: 643456 - DNA, 1453 bp, Homo sapiens
ctcatctcaaaaaaagaaaaagaagaaaaaattaggatattttaattttaattttatttatttatatacttatcatttatttatttgagacaaggtctcactctgttgcccagagcgctcaagcaatcttccttcctcagcttcctgagtagctgggactacacacacgtgccattgcccccagctaatttttaaattttttgtagagatggcatctctctatgttgccaagcctggttcaaactgccagcctcaaacggtcctcccaaagtgttgggattacaggtgtgagccactgcatccggaaatttataatcttattaaagtgtttgtaccatgtcttatctctttaaacctactgtgctttgacccttctttctgcctctctcctggtcaggctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacagctggggccttctctgcacttggggccttccatcccgatcatagggcagaaaggccattccctgaggaagatcctggacctgacggggagggcctcctaaagcaagggctgccgcctgctcagctggagggcctcaagaattttttgcaccagttgctggagacagtgccccagaacaatgagaacccttctgtcgacctgttgccccctaagtctggtcctctgactgtcccatcttgggaggaagcccctcaagtgccacgtattccaccgcctgtccacaaaaccaaagttcccttagccatggcatccagtcttttccgggtccctgagcctccctcctcccattcacaaggcagtggtcccagcagtggttccccagagagaggtggagatgggcttacattcccaaggcagctgatggaggtgtctcaactgttgcgactctaccaggctcggggctggggggctctgcctgctgaggatctcctgctctacctgaagaggctggaacacagcgggactgatggccgaggggataatgtccccagaaggaacacagactcccgcttgggtgagatcccccggaaagagattccctcccaggctgtccctcgccgccttgctacagcccccaagactgaaaaacctcccgcacggaagaaaagtgggcaccctgccccgagtagcatgaggagccgggggggagtctggagatgagcccccctaccctctctcctctttgttctctcattgttgttattttaataaatgctcattagtctgtaaaaaaaaaaa

SEQ ID NO: 643457 - DNA, 294 bp, Homo sapiens
agtattacatataaatatccaaaaagtatctcttacgtatcaacacaaaacgtataagtcattcctaactaatagagctttatagcattttcctagacaggaaggggaaaaagagttagcatttaaaagtccggaacgcttattcgtgggttaattacattagacggtttgacttagtccaactaccttcttaataaaacatggataaaagtattacatgggtccactgttataccagacaacatgtggcaaattaaattctggtatcatgttatccaacacagctcagaaaac

SEQ ID NO: 643458 - DNA, 254 bp, Homo sapiens
aaacaccgcatctccttcaatgcctagtttatagagggtgtttttttttaacatgaagagaagtcaattttattggaagccttttctgtgtctgtaagatgatcttgtggttttgtttttaattctgcttatgtgatgaatcacatttattgatttgcatatgttgacccaactttgcatcccagaaataaagcctacttggtcatagtggattagctttttgacatacggctagattcagattgcggtgtttg

SEQ ID NO: 643459 - DNA, 778 bp, Homo sapiens
  misc_feature (603)..(603): n is a, c, g, or t
agcggagcctgtcccgggccgcgagcgcttccagtcgggttacttctggtgggacatagaaagggcgaaccggtctgaacggtcgagacgctttttccctgctacggtctttgccccggagtctgagcaggaggcagtcaaggtcgtgagcttgagtctcgagtggtcccttgaccgtgtggtccacggggggcgagcggtcaagacctccacgcccggcagctcgcgtgggagcaggcaagcacggtctggggctctcctgggtacgcgcgagacgacgccgatgacgactcggctggccatcactcctcacgcagggctggtgcagtctgactgagccccatggtcgcactcaggttaaaggccggcaagcattccagcgcgccggagtcagcaccctggtcctggtcaatgtccgggtgccttccatgacgccgtcccacaaaggcagcactgggtgtcccctcggcacgtacaccttcagcgcgggcgaacgtcgctttcgtacagtaggcccgatcaggaagtgctcgtggacagtagggacagcggcagccaccgggactccggcacgaggcctagcggacattggcggtggtcacnagggtacagaccgagcggatcgacacactggaaggatatcagccggcacgtgccgcgtggcaggaatgcccggacgcgccgcaaatgggcacgagggtgctggggaggcttaggacaggatgacgaaaagggctgaggaagaacgcaagggacatgccgggccggcagacggggc

SEQ ID NO: 643460 - DNA, 105 bp, Homo sapiens
attgcatccaaagggagaagacaaagcgggcgccggcatacgccatggagagggtggcagagcctgctccggctttagccttgtaccacctccgtaccttggtac

SEQ ID NO: 643461 - DNA, 1159 bp, Homo sapiens
  misc_feature (836)..(836): n is a, c, g, or t
cgagacaccggtggcggacatagagacccggcggttttatactcccgagtttttattattgtccgcgggggtgatacatttgtaacgagggagacctttgtcccctttggccttttgggagcgcccctgttagaaaccgggggcgacacgagaacgcgcctggtgtatccgtttcgggtttttcccgggattttgcggaaccacccggctttccgaggggtttttgtacttttttgggagagtaggcccccccctttttaaaacaatgaggtgcccagagaaaaaaacaaccttttggggggggacacccccacaaggggggctccccaaacttttttttaagggtttttcggaagggttaagaatacagtgtttacccggttttatggggtgccacaccacgcgagtttttatagggcggaggaggttgcgcacacacttgttcccccttcttattgtgtgagaattgtgcggatgttaaccacacccctaatatatttttaagaagggggctcggggggaaacaactctccacctctcctcgagaagattaagaaaataaagaagagggggtgttttttaaatatcccccccgctataattctcctagtatttgtggagaggggttatatatatatttgtgcgggagtgattctcaacccgggtgtaaaggtgtagaaaataatatttgtcgcgcccctctctctgaagcgccacccctcgccacacatagcgttgtgagagaggttatgcgcactcttttgtccccctgcgaggccacgcgcgcggagagagtttattctccgtgtgggtataaaaatacattctcttgtggntccctctctctttgagagaacaaggccgcattgtctcacacacaatttttttttctcccgcggaggcgacacacacactctctgggagagtactcacgcgggggtaaaacccacaatatgcaagtgttttgtgcaaaaatttttcccacagaggtgtttttttttgtgagaacaaaatatacacagcgtgtggggtaccattataccacacatatataataggttaaaagagatattaacaaacacccacccaaggccccccctttcccaggggtttaccccctttatatcccccccaataacccttgtgtatcacggtgtta

SEQ ID NO: 643462 - DNA, 184 bp, Homo sapiens
atcttttaaggggccatcttgttggtgctaagagaatgttgctctttatggttgagcgggtggtttctgctgagggggagattggattgatgcataatgtggatacacaaggcacagtgaatgagggagaggaagccaaagggaagagaaaagtttatgtttaaatttttctcgtcttgccatc

SEQ ID NO: 643463 - DNA, 131 bp, Homo sapiens
aaagctccttccctgaagatggagcggtatgaagcgagaggccactgcagacgacctcatcaatgttgtggaggagctaactcggatccattagccaatggcagtggtgtgccccatttgctgaccattcc

SEQ ID NO: 643464 - DNA, 794 bp, Homo sapiens
  misc_feature (378)..(378): n is a, c, g, or t
gtatgaacctaatcctcattaccatgaaaatgctgtcatacagaaatgttcaactgtagaggacagttgtatttcttcttcagcctagtgaaatggagagtggtgcacaagaactcttctggccaaggcccgttgtaaattaaagaagatggctaaacaaaagaactatttgggccattaaggcttgggcttaaaacattgtggggaacttttttccccccaaagaaaatggttttccccccccctttttggggggggccgggaccccaaaagggggggacacgacaaaggtggaccctcgtttaatacatgacgaaaccaatattgcagttgtacaaatacaggtgtggaacacaacaaattaacatcattacctgncgaagctggacacacacttgggacccgggaaaacaacaacaccgtttttttctcttcccccccaagacaccaaacaccgtgtttttttataactaaaccacacccaaaaacggcgtgcgggcggcgcgacaacaaactgcggggccaaacaaaaaaacgttttccccctctttaaaaagacaccccgacaaaaatgtttcttattccctcccaggccccccctagccaccccctgtaaaaaacacatcgcgtggggtggcacacacaaacacggcgtttttcggggggccttggggaaatttaaggcggacccttaaaaaacagttggaagaaatggggctcttaacaaaggaatggaaacgttctaacgttccagcaacatcaataccagatggcttaatgcaagaaatcaggat

SEQ ID NO: 643465 - DNA, 862 bp, Homo sapiens
gagggctgaaccatcctgtcgtgtcttgtcggctcggcggaaatgcccagccggagggacgcgacacagaggacatctctgtgctgatccccaccgataattctatcccacatcaaggcaggtattctataggacagtcaagagttacatggaaataatagaactttggtggatggattgaacatgttctagatcctgtatggaaggtaattaggaatgggtattataggggccattaatcagaatcaggagatatatttccttttcttgtctatgaatacagaacaagataggtgccgtgctcttgaatagactaggcaagtagtagtcgggatgatgctgacacaaagaaagtgaactacgcgaaatgccaaaataggaccccacttacgatcataggcatgcgattcacatttgcacagacagatgatgtgcgaatcgctgattatgtcatcggactaccaaaatggatgatggctattgtgtgtatagctttctgataagatctttgttctggtcttgagtcagttttcatgatcaaacgggactcttttataacaaggggacggggaaccttgacgtacatataattccttaatacagactcgggggatccgaattaagtaggtaatacatagtttgttgatatgtcatgggactagtgttaactaccaagtgtgatatttcccctgcgtcacggtccctactactttgtagggggttgtgctgtacttaactccgagtccatgatggaaagtatgaaatgatggcttatggttgttttgccggttaattgggggggaaaaattttggggggggggcaaacaaatttttttttaaggttggtgaaatcaaatggttg

SEQ ID NO: 643466 - DNA, 415 bp, Homo sapiens
tgttggggtacaggtcgaggatgcaggagagtgtgggtcaaccccaagaacacaaacccggagggaggggcaggccagagagctgtgaaagcagcaaggccctccaggaacactgccggcgaggacacctccagcagaaccacactcaaacacgactgccgcagccaggaaacggtaacgctgtagctggttccacatctgagaggtggtcctgccagaaattcatttctttttccctaaaggaccaactgcagaattaagcccaaagaacagaaagttgacacctgaacaaaagatcaccgaaaggttttcccgtttaaccaacctgctgcaaacccacacgacggccagcaggcgcctctcttaagacgccctgggtcagcttccccagggtttttcaattaaagctgccatt

SEQ ID NO: 643467 - DNA, 567 bp, Homo sapiens
ggaaacaaccatttctatatagagtattgtaagacccacaggattttaaaatttgatacaatttaaatttgttcattgacactgtattttgtgctgttgtgaggaggaaggattccctaaaagtaaggaggaaatgtttaaagaaatggaaagttttaaaggtttagaagttgaagggtgattaacttttttttttttttttggtcttttctaagagttgcattaaaatgggactatttaaaatgtaacaagttatttaaattgtaattcagttgttagaaaactgccaggcctggaataaaaaaaaaaaaatgtttacaggaatctgtgtacttttccttaatctgttataaagaccttagagaaagaaaaagattcactaataaaattctaaattcctattctgttttgaaacagtaatttaaccggaagagtgaccaaaaaaaaaaaaaaaaagaaattgcttagtttttcattgtctagtttagattctggtttgtagtaaggtagtattaaaacctcagaaagtaacttttattcattacgaagtatttaagagcatttctt

SEQ ID NO: 643468 - DNA, 311 bp, Homo sapiens
ctgagacatagtctcgttctgtcgcccactgcactccagcctgggcaacagagtaagactccatctcaaaacaaacaaacaaacaaaaaaacaaaaaaaacctaaggaaaaaaatagcaaaaagtagccaggcgtggtggcacatgcctgtagtcacagctactcagaaggctgaggtgggaggttcacttgaggccaggtgatgatgctgcagacggctatgattatgccactgccctcaagcctggggaacagagtgagactgtttcaagaaaaaaaaaatggaaataaagttttttgtgattggtaaa

SEQ ID NO: 643469 - DNA, 1975 bp, Homo sapiens
  misc_feature (921)..(921): n is a, c, g, or t
ttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgctgccttttcactttagggctggcactatgtcgaagctgcccaaatttgagattgaattaccagctgcgcctaagtcaactaaacccagcctttccgaacgagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcctgctcgatcgatccagccctatcagatccccatcacaggtcctgctgccgtgaccagccagtctcctgttccatgtaaactctattcttcatcttggattgnctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggatttcttcctctacggagtatttaaacactatcggcaaaagaaggagatgcctcataaatttgtgatagccgtgctgatggaatacattcgttctcttaaccagtttcagattgcagtacagcattacctacatgaacttgttatcaaaacccttgtccagcacaaccttttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaa

SEQ ID NO: 643470 - DNA, 390 bp, Homo sapiens
gggaagctcatctgcatccggagcctccagcccgaacttccgccatccgtgcccgtcaggctagtcggtctctgggtgaacttgaggttcccgcaatggccagggctgtgacaatctctggggacgtgacaaaggcatgggtctcggggtttgcgtcgttgcggcccgtgaagttcctgttgtaggaggtgacgaccgcgcccccccccccctccttgatgtccttcctgtcccactgccaactgcaggggccacacgcatcggccaggacaatgccacccagatccctcaagatctgtgcatagccgtcccgctcaatggtggcccgcatctcctcggaacctggagtgatggtgaactgggacttgcacttgcagcatgggccagtgc

SEQ ID NO: 643471 - DNA, 284 bp, Homo sapiens
  misc_feature (198)..(198): n is a, c, g, or t
  misc_feature (205)..(205): n is a, c, g, or t
  misc_feature (228)..(228): n is a, c, g, or t
  misc_feature (231)..(231): n is a, c, g, or t
  misc_feature (235)..(236): n is a, c, g, or t
  misc_feature (242)..(242): n is a, c, g, or t
  misc_feature (244)..(245): n is a, c, g, or t
  misc_feature (257)..(257): n is a, c, g, or t
  misc_feature (260)..(261): n is a, c, g, or t
  misc_feature (264)..(264): n is a, c, g, or t
  misc_feature (268)..(268): n is a, c, g, or t
  misc_feature (272)..(272): n is a, c, g, or t
  misc_feature (274)..(274): n is a, c, g, or t
  misc_feature (281)..(281): n is a, c, g, or t
cgagaaacccaaagtttacccctgggaagtcccccctcagggcctgagttcccccgtctcaaagagtttcccccggggagagggtttaaggggaaagggcccccccctgctccccagttccagcctggcccccccccctcctttggcctttggcccttttttcccagggggcccccccccattgggggcccccgggtnttttttnccccccccccccccccccccctnggntttnnttttgntnntgttgggggggnatnnatnaatnaagngnttttttncca

SEQ ID NO: 643472 - DNA, 1996 bp, Homo sapiens
  misc_feature (921)..(921): n is a, c, g, or t
ttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgctgccttttcactttagggctggcactatgtcgaagctgcccaaatttgagattgaattaccagctgcgcctaagtcaactaaacccagcctttccgaacgagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcctgctcgatcgatccagccctatcagatccccatcacaggtcctgctgccgtgaccagccagtctcctgttccatgtaaactctattcttcatcttggattgnctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggatttcttcctctacggagtatttaaacactatcggcaaaagaaggagatgcctcataaatttgtgatagccgtgctgatggaatacattcgttctcttaaccagtttcagattgcagtacagcattacctacatgaacttgttatcaaaacccttgtccagcacaaccttttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtgccactgcaccacttgtgcaagataatccctatataacacccatcaggcttagcactacagattcttctaactcaagttcagatatgtacactatcataaccaccattgggcagggagccgccatttctcatttccggatcggccttggccagaagggccctatgtccgccataagtttgatgaaccatctctaagtgggcggatcactgtgttcggtcgacatgtgtgggttgatatagagttccgccggcactgtgtctggcgtaatcatcgcgctgggcaccctatggaaagacgaaaagatg

SEQ ID NO: 643473 - DNA, 659 bp, Homo sapiens
tgttttccctataccgggccaagtaaagttttttagtttattttcccccttccaagtaatgctgttaagttttgtatataagacttttcctgtattttaaattattttgttatggtagagttccataaatggaataaatgggtcaaatatttttgaagctgatacccaaagtacaaattactttccaaatgggtgaatcgatacttgcagtgtatgagaggatccttttcagcacattggttgtacattcctttacaaatatctaatatggtaagcaaaaatggatacttaatctttttaaaaaactttgtatgaaatttctaatgagtgtgaactttttcatatctgtatttgctgcttttaggatttctttaagttgttgccagcctcagttaatttaataccatacttttcttactgttattatcaaagatatcatttatataacaagaaggttaaccttttgtcatctaattgcaaatatttttccagtttgagcatgccagtttttttcttgcttttatttggaggggagtcattttgcaaaattttttatttttacgtatttgttatctttttccttttgtctttgaaagctcagttttaataatcaggtttctaaaattttgttttgcagtaaccagtgaaagaaaaaaaaa

SEQ ID NO: 643474 - DNA, 289 bp, Homo sapiens
catcacccactaggaccataggatcttccacaccgtgtcctgagcacagaaacaatcaccagtggttatcacaagacaccacccccctatccaccttggtgaccagactccccactaccatcagcaggtctacacctacatctgagagcacctacactacttctcccagcagcagtgtcacagactccactagcaaaatcgcctactccacaagtatgacaggtacattgtccacagagacttctctcccacccacctcttcctctctcccaaccgacgaggaccattg

SEQ ID NO: 643475 - DNA, 947 bp, Homo sapiens
tcccatcttatggctttcctttgtggaatgactcagaagaactaatattattgcatcactggtatcccacacgcgtctgtgccatctctccccatgctcatcatcggaatcccccagtcctcttcctgccgtacttgccttctctggaagtggctctgactgagtagacaggggctagctgagaagcgttccccagatctgagctcctagacacgtgcccctgcccaggacatcgtcctagcccacaggatcctgttgctccttctgcagagtcctttgatatcttccagacgccagtcgtcagtcagtggtcctgagcagaggtccatgcggatggtggctctgcgggaagtgactcatgacaccttccctagaatggtgggaaacacgcccaatctaaacatcatcaggacactctctcctccatcgtcatctggactctcacgtaagcctacaatactgcagtccgagattctcaagagttattctgcgcttctggattcctgccgtaccgcgagattacaccagccttgattgagattctctattgcctccatgagatacaagattaacactcatcctggttttaaggagaaaaatgattatccttcctcttgtgtttatacgtatgatataactttggatattttttccctactaatgtcaatgtcgaaagtttcgagtcccactgatgtatggaggatcggggatcatgtgtgcggagcgtgatttggtgtcatcggggagtggacttcatcatgatatgacttggtgttatcttggtctattagcacccacaagatctgattgtttaaaagtgcctagcagcatccctcttctctttttctcttcctctctccccatgttatgccaactccacttcactgtccactgtgagcagaagcactctgaggccctcagcatacgtccaagtcatgctttccttt

SEQ ID NO: 643476 - DNA, 135 bp, Homo sapiens
ccacctgagcctaccaagtaactgagactgcaggcatgagctaccacacctggctaatcttttattttcttgagagatgcggccttgctatgctcccgaggctagtctcaaactcctgtgtatacacgatcctgc

SEQ ID NO: 643477 - DNA, 137 bp, Homo sapiens
  misc_feature (62)..(62): n is a, c, g, or t
gagaagtaggaacgtgggggggtatgacgttctatgaggctaagatatatttcgactggcgngtggtaggctggagctaggtggctgagcagagtagttaaatgtagaagacttctgtgagccagttattagaacta

SEQ ID NO: 643478 - DNA, 882 bp, Homo sapiens
  misc_feature (231)..(231): n is a, c, g, or t
cttacctctcaccgtttctgcaacaatagaggtttaatgtactaccattacctgcataacgtcccacaccacccctgggggaaccccccttcagtgtaacagcaccctttctaaaacatttcccccctctttaggatccccgtggccccaaaagtcacaaaatctgaaggcaaaaaggcccattgtcccccgtgataacaacctgtgtccccctatttggtacacgacgcncttcttatgaaagctcccccaccatcccccctggcaaaataaactgatgacgaggtcctccccaatgtcaccaataataatccaacgccgtctgtacccccctaccccaggcctttcaccaaataggccccccctaaatgatttgtacatcaaatctccccgcccgcttcacaccggagcgatgacccaaacagcttcttcttcattcttttggcgatagccccaacaacaagatttccccgcctagcaaaatataattaggaaaaatatgtcttacagtccttccttcccaacaagcaaaaattttgtgtcttaccccccccacccagggtctagatgacaccggccttttaaaaagtagggtcgccccgcctaattcttgcccatagagatgcgattgaagcacatccggacgcggcgacccaaaatcaccgccataatagcgagactgggttcgaagagctgataggcgcccagctgggtctggcgcgcaagacccggataccccgcatcttcttcataaaaaacgacagaggcgtacacccaccctcgtgtaaattaattcatgtgtttgacatggagaatctgccctccgagcgtagttaaaaacgggaacaatctggcttttttaagtacggccccccacaatca

SEQ ID NO: 643479 - DNA, 123 bp, Homo sapiens
ggtttctgatgaagagctacctgcaggctcaagtgtccccaggatccataccacagaagcctctccctcagtccgtcatgtatctcgccacaccaaagaccagccaggtgcccagcccagaca

SEQ ID NO: 643480 - DNA, 208 bp, Homo sapiens
attgattgagttggagggtggcttgctggactttgttcttttcttctcccgagggatgcaggagcctgtcaggttatggggaatctgcgcctttatttaacagtagcgttggtgcctggcagccagggtttttcccctacagaaagagctggatttctcctgcacactcttgagtcctcttccatggggtctgagcaccatctttgat

SEQ ID NO: 643481 - DNA, 162 bp, Homo sapiens
  misc_feature (18)..(18): n is a, c, g, or t
  misc_feature (43)..(44): n is a, c, g, or t
gccagggcactgcaggtngggtccgtggcctgagccccagctnnatgcaccccccacctgggtctggcttctccatctccacacccccttgagggcttctgtctccccctgccccttcgatcgcaggaggcagtgctggccggggtcgcaggcacctgtcac

SEQ ID NO: 643482 - DNA, 332 bp, Homo sapiens
  misc_feature (123)..(123): n is a, c, g, or t
  misc_feature (125)..(125): n is a, c, g, or t
  misc_feature (159)..(160): n is a, c, g, or t
  misc_feature (163)..(163): n is a, c, g, or t
  misc_feature (168)..(168): n is a, c, g, or t
  misc_feature (189)..(189): n is a, c, g, or t
  misc_feature (191)..(191): n is a, c, g, or t
  misc_feature (263)..(263): n is a, c, g, or t
  misc_feature (273)..(273): n is a, c, g, or t
  misc_feature (283)..(283): n is a, c, g, or t
  misc_feature (287)..(287): n is a, c, g, or t
  misc_feature (292)..(293): n is a, c, g, or t
  misc_feature (297)..(297): n is a, c, g, or t
  misc_feature (301)..(301): n is a, c, g, or t
  misc_feature (321)..(321): n is a, c, g, or t
ggcgccgctgtgaagggagccgccgccatgtgtgcgcatatgcaatggatggcgtgcggaactgctccagattcctgagcaagaggaataagcggacctacaggactgagcccaataacttgnanggccgcaatttctttcgcttcaacggactgattnnacnaagantgtgggcgtggagcccgcagncnaccgcttctatgtgcggaccaccatcaagaatggttgcgccacgcttagaaggattagacacatgatccgcnagaacaagtnccggcccganctgngcatnngagncatncgcgggcagaggcattctgngcagacaggct

SEQ ID NO: 643483 - DNA, 132 bp, Homo sapiens
agaagatcaaatgacctcaacctttctttaactcatggatttggcacctactactagaaagcttagaagctgaagtgcttctttggctgaatatttaagaaacagatactggctgttttagctaggatagag

SEQ ID NO: 643484 - DNA, 136 bp, Homo sapiens
  misc_feature (33)..(33): n is a, c, g, or t
aaatggcatggctcgtactggtctgggatttantggatcgcgcgtttccggaacagccctgtgcggatgaaagggaggaaaaatatgccaccctgcggccggggccggagctggagtcgccgcttccgccgccgcc

SEQ ID NO: 643485 - DNA, 888 bp, Homo sapiens
tctcaaaacatatattgacccctcctctcagtacatcttgtgagcacctttcccaaaattctcaggaacgtgtttagacccccgccccacactttcaatacccgcccataggcctgggtgatgaggccccatcaaagctgggtgcaagggcattcccgtgtcagaataccaaaacatcttcagcagctcaggcagtggcatcacccaaatatcgtgtggaaaccccggataaacgtgccagaggtggcggtgacaagggagtgccaggcctcgacccacaaagcgagacaacggagacacaggcctcaaccaaggtgcacaccatcaaataaaaaaagtgggtcactcacagcaggggagaggaactccccgggaccacaagggggggccaacgaaagccgccgtgacgaagaaaagtcagataaaacgtgactcaacagggcggcctgagagaggagtaacaggggggatcccaaaacaacgcgcgagatggtgaagaaacgattcaacccatataccctaaacaaagcaacgataaccgggcaagcgcggagccaaagggcacactcgagagacaaggagctaacccacacaagcccccgaaaaaaccggagcacaacccgaggggccaaacccgtctgcagtgctagcagcagaccccacacatagaggcaatatagctcaaaaccacgcgggaaaacataaccaccaaatcgggacaggtcaacaaacgaacataagacggcgaaaagccccagctgagagccgaggcacgcggccccgggaagtaaaaacacaaaaaacacaccacaagaggacatagaggacgagacaaaaatcccccaacaggccattccacacacgaacgcaacaccacaaaccccaagg

SEQ ID NO: 643486 - DNA, 449 bp, Homo sapiens
tactaggcacataagctgtctgctgctagaggtgtccatgagcagtccttggtggtgtacaggacagaacgtgcattccttggcagctgccacgagctgtgcttcttctctgtgaatggggcacaaaggcacctgctcacggggcgattgctacagctacctgcactccctgagcatctagtacgtgccagcgccatgtcacaccctcttgcaaatcatcccgttcttcctctcagtgaccgtggcaggagggattggtatgtccattttatggattgagagactgaggtttacagatgtgaaattatttggctagggcctgagagctccagaaggtggtgtcgtggaaccccagtgcttatctggggtgtcttttcattattcgagcacaggaagcccctggtgccttccgcttctctgtcccatcacattccccattgctgtggctc

SEQ ID NO: 643487 - DNA, 166 bp, Homo sapiens
gtaattcctcagaacttgctttggtcgatggactagcaaatcaagtgaggagacaggccatgcattaatcaagtgcatgcagatcactgattacatccacaagtttccgcacagtgcccacacagaagtatgtccagacaagcctggaaagacaggcagacatcac

SEQ ID NO: 643488 - DNA, 253 bp, Homo sapiens
ttgaaagggtctccccttccccatggtgaagtcaggcctaatgaagagagtggctacagcctacttagtgattgggaaattccctgtcttgccctgggccagagctggcgtacctctggtggatcaggtcttacaagcatagaaccttacactcccaactggcaagcctgacacctcttgctagggtgtgagcaaaactagcacaggacctataagtagatgtttgcgtctgtcatgattctccagacaaact

SEQ ID NO: 643489 - DNA, 104 bp, Homo sapiens
ttcgctactgtgtgccaccaaaccaggactttccccttccccttggcttggcatccctggctctctcctggtacccatcaagacagccaccacacagtagcgaa

SEQ ID NO: 643490 - DNA, 151 bp, Homo sapiens
ctactgaggtggggagagggtgattctctcgccaaatcccttcttgcctggctgccaaaccaaagacagcctagagccctttctgcatggggggctgagatgacaggctttccagacccccgaagctctctttccctcctccctggttttt

SEQ ID NO: 643491 - DNA, 132 bp, Homo sapiens
atttggggctgcaggttcagcaacttcctcacagcgactgcaggaacaagccctagtcccctaaggtttcatgatgttggccttgtggacagcagtgaccttgccccgccccttcttggtgcgcggattcgg

SEQ ID NO: 643492 - DNA, 495 bp, Homo sapiens
cattctagcttcttcgcatttctaaagaactttttaatctgcaccaaaagaagtaaaaagtctgcgttaatttttattgagatagcattggcttaatagatcagcctggaaataattgatatctttaacaatgttgagtcctccaatccataaacatggcatatctctccatttatttagatctgctttaattttactcagtaatattttgtagttttcaatgtacagttcttgcacatattttgttaaaattatccctacttctttcacattttttgatgctattgtatttaaacaatggtattttatttcaatttccaatcttttgttattaaaatgtaaaatacaattgatattttatattgaccttgtatcctgagaccttgctaagcttactacttctactatccttttttatagcctccctgggattttccatatatacagtatgtcatccataaataaataaaattttgtttctttcaaataaaaaaa

SEQ ID NO: 643493 - DNA, 1412 bp, Homo sapiens
ggccgtgagaagccatgagcataagtctctcgtcggacaaccctgtacgaggcggtgcggcaagtcctgcaccgggaaccagcgcaagcgccgacagagttcctggagacggtgtgagttgcaggaatcaagttgtgacacgaactagtgatccccagaaatggagcagatgcgcttcatcgtgagcaccggaacatgagcttagacgtctcgacgtcttcgcgacccttaagggttacctctgttcgtgtgtccctgaggaggtagctcagtcacgcacttgtgacgagggcttaatggcctgtggattttcccctcgacaattgtgactatccgaaggcctgcttgacagataacacctcgagcacatgagattaaagaaaatctggttcagtgacatgcattgcggccaaggaacgatacttgaatgcggatctatgttggtcctcaaggagctcatctagaatcagacgtgcagcactttgcgcagcggcagagtaccatacggggcacgcagcgatgttaagagtatacgcgtgcagggcacacagagctttcccgactttcgcacatggcgtaccacaggcgagcaaattcgtaacaaaccaatgtgttgtgaaccaaacacgttgtgtaatggacggagattgagacgcgttccagaaatttgtcccaaaaagtttaccccaaaaacaatttggaacagtgcacagtggggtatggttagaacttcggttcctttggcggccatttggctaaaaggagcggttggagacaagagggtctccaatccgggttggacaaggggcaagtttgcaagcacaagtgagaacacggaaacgttggaacaggccgtttaggatagggttaggttaggcagccacttttgacagcaccccttagtgagcggtaggttacagagaccgttcttcactcatggagggtggagttccaagtgtatagcgttcccgaggagcgaaataaacaataagctctttgggtgccagagtgaaaaacggtcgggtcctccatgggggggcccacttttacattaattagcttcccaaagatgaaagggcaaagccccaattttggggtggccaaagagggggccccacccaaaggccggccacctgttaagtttactttttaaacacagtcggccaacgcaattatagttggaaactttacaaatagtttccgtcacagttataacccccaacaggttaagaaaacgacgaacaacaacacaacgaagagagacgaaggagcaagcaagagcaaggaagagagagagacgagtcaccaagagtgagatgcgccaagaagaggaaggagtagaacgacgtagataatgggatgagaaaagaagaggaatgatgcgacagaggagcagagacaccaacgaaagg

SEQ ID NO: 643494 - DNA, 251 bp, Homo sapiens
agcccgtgcgggttcctcaggcagtatgtacgaccaacgacctggtgtatgacatctgcggacacgagatgactatcacctccttgaggatctagaggaagggatccaagcgctgatgtagcggctggaatgcgcaggctctgtgagcatgagatagaagaatcatgaaggctttgagaagcgggtcgactccagccaaagtgggatttcgctaggactgtgacacggactgtccttaggcactaacattc

SEQ ID NO: 643495 - DNA, 389 bp, Homo sapiens
  misc_feature (89)..(90): n is a, c, g, or t
  misc_feature (121)..(121): n is a, c, g, or t
  misc_feature (132)..(132): n is a, c, g, or t
gcggccgcctactactactactactactactaaattcgcggccgcgtcgacgggaggatctcttgagcccgggaggtggatgatgcagnntgggccctgaccatgccatctgattccaggnttgcagggcangaacgagatctctgtctcaaaacaaacaacaaaaaaaaaaacaaaacaaacatatccttcgcccactttttgatggggttgtttgtttttttcttgtgaatttgtttgagttcattgtagattctggatattagccctttgtcagatgagtaggttgcgaaaattatctcccattttgtaggttgcctgttcactctgatggtagtttcttttgctgtgcagaagctctttagtttaattagatcccattggtcaat

SEQ ID NO: 643496 - DNA, 531 bp, Homo sapiens
aatccacaggtgaatggggcgggctggtgccacatgacgcctcaccgcagtgacgttgagaactgtgggtggagtgccacctagtcttggttgagtccagatggagcagcagcctgtgtgagctagtgtggggccggattctggcagtggcaggggctgtatgtacctgcagggaatgggggtcgctgtgtgtccgcctctaggggctgtcaggcggtatctactgcaccagccggtaggtgatgtacctgccagcctgtctcactgggccggatgatcttcaccacctgcccacgctttatccccaaagtaccgcgccacagggtcccccgcctggatcctgggcagctggttctctcggagcttctatcgggccagcagctctgtcaacctcctccttggtcatgacgacgtgctcagggactagctcgtgctccgtgatgtcgatgagcgctcctgctgaagaaactgctccagtgatgtattgggggccatgtcgaccagggactgttggcgggggtgtccgccctg

SEQ ID NO: 643497 - DNA, 975 bp, Homo sapiens
agactcaaacatagcaggtcgaggccggtgttaatcggccgaggcgggatagtggctttcgcagactccggatctactgacccgggaactgacaggctccaactacccgggcactcagtattagccttcgcctcactggctcctctgcacaagaggaggcttccggagtagccctcggtgaagccccagaccacagctatgagtgccttcgtgtgacgtctgcgcatgaaacatgttctgcatgtccagctcaaccggtcccgaacaagaggaatgccatgaacaaggtcttctggagagagatggtagaggtgcttcaacaagatttcgagagacgctgactgtcgggcggtggtgatctctggtgcatggaaaagtgttcactgcgaggtagttgaccgtgatggacagtgggttcggacatccgtgcagcccaaaggaggatgatgtggcccggagtcagctggtacctccgtgacatcatcactcgattgcaggagagcttcgaactgtcatcgagaggtgcccaacgcccgtgatttgctgccgtccatgggtggctgcattgggccggagcgtgtggaccttggtcagcgcctgtgactccggtacttgtgccccggatgctttcttccaggtgcaaggaggtggacgtgggtttggctgcgctgtaggaacactgtctgcgcctgccgatggtccctcggggaccagagcctggtccacgagcgtgggcgttcaacgcccgcaacgatgatgtgcgtgaccgagggcctggggccgtggctgggtcagacggggtgttccccgacgcaagagggtgctgctggtgctgccttacgcggcggcgggcattgctgcagacccgtgccggtgttgctccacggtcacctgtggttcccgcacaatcgtgggcggagccccaccatgtggtcccgccctacgtgttttcccccccttttgtctcggccctta

SEQ ID NO: 643498 - DNA, 207 bp, Homo sapiens
taccgcagagagcttaaggggtacgtctaggtcagactcgcaagtccactactcattcactgtgaccttgagaaacttacctaaaccgtgtaacatattgtaaagctggggaataacaccactttcctctgagaagccatggcaagaatgagacattcttggaacattctttgcacaatgcctgttactatattttttttcatttta

SEQ ID NO: 643499 - DNA, 570 bp, Homo sapiens
  misc_feature (140)..(140): n is a, c, g, or t
  misc_feature (142)..(142): n is a, c, g, or t
  misc_feature (147)..(147): n is a, c, g, or t
  misc_feature (178)..(178): n is a, c, g, or t
  misc_feature (237)..(237): n is a, c, g, or t
  misc_feature (294)..(294): n is a, c, g, or t
  misc_feature (317)..(317): n is a, c, g, or t
  misc_feature (374)..(374): n is a, c, g, or t
  misc_feature (388)..(388): n is a, c, g, or t
  misc_feature (395)..(395): n is a, c, g, or t
  misc_feature (400)..(400): n is a, c, g, or t
tttttttttttatctgtttccagattttattatctatatattttattacgtacatatgtttttcttatgtattcattcaatttatgcaaacaatgatagattaatcatttcattttaattgtattcttaaaaataacatntnaatantactattgcaaaaatattgctttataggagnttatttaaaaatattgaactccccaactgtatttatccattctttcattccatttattnatcaaacataacctgagtacctgttatgtagcagacatattctgctatctctcaggncccttctatccttaaaaacttcntgtttacctgccctgcctgcacaagctgagagatttaaaataggaatattgggactnaatctccttgaaantttgtcncccanctttcaaacaaaagcatttctgaagttagaaaatagtagaagataacctttaactgccattcaaaagtttatcagtcttaaatgctaatattaatcattggaaggtcttatttgcatatattctgtaagcataaatattgaataaaatgagccatatgtattcacttgaa

SEQ ID NO: 643500 - DNA, 201 bp, Homo sapiens
ctgccctcagacagacagaggactgtgccaggaaactgacatgctcagcgcacaagccagctagggacagcgaacgagcccagagagacagagcaagttgcctgaggtacacagagcagaggacttgagacaccagtgcagaccgtgctccacagtaggccctactctacctaccctagcctacctgggccatatcaacgg

SEQ ID NO: 643501 - DNA, 698 bp, Homo sapiens
ggccggctccgttatggcgacccgtagccctggcgtcgtgatgagtgatgatgaaccaggcttagtgaccttgatgtacttattgcataccgtaatcattatgctgaggattcggaacgggtgttaattcctcatggactaatcatggacaggactgaacgtcttgctcgaaatgtgatgaaggagatgggaggccatcacaatttgtagccctctgtgtgctcaaggggggctatagaaatactttgctgacctgttggattacatcaaagcagtgaatagaaatagtgatagatccattcctatgacgtgtagattttatcagactgaagagctattgtaatgaccagtcaacaggggacataaaagtaatgggtggagatgatctctcaactttaactggaaagaatgtcttgattgtggaagatataattgacactggcaaaacaatgcagacttggcttccgttgggtcaggcagtataatccaaagatggtcaaggtcgcaagcttgctggtgaaaaggaccccaagaagtgtagggtataagccagacttaggtggatttgaaattcccgacaagatagaaggtaggactatgccttgggtataatggaatacttcaggggattggaatcatggtggagtaattaagtgagattggaaagcaaggtaccaaggctaaggatgagagttcag

SEQ ID NO: 643502 - DNA, 369 bp, Homo sapiens
cacgaggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacatataaaaaaataaggaatgcctctaacttcaatagctatgaacaggtgaattcctgccattttttttc

SEQ ID NO: 643503 - DNA, 397 bp, Homo sapiens
  misc_feature (2)..(2): n is a, c, g, or t
  misc_feature (7)..(7): n is a, c, g, or t
  misc_feature (31)..(31): n is a, c, g, or t
  misc_feature (66)..(66): n is a, c, g, or t
  misc_feature (71)..(71): n is a, c, g, or t
  misc_feature (104)..(104): n is a, c, g, or t
  misc_feature (268)..(268): n is a, c, g, or t
tnttganacggagtcttgctctgtcgccccnggctggagtgcagtggtgcaatcttggctcactgnaaacnccgcctcctgggaaacctggctctcaacggtantattaaaaatgaaaatccagccgggcactgtggctcatgcctgtaatcccagcactttgggaggccgaggtgggcgcattcaggagttcaaaaccagcctcaccaacatggtgaaaccctgtctctactaaaaatacaaaagttagccggacatggtggtgcanacctgtaatcccagctactggggaggctgaggcaggagaatcacttgaacccaggactcagaggttgaagtgagctgagattgcaccactgcactccagcctgagtgacaagagtgaaactccatctca

SEQ ID NO: 643504 - DNA, 129 bp, Homo sapiens
tccgttacagagtgacgcagtgaagctccctgagggagcatgccagggtctacgcgtgctagatctgcatcgccttctacttcctgcactagaggcggatcatctacagggaccttaagctggacaacg

SEQ ID NO: 643505 - DNA, 153 bp, Homo sapiens
aggcagtgagccaccgcgcccagccgtgcaactttctttagagtgcctttccagtcctcccacacctggctagggtattcatttgccacatgaacacatacaccacggccctgcaatttattgcagccacatgtcacactttaaccttcatga

SEQ ID NO: 643506 - DNA, 278 bp, Homo sapiens
  misc_feature (2)..(2): n is a, c, g, or t
  misc_feature (9)..(10): n is a, c, g, or t
  misc_feature (54)..(54): n is a, c, g, or t
  misc_feature (57)..(57): n is a, c, g, or t
  misc_feature (59)..(59): n is a, c, g, or t
  misc_feature (71)..(72): n is a, c, g, or t
  misc_feature (110)..(110): n is a, c, g, or t
  misc_feature (129)..(129): n is a, c, g, or t
  misc_feature (135)..(135): n is a, c, g, or t
  misc_feature (198)..(198): n is a, c, g, or t
  misc_feature (220)..(220): n is a, c, g, or t
ancggccgnntcgcatctcagctggttggctttggttagagctcccgtcagacnttngntcgggcctaggnnttggtagccccgaagtgtgggctctctccagtaccagnctcatttcagtaccagccnttgggnagtcgtgtgaatactcggtctcttagccacagggatagaatggcggcctgacggagccgcggngccggcgaagtcgctgaggcgncgacttgtaacccccagaccagctcaaacgggagccaaaacctcgaagccttggaagc

SEQ ID NO: 643507 - DNA, 1180 bp, Homo sapiens
tcacgaggattgcgcgattagttgattccatcacgagcactaggtcacaccatttaagcggatttacaaggacctgagcagaacgagatctctgtcgagcttaagacgacgacgtggatgatgtgccaagtgagtctcgttgggtaactaatgtgtgcacttgcgcaggatgcacacagcagtcgtacgcggaagcgaaccaaggtcaaaattctagcgaggacaagtggaacaacgtgtgcattgcttagcaatcttctgccaacaactcaagaaactacactttgtaaactgacgatctttatagttgacctagttgcgggcaaatataccagtaataaaccctccagtgaccgtggggaagagctcgcaaatacaagtcactcaattgttcaggctgctttcaaaatattactaaaatggcatttggtacgcctcttgaggccagggtcttgacagaacagctgtggggcccacagtttcaaccctaggtgaccagcgagttccacattgttgttaaactcctatagcgcaaccatctttaatattgggacttacctgttgtgatgcgtaacacttaacagaggcggattgaaagcgtactatagtcacggtggcagcaattcgtaagtcactttcccagttatcaccagagcagcgatttgcacttagtattaagtagtcctaagagtacttgaggctggtagaaagcaggagcgtagatccaagtagttactggctaaggaagaaacttgttgcatcccaacccaactgttgtgcgattggtatgtaagaagggcgggtacaggatcacgtaaaacagtgccgcgaatacttggatttgggagatgttcaacactacctggtagactctaaaggcaacaactattgtaagcctatttcagaacagtcaccggtctccatatataacagcccgatgacatgggcctttggaactctggacctatggataatttgctctaaaaaagtcccgcggccatctctcggcccacaagagccggcataacccgacatgttgtcgtatacacactgtgacggcattctacacacagatataccaaagctatccacaccgccatatctagtgtgcacgaccaacacatttgtgcagtccaaaccacaaatcagcacacacaaatatcgcgtcgtgatttttttt

SEQ ID NO: 643508 - DNA, 294 bp, Homo sapiens
atgagtctcaagctgccgcccgtttggtgaatggcgacggtattgtcgaagtcttttttggttgcccccatcttcagcgccaccgcgaagccctgcaacatttcgtccataccaaagccaatgccgtgaataccgacaatcttctcttccgatccaacgcacaccagcttcatgcggcacggctggcggtgagtggtgacggcggtatacatcgcggtgaaagaggatttatacactttcacctgatcgtcgccatactgctcgcgcgcctgcggttccgttaaaccaacagta

SEQ ID NO: 643509 - DNA, 537 bp, Homo sapiens
  misc_feature (129)..(129): n is a, c, g, or t
  misc_feature (494)..(494): n is a, c, g, or t
tttcttccatctatattttcttagttaacataattttttaaatctatgaaatcttacctgactgcagattcatcagaaattccaacatctattaaagaaaaaggtaaaatgcattttaaatcaataatnaatgtacagaatattaaaatcataagaatgcacagtgatgcatgcctctaatccaaactacttgggaggatgaggcaagaggatcacttgaggagcccagaagtttgagaccagcttgggaaacatagtaagactctaccttcataaaaaaattgtgcacacttgtgtgtatgctttagatcctgttttttgttgttgttgttgttgttgttttggtttggtttggttttttaaagcataagactgacgctttgttacaaagcattcctttgggagcatgcctgggacgttattagaattaacattcattatatgtattggtaggtaattaatgcagtaagaactcttccctctgtatttattanatgcaaagaagaatacatttattaaaatttggtatctacaagt

SEQ ID NO: 643510 - DNA, 893 bp, Homo sapiens
ggcagccgggctggtcctgctgcgagccggcggcccggagtgggcggggagaaaatgaacgtggagttgcccacagtgaagtgaatccaaatacccgtgtcatgaacagcggggtatgtggctgacatatgcatggggagtgggtgtgttcatatgtgtcttactcagcattcccttcttcagtgttcctgtgtgctgtggactttaacaaattattatacataatcgtgggatgtacgtattttggcatggagtgaaaggaacacctttcgaaactccgtgaccaggtaaaagcaaggttcctaactcatgtggaacaaatgactagtggagtacagttatacatcttcagggaagtttttcacaatttctccaataattctatatttttcctgacaaggtttctataccgaaagtatggattccaattcatttcatcctaaaacagaagttctctccgtgaggtgtactaatttcccaaaaaagtgccacaaactacatggtgtcggatcttggggaatacttaagtatggaaagtggttgtgaaacgtgaaaaaaatttttacagtagtgaatttcttatagggagggagtggttagtaaactggtgttctctgatattgtgaattgagacgttttacatgggggggcatgggtggccctcaggtgcggtgaagtgagattcattaatgatggtctgttaaaaactggactttgaaagggtaaaagcgggggggcagtaaagtaaggaaacgagggggaaactcagaacagatgtgaaacacggtatgaggggtggaaaacacctctctcgggtaacaatagggctccttattttgtcaaaaaaacggtcttggggcgttgtttctctattcacgcgccacctatggggg

SEQ ID NO: 643511 - DNA, 309 bp, Homo sapiens
ggataaaaagaatcaatatcattaacatagccatactgcccaaagccatttacagattcaatgctattcccattaaactaccaatgacattcttcacagaacaaaaaaaaaaaaaacttttaaaaatcttagggacccaaaaaggagcccaaatagccagggcaatcttaaggcaaattggcaaaaaggaacaacggtgggaggagattcatggccacttggatttacaaattaatattaacaggggatacaggtaacccaccaacaggctagggtacccgggtacaaaaggcaggacactatagacca

SEQ ID NO: 643512 - DNA, 228 bp, Homo sapiens
atgcttgggaatccaagcgctggcccaactagacccaccgtgcggaggtcgtttgaataccaaagatgctgctatatcacctctcccggttaccccaggactacccctcccaacagaactgcgagtggattgtttacgcccccgaagccaaccagaagattgtcctcaaattcaaccctcactttgaaatcgagaagcacgactgcaagtaagcgccgtcccacagtt

SEQ ID NO: 643513 - DNA, 798 bp, Homo sapiens
agccggcgatggccgaatcagaagccctgtcgaagcttcgggaagacttcaggatgcatgaataaatcctgtctttattttgggcgccagcggagaaaccggcagagtgctcttaagaggaaatcctggagcagggcctgtttgtccaaatgtcacgctcatgggccggcgagaatgctcaccttcgacgaggaaagccttataaaaatgtgaatcaagacggtggtggaactttgaaaacgttggatgactacgcctctgccttttcaaggtcatgatgttggattcttgttgcctgggttaccaccagagggaaagctggggcggagggatttcgtccgtcgttgacccgagattatgtgctgacgtctgcagaagcctggcaaaagctggagggtgcaaacatttcaaacctgctatcctctaaaggagctgataaatcaagcaatttctgcatatctaccaggtaacgggagacgtagaagccaaaggtttgacatcaacttacaatttgatcgttactctgtatttagcgccctggaggtcctgtcagtgtgatacggcacgaactctcgcccaaggtgaatggtctgctttaggaaaagtcctttgctcctttaccagaatctgtgggccaggggcattctggtgcctgttggtgcacgggggttaggaccaatgctgaacccactgttgttggaaccagagacaagccgtttggcctggtggcgacaaggcctccctgtacctgggaaaacctgggatactaaccagagccctgggcagggttactgcacc

SEQ ID NO: 643514 - DNA, 278 bp, Homo sapiens
ctggccgcagagctccaccgctgaggccaacgaggccatttctttatttgcattaaacaatattttttcaatacagttttggggggggggggggagacattaagctcatttaacaagagacataagttaacacaatgtgcgctgctttcatgaggaggaaagaggcaagatcttagaggaatccaggatactggccaccaggaatcacaggatctcacagtacaatccacttctttaaaggccgcagggtaagctatggaagaaaacccaaaacaaag

SEQ ID NO: 643515 - DNA, 260 bp, Homo sapiens
gtgcacttgcttctgcggtcgctctgaggatccccgttcgcggaagcagaaagaggtgttagggtttggggtttttgtttttgtttttgtttttaatttcttgatttcagagtttcctccctccctcgtcgtgctgcggccaccgtcctcgtatcccctgcttccgcgggcgccgcgcggctggtctggtttggtgtttggttgtattagtgtgtggtgtattaattgattgtattgcacacattttctcccaccactca

SEQ ID NO: 643516 - DNA, 774 bp, Homo sapiens
aattgttttgtactttttggtatttttgttttattttttttcagatggagtcttgcgctgtgtcccaggctggtagtgcccagggacgatctcggctcacggcaaactccgcctccggggttcacaccattctccgggctcggcctcccaaagtagctggggactacgggtggctaatttttggtattttgagtaagagacggggtttcgccgtgtgggccaggatggtctcgatctcctgaccttgtgatccggcccgcctcggcctcccagaagtgctggggattcacgggggtgagccaccgggcctgggcctaaaattggtgttggatagataattagattggagatgtacacatttctccccgattattggtgggaatccgttacattttctcacgtggatcttcagaacttttactccaaagtggcaagccgtggtgctcttgtgcacctcgaagattcattacacgtgggccatttcgtggctcccattccgtggtcgtggtccaggcatcgagtccatgtcttcgtcttccataagcggggtgctccatagtggagaatagttcacgtgttggggtgaaccacgtttcacatccgcttatttcggcgctcgcttttaaacaagagattcttgggctattctcagagctatttaattcgttccagagtaatcttgctaagtcatgtggacaaattccttacaaaaaccccagggagattccagttgaaatgtgccttaaatttggggggtcacttacgggaagacta

SEQ ID NO: 643517 - DNA, 197 bp, Homo sapiens
  misc_feature (171)..(171): n is a, c, g, or t
gggaggcagaggcgggtggatcacttgaagtcaggggttcaagaagagcctggccgacatggtgaaacccatctgggttggtcaggcatggtggcgtgtgtctgtaatcccagctacagaaagatagagaggtggctgaggcaggagagttgctcgggcccgggagttggnggttgcagtgagccgggatcacacca

SEQ ID NO: 643518 - DNA, 181 bp, Homo sapiens
gcttctattaaatgattcatgcttgatacttttataagacaacacaagcaactaattttctacaaaggctttcggcttatatgcaggcttttattgactgtttttcgtgcaaactatgtttaaaagaaatcttcactaacatgatcactgactacatttagagaaaacaatgagttttcca

SEQ ID NO: 643519 - DNA, 150 bp, Homo sapiens
tagcgatcacaggatcttaagcttggtcagcaatgacatctgctcctccatctgctttccaggtttcccatttgagttgcgggtactattctattgcttgtgtggtatagtggctgcactagactgaagcgggtagaaggacaaaagtct

SEQ ID NO: 643520 - DNA, 306 bp, Homo sapiens
  misc_feature (124)..(124): n is a, c, g, or t
ggaagacgggccctccctatggccctagaagatctggctatgtttcgggaggacccacattaactgtttgttacccaagtgatggcgttgttacatagaaggcagtggaactagtcgtccatanaacacaagggatatctgcttcatccggaccagccgtccagaaaatgccatcatctataacaacaatgaggacttccaggtcggacaagccaaggtggtcctgaagagcaaggatgaccaggtgaccgtttttggggctggggtgaccttgcacgatgccttggtcgctgctgatacttacta

SEQ ID NO: 643521 - DNA, 448 bp, Homo sapiens
aaatcgggaacactttcgggccgaagttcccctgttccccccccgttggaggaactggcccttacaaaattggttaccttacggtgcttggcacccggctttagcccaaaggacgtgttggtttcttggctgcaggggttccaggaatttccccgcgaaaagttccttatttgggcattccggcaggaacccaaccagggccccccccccttttttttgaccagcattttgggggtggcaacccaggttgtgaaaaagggggacccctttttttgcatggtgggccccaaggcccttccgttggccttttcccaaaaaaccattggccgcttggggggttaacccccccatgtcaatgtgtttgtttttatggggggggtggggggcccctgttttttaaccgcccccctgtcccccccccttaataaactccatgttccccccagca

SEQ ID NO: 643522 - DNA, 790 bp, Homo sapiens
  misc_feature (19)..(19): n is a, c, g, or t
  misc_feature (95)..(95): n is a, c, g, or t
  misc_feature (131)..(131): n is a, c, g, or t
  misc_feature (133)..(134): n is a, c, g, or t
  misc_feature (157)..(158): n is a, c, g, or t
  misc_feature (168)..(168): n is a, c, g, or t
  misc_feature (178)..(179): n is a, c, g, or t
  misc_feature (182)..(182): n is a, c, g, or t
  misc_feature (195)..(195): n is a, c, g, or t
  misc_feature (199)..(200): n is a, c, g, or t
  misc_feature (299)..(299): n is a, c, g, or t
  misc_feature (350)..(350): n is a, c, g, or t
  misc_feature (391)..(392): n is a, c, g, or t
  misc_feature (398)..(398): n is a, c, g, or t
  misc_feature (400)..(400): n is a, c, g, or t
  misc_feature (402)..(403): n is a, c, g, or t
  misc_feature (424)..(424): n is a, c, g, or t
  misc_feature (427)..(427): n is a, c, g, or t
  misc_feature (438)..(440): n is a, c, g, or t
  misc_feature (452)..(452): n is a, c, g, or t
  misc_feature (458)..(459): n is a, c, g, or t
  misc_feature (464)..(464): n is a, c, g, or t
  misc_feature (469)..(471): n is a, c, g, or t
  misc_feature (473)..(474): n is a, c, g, or t
  misc_feature (494)..(494): n is a, c, g, or t
  misc_feature (525)..(525): n is a, c, g, or t
  misc_feature (533)..(533): n is a, c, g, or t
  misc_feature (544)..(544): n is a, c, g, or t
  misc_feature (555)..(555): n is a, c, g, or t
  misc_feature (662)..(662): n is a, c, g, or t
  misc_feature (664)..(664): n is a, c, g, or t
  misc_feature (667)..(668): n is a, c, g, or t
  misc_feature (695)..(696): n is a, c, g, or t
  misc_feature (766)..(766): n is a, c, g, or t
catcctccctctggcagtngggccctcgtgtccttttgcctcagggacggaagcttttgcaggagctgagttgttcaaaggagcctgcgaaaganagttgtctagtgaggaaacctcgagatgtcaggatnannacgaactccacggcgctggcttnnggggatcgcngcgccccggnnggngcctgggcatggnctgnnccccgggtctcagactgtagtctccccttgtttgctgttggtgggcctcgtgtagaccttcctccaggggttgagggtcttgccggaccagatccagangcccgacgtgatgcccacgatcagcgtcataaggtacttaatcatgggggncgtgaagtccgggctcatgggggggtggggggggggggttnngggggntngnngtggggggggggggtagcgtngtnttgctgttttnnntatccagttgtnttcccnntggtnccggnnngnntgttcgtagaagttgcaggngatgacgatggtggttggtacagtgtacagnacgctgantgatgccaatntgcaccatgancttctccagcttctcggtcttggtgccatcgtgcttcatgatggtgcggatgcggaagatcgacacaaagccggccagcagaaaggacgtgccgataaacaggtacntnttnnggggcgccacacgaagccacgcagcgnntccacgttgttaagccccacgaagcacactccgctcagcacatcgccgtccacctggcccagcgcagggntggtgatggtcttgatggcgggca

SEQ ID NO: 643523 - DNA, 318 bp, Homo sapiens
gcttacaacattgaactcgacaaccagcccattccccacgccggagcagtgcgcggaggcctgtccaagcgccgcatcggactcggctacaccggcctgggtaccatgatggtgcagctcggcattcgctacggctcgaatgagtccatcaatgctcaccggggaagtcggcaagttcatcgccgtcgaagcctattgggagtcgaccaacctggccgtcgagcgggacaccttcccgctatacgaccgcgacaagatccaggaagcggagttcgtcaagaagctcccgaaaggaccttggtcagtgcatctacgaag

SEQ ID NO: 643524 - DNA, 218 bp, Homo sapiens
tgcaccacagatgttcctgtgtgacccttccaatgaccacctctccccccatgatgtgagcactggctatgtggaacagggcctggtgtgtctgagacaccactggctatgggaacggggcctggagtgcctgagacgctctggctatgggaacggggccaggtgtccctgagatgctctggctatgggaacagggcctggtatgcctgagacaccct

SEQ ID NO: 643525 - DNA, 180 bp, Homo sapiens
aaccaaacgaacaatacagaggctcaagcattcaggaagcactgacaggttggctaggccccaattcattaaccctcctggcctagcagtctaggcgttggctttacctatccagtctcttctgagcacacacaggccaggtaggggactaatggctggcacacagtgatgcttcaacct

SEQ ID NO: 643526 - DNA, 366 bp, Homo sapiens
gcgcttggcacacgcaacttggctcgagcatttctttttgtgtttataacatttacttgactctttacaactcttcaactgctatttgttgctataaagttttaaagtttgggcttaagacagagtctcactttagcccaggctggagtgcagtggtgcaacctcggctcgctgcaacctccgcctcccaggttcaagtgattctcgtgcctcagccttctaagaagctgggattacaggtgcccgccgccacacctggctaatttttgtatttttagtagagatggggattcaccatgttggtcaggctcgtcttgaactcctgacctcaagtgatccacctgcctcagcctcccaagttgcgtg

SEQ ID NO: 643527 - DNA, 792 bp, Homo sapiens
ccacgcgttcggcatacaccaaagtggcggatgacgccggtgcagcgggggggcccgggggccctgtgtgggcctgggcatggggaaccgctggtggcttccgcggaggtttcggcagtggcatccggggccggggtcgcggccgtggccggggccggggccgaggccgcggagctcgcggagtgcaaggccgaatggataacggagtgaattgccctgtcaccaagttgggccggtttgtcaaaggacatgaagatcgaagtcgctgcgagagagatctatctcttctcccgtgccataaaaggaatcagagatcactgatttcttccgtggggacctctctcaagggatgaggtcctgaagattatgccagtgcagaaagcaagaaccgtgccggatagcgcaccaaggttcaaggcattggtggctatcggggactacaattggacacgtcgggtctgggggagttaagttgctccaaggaggtggacaaacgccatcccagtggggccatcatccttggccaaagctctacatcgtccccgtgcgcaagaagctacctgggggaacaaagattctacaaggcccccaacactgtaccttgccaagagggtgacaggccgtgagagtctggtgcatgtgtacgcctcatcacttgaccccaagggcaaatggcatctgctaccgcacctggcctaaaaagctgtcatgatgcgtgtatcgatagtgtacactcaacccggatgaatgacagctgaaatcgcaggcacttgagcactaaactaatacgcc

SEQ ID NO: 643528 - DNA, 480 bp, Homo sapiens
  misc_feature (266)..(266): n is a, c, g, or t
taaattagttgaaacttgtaagacttacatatatatatatagcaggcttgtataccagcagtccccaaccttcttggccccagggactggtttcatggaagataattcttccatgaacttgcggccagtagggggatagtttggggatgattcgagcacattacatttattatgcactttatttctattattattacattgtaatatataacaacataattatataactcatcataatgtagaatcagtgggaggcctgagcttgntttcctacaactaggtggtcccatctgggggtgatgggagacagtgacaaatcatcaggcattagattcttataagaagcatacaaccaagatcccttgcatgcacagttcacaatggggttcgcactcctatgagaatctagtggcaccactgatgtgacactaggcggagctcaggcagtaatgctcacttgtccaccactcaccttccact

SEQ ID NO: 643529 - DNA, 710 bp, Homo sapiens
  misc_feature (56)..(57): n is a, c, g, or t
  misc_feature (59)..(59): n is a, c, g, or t
  misc_feature (463)..(463): n is a, c, g, or t
  misc_feature (561)..(561): n is a, c, g, or t
gagaccctgacaccaccttcaactcacgggccctgactcaggggcctggtggcgannangaagctccgagtctggatcatctctggacagcagctgccgaagtcaataagaataagaattctatcgtggaccccaaggtgatagtggagatccacggtgtggccaggatgtggcagccgtcagacagcagttattaccaataatggtttcaacccacggtgggacacggagtttgagtttgtggtagcagtgcctgaccttgcccttgtacgtttcatggtagaaggattatgactcctcctctaagaacgactttatcggccagagtactatcccctggaacagcctcaagcaggggtaccgccatgtccacctcttgtctaagaatggagacctgcatccatcagccactctctttgtgaagatctccatccaggactaagcctgggggactgacgcaggntcccctgagtgggcggagctgtgtccacacctgtctggcaatgttgcacctctggcgcggagcttgaggccactgaactgccttcagctctaacacantcgcctgagcttctacttctctgggggtccaggagcagtccagtccccggagtggtctaaaattccgttaggaacaacactgcatctctctccctacccctagttgactttaggttgtgagtttttatataaaaaaaaataataatcac

SEQ ID NO: 643530 - DNA, 675 bp, Homo sapiens
gggaagaggtatgaggggaacatatgaacatgccttataccaacctggctgcttgtctaactggcaccttgacattgtttgctgactttgtcaattgaaatttttattaatctggaatgccttttcctcctctggtatcaaaagcctgtctttcctccgtgggctcaactaaaccacagcttttcaatgaaccactttagatctcattctcatctttctgtctctaccatcagatttttaacaattttatttatttattttaaacagggcctaatgctgccgtcccaggctggaatgcagtgatgcaatcatggcttgctgccaaccttgacctcctgggctcatgatcctcctgcctcagctccgtagtagctgggactgcaggtgcaccaacaacctggctattttaggggagttaaaagtcgtatgaagtaaagggtagaagaacgtgagtctcgctatgtagcccagaactggttccaaactcctgagctcaaagcagtcctccagccttggcttctcggaaccagctgggattgcagtgtgagacactgacacctggcaataactatcagattttcaaacactatcaataccgactgagcaactctgaacttgtgttgtgctggccatttacgtatcaccaggacaaggtcacaatgataggcgagaaaa

SEQ ID NO: 643531 - DNA, 231 bp, Homo sapiens
agcatccatatccgttacatcactcagctcgagctgcagtgatgtccggtcatccatctacttgatcacacggttcgtggtgtgggctccggagcccggcatgcccacctcgcttctcctgcatatacccttgttttcaatttttggtcccgcaaaccactcaggcagctttccacactccagtttccagaaatttgtgtgtttctgggccccaaattggcccttatcgag

SEQ ID NO: 643532 - DNA, 969 bp, Homo sapiens
tatatattatcgagtataacacagtcatacaaaaacattgagtagaaatataattcacacataaaaacagtctacttattttgtgtcccttttatatcctattttaggcaaaatgataaaacccagaaaataacaggaatgtactagtcctaaaaagtggcaccttttataaatgaaacagatccgatcacctataccttctctcaaattccaaataatgaggcttactgacctgtactctcagaaatcaacttaaatacattttagcttgatgtggatgatatatgtactttcagttgttgacaatccaggtagaacatgtacataaagatgattcctaagtcaaaacatttcatacaaaaggagatggttttaacccagacaactcaagaggacaatgcactgaattcaaaaacttctgaaacaggcattttgggaccatttataaaatactaaaaagttcagaagtgctgaaaaacaaaagtttatcataaaatagagccaggggtgaaacaactatcatgtgtctcaaactcactctaaagacatatattatataatgtgaatatataattagaaaccaggtttaaagttgcatttctcctgtgtaccaagtgactaatcacatgtaaaactggccattcaattaaaaatgccatttaatacagtattagcaagccttctggccatttatgtaacaccttcaacaattactgtttcgcacttggaaaaatagagctacatacgtttttaaaacaagccaggtggtgaacgtgcactacattgtgtgcaaaccttgctcaacaaatctttgcgcctgctcacacttcttataaatagactttaagcgtctccaaacagcggtttccatgcccttgtgagcacttcatgcgggccacacgactggggaccgccttaacacctttccctagaacaaaaccggctccatctcctccagcaggcgacgac

SEQ ID NO: 643533 - DNA, 699 bp, Homo sapiens
tcgatcatcaccatcacaatacgggaaattttgccaattcagcaggccggcaagaacatgagtgccagcgtgactgttgtctgcaagcagtgccctctcttcagaaaaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatatttcatccctccctcgtgagaagatgtccaaatgggatggtagaaggcgagggcttatagtgtaatttgcttctccttcaagccgttgccctgaggtgagacaatcttgtattgagttttgtaaaataatggtaaaaaaaaaaattataaaa

SEQ ID NO: 643534 - DNA, 296 bp, Homo sapiens
ctctgttatgaagtgtcctactggatgcttcaaatctattctataaataggtgagataggaaacaatgagtaaatatttatcggatcattattttccaatgttaagtgttttaactacagtgtagtatgtttatgattcttgaaactctctttttcatgatatcttgagttattaaacatgcattcactaaaagcatctgactcatcacatctggcccaaattctgatatatgtacaaatgttcacacattatcggcaagattacatataaaagactggcatcacaatgtatcagt

SEQ ID NO: 643535 - DNA, 212 bp, Homo sapiens
caccacctatagatcagtagcaacgaagttgacggctaacagccgcgtggcattgagcccgaacacggctaacacacattcggacaggctgtagataaagcctttactcttgctttttagaacacgtggttcaagtataaaattgcaaacgcctttggcaaccttgaactaaaagaaaaaaacaaaaaaatttgggccattactctttttct

SEQ ID NO: 643536 - DNA, 379 bp, Homo sapiens
gtatccctaccgcaggcggtctgtggtgctgatcggcgcactgctgtcctgcttggcttcctgctgcgcagccaagggtaccaagtgttggcgcaggaggccccgtgctgggacgcccctttgagggacccagccttgagacagctgctgtgcgggacagaactgacgactctgcagccctcggaaccccactcggcgggtgccctctgctcaggcctccctagcacctctccctaaccaaattctccctggacccaattctgagctccccatcaccatggaaggtggggcctcaatctacggccttccctgtcagaagggggtttgtggccacaatccccatcacaagctgccagcttgccccgccgggtaccgagct

SEQ ID NO: 643537 - DNA, 610 bp, Homo sapiens
  misc_feature (396)..(396): n is a, c, g, or t
agtgcatattttaataaatgtcctttggagtcatcttaaaggccatatatctgtgtactgctaggaacagggcagtcttgatctgtgtgttttcacgttttatttctaaaatagaaaacatgttttcatttttatttcttctcctcactggagtctttcagaggctcatttttatttcttctcctcactggagtctttcagaggctaccgtgaaccatgaacatctgtgagggtgggattggggaagaagggcataatggagatcagtacataccttggttccactggctggggtggctggagaagatggcatggatgtacagctgtggttactctgactagcactggagctggaacgagtaggggaagctgcccgggaagatggtttggaccttngaccccgtgagcggaagggggtcattccctgggatgctccctctggtaggatgaatttctctctaagttcaatgttagttctacctcgtgctcggcagggatcatttttcactaaaaattcgtgccaaggccatccatcctccaccaacgcgaaccatacacggtgctgcgcagaatgacggaccagccgcaactgatgagaatccccgtcaga

SEQ ID NO: 643538 - DNA, 1508 bp, Homo sapiens
  misc_feature (406)..(406): n is a, c, g, or t
  misc_feature (1212)..(1212): n is a, c, g, or t
ggcgcaagagccgcatctccaggccttagtatcagagaagcttatgataactcctagtttacctcctaggcattacaacgtatacgtgcgactgatataagttgagaaggctgcgacgtctagtacgactagttcgtactcggcataggggtgcaagcatcgatgaaagagtgatacgccagtgcggtacactgatacgcaaaaggagctaaaccccttagtagcctcttcgtagcggtacttgtatttatacctagaatatgtagacgtttgtgcagatggagatgccaagagcttatggacacacctcgaaacaagcacgagcagacgactaccctgtacacgcataacaacgaccttagaaaaaagacggcattcgagctccagattcttagtgttaagacangaacacttaggtcggagacacagactttggatacgcagtgacggaacgagacggcactattaacacataagcactgctgacgcaagagtagaattgacgtcgagcgaatgggttccgaaaggtactaacggacaatttcttcttaagattttccacagcattgttcctacacggttaattggctcgccagcgaagcgagatcgccactttcgttaaagaagttcgcgcacgttgtgcataagaaacatttcttatcacctggtcttaagttacgcgcataaagacaggaggataaccaaggattgccctctaatggtggacccaacccttaggtgcacaccaaagaaaacacctttaggttggggaaagcacggcacgggatcacacggaacgacaatagttttggaaaaggcgtaacattcccaaagttaagggcttaaggaagctcccctttagcgacgagaagggcaacggtcccgagcggccgaaaataatagagccgtaagaaagggccgacatttaccatacagggcctgtcccgaataaacacacctccggagacgataaacgcacgtgtgaggcaacaatatggagattcggcgctaatagacaccaaagttacaattagcaccgtgtggaagacatataccccgttacgagaggaaagaaccgccaataagttcaggaggaatcccgcaaaaaaagttcgtgtaaggattctgaagccccacggttaagtgtaatagcacatcgggcaataaatccattaagaagttcgggtcttcaaacggtcacacttataatangtttacacaccagagatagggcacatagagaaccccaatttttttgcgatacccccattgtcccccggacgcgattttagaaaggacgccctttggctaggttgtcaacgtgaacctatttacaaagagaagcgagatctcgttggtgaacgaccgttgggcacacggcggaacgatcgtcaagaacgctaaagtgcgccgccgaagtagatcagatatcgtaaacggacagttccagagaagagcccaagagcacacagaggatccgatattctgagaatgttacagggcccacg

SEQ ID NO: 643539 - DNA, 364 bp, Homo sapiens
  misc_feature (201)..(201): n is a, c, g, or t
cgtggatgaagtacccgacatcgagctggcccgggcccgcaacctgatttcacccaggatggagaaggccttgagtcaattggccctgcgctctgctgcgcccagcagccccgggggtccttcccaagggcccagcaacttggcctggggctaacccccaaccaggccaaccccggccttggcatggccttcgttcccagngtcctcttgaggggtcagatctgtgacgatcacagagacagagatgacaataccggccgacagacgtgagtaacgggctactgccgtgtggacgtgttcgagcagctgctcgtgagtgctgtcgatgggatgtgtctatatactgggaatgaactgtgctcac

SEQ ID NO: 643540 - DNA, 867 bp, Homo sapiens
  misc_feature (140)..(140): n is a, c, g, or t
  misc_feature (609)..(609): n is a, c, g, or t
  misc_feature (694)..(694): n is a, c, g, or t
gggcgaaggacatgaacagacacttctcaaaagaagacatttatgcagccaaaaaacacatgaaaaaatgctcatcatcactggccatcagagaaatgcaaatcaaaaccacaatgagataccatctcacaccagggttntgagaatggcaatcgatttaaaaacgtgcaaaaaagggggaaaagacgaaaaaaaatgagaaaaaaccagggtgccattagggggaaagggcaaagggggggggcaaacttgggggttggacaaaaacgggaaaatattaggcacaccgaaccttttttttttttgggttttttttaacccaaccctagtttcggtccgggcactattagggtttttctaaaaagcaaggcaaattaaaccccgcttttcaaacggggatttattcccgaaaataacccccacaagtttatgagggactacgccgggggccaaacacacaaaacgggggggtttttccccccaaaaaaggggctacgctttggggacgggcccagggcggcacaccttttcgagttttgtacacctacacccctctattgttttttctccccctaaaaagggagcccaagggcgcggacggccagcacnaaatactactttatttcccctgtcgtttttataacgggcgcgaacacaaaatcataacgacccgtgttttatacaaggggctgancaaaagatataaaatctagaaacatctttttatatagcacaccgcagcccggaaaaatgacgtttctacattctccgcgttcgatggaggaagcaagaagcacctcgtaatccccgtacgccgcatctaaaagggcggatctcgccttacccgtaaaaaatgcttttgcccac

SEQ ID NO: 643541 - DNA, 113 bp, Homo sapiens
gcagggtctccagtgcacaccaggctcggtcccccagcccccgcatggcttttgttcccaagcccctcacgcagtcaatcctcagtggggtcagtcaagcattccattgccag

SEQ ID NO: 643542 - DNA, 344 bp, Homo sapiens
  misc_feature (255)..(255): n is a, c, g, or t
  misc_feature (293)..(293): n is a, c, g, or t
  misc_feature (325)..(325): n is a, c, g, or t
  misc_feature (331)..(331): n is a, c, g, or t
tcgcagcctgtcccactgcccctacctaagaatctgagagggaggttatctttgaaagctccctagatgattctatcatatatccattgttgagaactgcagttaatctgcataacattttcagggaaataatattatgctacagtaatagctaaatcaagacagatatagtcagtaattactcagttaaatgtcttgatggtgttaattaaaccaattgctttaaaatacttcagtcagcttggactaaaaaantaaggaaaaacaaaaaacccagtttggggcttcaaaantttaaaaaactcttaccaaggccaggaggganttttgncaaaccaaacttt

SEQ ID NO: 643543 - DNA, 329 bp, Homo sapiens
  misc_feature (141)..(141): n is a, c, g, or t
  misc_feature (149)..(149): n is a, c, g, or t
  misc_feature (168)..(168): n is a, c, g, or t
  misc_feature (171)..(172): n is a, c, g, or t
  misc_feature (194)..(194): n is a, c, g, or t
tctagttcgcgaccagctcgattgcttatgtcttgtctgagcgagctacctataccttcactctgtagagaagtttcctcagctttaaacttataaccccagctgtggtctctgagagactgaagattcgaggctccctgnccagggcncccttcaggagctccttantannggacttatcaaactggtttcanagcacagagctcagtaatttacaccagaaataccaagggtggagatgctccagctgctggtgaagatgcatgaataggtccaaccagctgtacatttggaaaaataaaactttattaaatcaaaaaaaaaagcgg

SEQ ID NO: 643544 - DNA, 107 bp, Homo sapiens
taaatttttccccccccccccccgggggggggggggttttttttggggtttttttttttggggccccctgttttttttttggggaaaaaagccccctttgggggcca

SEQ ID NO: 643545 - DNA, 200 bp, Homo sapiens
  misc_feature (65)..(65): n is a, c, g, or t
accatctagcacaggccagcgaacgaagaagacggcccgacctaggattcacaaactggtttcanagcacagagctcagtaatttacaccagaaataccaagggtggagatgctccagctgctggtgaagatgcatgaataggtccaaccagctgtacatttggaaaaataaaactttattaaatcaaaaaaaaaagcgg

SEQ ID NO: 643546 - DNA, 1463 bp, Homo sapiens
  misc_feature (478)..(478): n is a, c, g, or t
  misc_feature (1463)..(1463): n is a, c, g, or t
ggtgacttgaactctcgggctttgcgagttataggctgggtcggggctcagttgtcttcagagaagctcgagagctcttaggatggatccgtggaacaggaagggatggggtgccataaagatgataagggcgataggaggacgtgcaatcgcagtcccgaggatcgacatccttgagccccggcatcagtgaatgagtgtgacgcggcgatagttagtcaaggctggcaggcgggcaatcctatcagaatcgcatcgtactcatccagcctggctcagtaacttcatgtcattccaaacaagatggagatacgagcaccatgttaccagcacaatggaggcatacttgcgagacgtcgttcatacaggggatacagcatggatatacgatcgagaaatgtacatccgttaaccacgtacagacagacagggatgatcgtagtgtggggacccgagaggcctgaggactttacagagntagcatgaggtacatacgcggaggggcgcttctctgaaagcaaaaaactaggatccgacttcctgtttctcctatagggagggacctgggaagctgtgagatgagcacgttgaatgcaggacttgcgcctgcgcagtagggcaaacgcagaaagtcctcatgcggcgtggggttggggggaaacttagggcggccacttgaacacggttgaagcacttgcgcctaattcggacaacatacgcgttggatcgtaatgcgtataggccatggacaccacattggttgttctgtgcccaaccattgtgtgggtgtccccctttatcacttatggccttgtgattcgacatgggtgagaagggggtaggaagagttggggctagttgttcatcattacacaggggagggtaccaagacggcggggaaacctacctagttccggcccatttttcgaacatcaagcgggtgcaccacgttcgggcaattaggaagcgccaaggcgcctgtcctgtgtctgtggccttataatcgccctttcgtgtcggtgagaatcgtcctatagtcccacagggaatccgagagcgggtatcgaccatctccgggcgagcgttagttgacttgaactcgaagaggaattcacgggcctcatagttttcggatcttgtgcgaagggagtggggtggaagacagattccgtggggggagtcccctgtgagaaggatgctttagatggggcgttccaggatactttccggcacgaaaagcactcccgtaaccaaaggggacttggagagggccctaaggcagcgggagccattttgccccaagcggtacagatcgtttggcggggttcacaagagggagcgttaacaatcttcgccaggaaattttcttggcgcccggtacacaactctcctggagagacggtgccacattctgaccacaccacgtctttggaattatagacgaacccgaagcgcagattgtn

SEQ ID NO: 643547 - DNA, 1144 bp, Homo sapiens
  misc_feature (221)..(221): n is a, c, g, or t
  misc_feature (223)..(223): n is a, c, g, or t
  misc_feature (240)..(240): n is a, c, g, or t
  misc_feature (264)..(265): n is a, c, g, or t
  misc_feature (267)..(267): n is a, c, g, or t
  misc_feature (269)..(269): n is a, c, g, or t
  misc_feature (271)..(271): n is a, c, g, or t
  misc_feature (276)..(276): n is a, c, g, or t
  misc_feature (286)..(286): n is a, c, g, or t
  misc_feature (288)..(288): n is a, c, g, or t
  misc_feature (305)..(305): n is a, c, g, or t
  misc_feature (307)..(308): n is a, c, g, or t
  misc_feature (310)..(310): n is a, c, g, or t
  misc_feature (316)..(317): n is a, c, g, or t
  misc_feature (348)..(349): n is a, c, g, or t
  misc_feature (374)..(374): n is a, c, g, or t
  misc_feature (376)..(376): n is a, c, g, or t
gagagccgcgcgccgggcgggaatgtaagatggcggagtagcaacgcaaagcgctggtatgagtctgtggccgacttcggttccggtctctgcagcagccgtgatcgcttagtggagtgcttagggtagttggccaggatgccgaatatcaaaatcttcagcggcagttcccaccaggacttatctcagaaaatgtgctgaccgcctgggcctggagctangncaggtggtgactacaantcagcaaccaggagacctgtgtgnnanantngtganagtgtacgtngngaggatgtctacatgtncnnantgtttnnggcgaaatcaatgacaatttaatggagcttnngatcatgattaatgcctgcaagatngnttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtt

SEQ ID NO: 643548 - DNA, 465 bp, Homo sapiens
ccacgcgtccgaatttaagtatttaattaatcaaaaggcactacgataccacctaaaacctactgccttttgattaatttaagtatttaattttcatcttccttctttggatctatttggcctctcaaatgaactgagattcctgttaaaaaagattgatgttattgtctcttgtagaggaaactaataaagtgtgtgtacctgtgtgatttggggtctgtatcatacataatctgtactgatctctctgctaaaggtttggtttagatagatgtcttgctgtccattgatagctcttatttgtttccaaactacgttagcttcattgttaaaccaagagaagacattggcagcagttttattcaactgtaagactaagatgtctggagtttactggaaatgttcattagagatgtgtaatctcttgtcgcagatatccctaaacttatacgcatgtataatgtc

SEQ ID NO: 643549 - DNA, 440 bp, Homo sapiens
catatgatattttgttgtggaagcctaagcaggctaatatactcctccctgactaaaattctgcaatgacaagtaagatgaatccaaatcaacattttttccctctagacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgaggatgagatttgtgcaaaacaagacttttctaagtgtttaggaggtggttacttacgttgaattaggtctctggattctgaagatatctttctttggtctgaaggatttagtcttgtcatcagaatttgtgatccaaaagttaacaatcacctgtttcttttcctttt

SEQ ID NO: 643550 - DNA, 159 bp, Homo sapiens
gactctagagatccccccgccgtaccaggttgcgccataccaaacgcccctcttcgtctgattcgtcctaatcacagcagtcctacttctcctatctctcccagtccgtagctgctggcatcactatactactaagcagaccgcaactggtacggcggg

SEQ ID NO: 643551 - DNA, 2088 bp, Homo sapiens
  misc_feature (221)..(221): n is a, c, g, or t
  misc_feature (223)..(223): n is a, c, g, or t
  misc_feature (240)..(240): n is a, c, g, or t
  misc_feature (264)..(265): n is a, c, g, or t
  misc_feature (267)..(267): n is a, c, g, or t
  misc_feature (269)..(269): n is a, c, g, or t
  misc_feature (271)..(271): n is a, c, g, or t
  misc_feature (276)..(276): n is a, c, g, or t
  misc_feature (286)..(286): n is a, c, g, or t
  misc_feature (288)..(288): n is a, c, g, or t
  misc_feature (305)..(305): n is a, c, g, or t
  misc_feature (307)..(308): n is a, c, g, or t
  misc_feature (310)..(310): n is a, c, g, or t
  misc_feature (316)..(317): n is a, c, g, or t
  misc_feature (348)..(349): n is a, c, g, or t
  misc_feature (374)..(374): n is a, c, g, or t
  misc_feature (376)..(376): n is a, c, g, or t
gagagccgcgcgccgggcgggaatgtaagatggcggagtagcaacgcaaagcgctggtatgagtctgtggccgacttcggttccggtctctgcagcagccgtgatcgcttagtggagtgcttagggtagttggccaggatgccgaatatcaaaatcttcagcggcagttcccaccaggacttatctcagaaaatgtgctgaccgcctgggcctggagctangncaggtggtgactacaantcagcaaccaggagacctgtgtgnnanantngtganagtgtacgtngngaggatgtctacatgtncnnantgtttnnggcgaaatcaatgacaatttaatggagcttnngatcatgattaatgcctgcaagatngnttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgtgggccttgcagctttaactatagctcagctgctgcaagatttcagacttttgaggatgttgtgtgagggtgtttgactgtgactggggaagctcagactactttgtatgtgaatgcttcagggttttctttgttgagaacaactagcaacaaaggcaacccatgtgtgaccagttctccccaaggtctatgctaaattatagcaagagccctgggcaaccccaaacctagtcctggtagctgagcaccctgtaaggcaggagcaggcagctcagcttgagcagacattgggtggggggtggggggtggttgaggggggaggcagcacagtgcagcaaatgtttcttgggaggaagaagcctgatccatcaccatctgcttgactatgtagcttggattctcctttgtacctatccctttcgatttggctttaccttcatctatcttgatcctttcctggccaaatatcctcttgggcccaaatgaacattgtaccatagtcttctggaaagcaaacatgcttcctgctatgtaattgctaacattcatattagatgatgtgctgtagcttgatcttccttagcctactgccactgaggcagtaggttttaggtggtatcgtagtgccttttgattaatttaagtatttaattttcatcttccttctttggatctatttggcctctcaaatgaactgagattcctgttaaaaaagattgatgttattgtctcttgtagaggaaactaataaagtgtgtgtacctgtgtga

SEQ ID NO: 643552 - DNA, 313 bp, Homo sapiens
  misc_feature (76)..(76): n is a, c, g, or t
  misc_feature (160)..(160): n is a, c, g, or t
  misc_feature (212)..(212): n is a, c, g, or t
gttgtcctccttttggcccaggacctcgggtggcctcacgctttgtaatccccaggccacttttggggggcccctnggcaggcggatccacaaggtccgggaagtttcgaaaccagccctggccaaacaaggcaaaaccccgtctctacttaaaaatacnaaaattagccgggcatggtggtgtgcgcctgtaatcccagctactggggagnctgaggcagaagaatcgcttgaacccaggaggtgaggttgcagtgagctgagattgcaccactggactacagcctgggtgacagaaccgagctccgtctca

SEQ ID NO: 643553 - DNA, 107 bp, Homo sapiens
ttattcgtgtagcacagggtagacagaaatcctttcataaagcaccagcagtgtgtaaaagatgagctaccattacttatactttaatgggttcagcttcaagatct

SEQ ID NO: 643554 - DNA, 2276 bp, Homo sapiens
  misc_feature (221)..(221): n is a, c, g, or t
  misc_feature (223)..(223): n is a, c, g, or t
  misc_feature (240)..(240): n is a, c, g, or t
  misc_feature (264)..(265): n is a, c, g, or t
  misc_feature (267)..(267): n is a, c, g, or t
  misc_feature (269)..(269): n is a, c, g, or t
  misc_feature (271)..(271): n is a, c, g, or t
  misc_feature (276)..(276): n is a, c, g, or t
  misc_feature (286)..(286): n is a, c, g, or t
  misc_feature (288)..(288): n is a, c, g, or t
  misc_feature (305)..(305): n is a, c, g, or t
  misc_feature (307)..(308): n is a, c, g, or t
  misc_feature (310)..(310): n is a, c, g, or t
  misc_feature (316)..(317): n is a, c, g, or t
  misc_feature (348)..(349): n is a, c, g, or t
  misc_feature (374)..(374): n is a, c, g, or t
  misc_feature (376)..(376): n is a, c, g, or t
gagagccgcgcgccgggcgggaatgtaagatggcggagtagcaacgcaaagcgctggtatgagtctgtggccgacttcggttccggtctctgcagcagccgtgatcgcttagtggagtgcttagggtagttggccaggatgccgaatatcaaaatcttcagcggcagttcccaccaggacttatctcagaaaatgtgctgaccgcctgggcctggagctangncaggtggtgactacaantcagcaaccaggagacctgtgtgnnanantngtganagtgtacgtngngaggatgtctacatgtncnnantgtttnnggcgaaatcaatgacaatttaatggagcttnngatcatgattaatgcctgcaagatngnttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgtgggccttgcagctttaactatagctcagctgctgcaagatttcagacttttgaggatgttgtgtgagggtgtttgactgtgactggggaagctcagactactttgtatgtgaatgcttcagggttttctttgttgagaacaactagcaacaaaggcaacccatgtgtgaccagttctccccaaggtctatgctaaattatagcaagagccctgggcaaccccaaacctagtcctggtagctgagcaccctgtaaggcaggagcaggcagctcagcttgagcagacattgggtggggggtggggggtggttgaggggggaggcagcacagtgcagcaaatgtttcttgggaggaagaagcctgatccatcaccatctgcttgactatgtagcttggattctcctttgtacctatccctttcgatttggctttaccttcatctatcttgatcctttcctggccaaatatcctcttgggcccaaatgaacattgtaccatagtcttctggaaagcaaacatgcttcctgctatgtaattgctaacattcatattagattgccttttgattaatttaagtatttaattttcatcttccttctttggatctatttggcctctcaaatgaactgagattcctgttaaaaaagattgatgttattgtctcttgtagaggaaactaataaagtgtgtgtacctgtgtgatttggggtctgtatcatacataatctgtactgatctctctgctaaaggtttggtttagatagatgtcttgctgtccattgatagctcttatttgtttccaaactacgttagcttcattgttaaaccaagagaagacattggcagcagttttattcaactgtaagactaagatgtctggagtttactggaaatgttcattagagatgtgtaatctcttgtcgcagatatccctaaacttatacgcatgtataatgtc

SEQ ID NO: 643555 - DNA, 485 bp, Homo sapiens
atgaaacatatatttgttaatggactattccgggatgacttttaaatatttacactgaataaatacctgtatctggttggcccatgtcctagctgctgaatattcaggaaagaataagggatggctcctgaccttgagaagcttagatttctggtgaaagtagctttctcagtgcaattatactgtgagtggcatcttcttcctctctgggccctccccctggttcctgctccccactactattgccacagctgagtgtcaggctgaatgaatcatggagctatctgaggatggcagtacttacattactttattacgttgtaaaatacttcctgataagaacgtactagtggttttttgagtgtctggaaacattgtaaacctgtcaaataattctaaagattccgctgttaacatcagcttaaagatttgttagtaacgtaacttgccaaattccttgccccatcacagtggtctccctaatt

SEQ ID NO: 643556 - DNA, 131 bp, Homo sapiens
gctcatttgcagtggggagccaaaaggggcatcatctctgccccctctgctgatgccgccatgttcgctatgggtgtgaaccatgagaagtctgacaacagcctcaagatcgtcagccatgcctccttggt

SEQ ID NO: 643557 - DNA, 1867 bp, Homo sapiens
  misc_feature (221)..(221): n is a, c, g, or t
  misc_feature (223)..(223): n is a, c, g, or t
  misc_feature (240)..(240): n is a, c, g, or t
  misc_feature (264)..(265): n is a, c, g, or t
  misc_feature (267)..(267): n is a, c, g, or t
  misc_feature (269)..(269): n is a, c, g, or t
  misc_feature (271)..(271): n is a, c, g, or t
  misc_feature (276)..(276): n is a, c, g, or t
  misc_feature (286)..(286): n is a, c, g, or t
  misc_feature (288)..(288): n is a, c, g, or t
  misc_feature (305)..(305): n is a, c, g, or t
  misc_feature (307)..(308): n is a, c, g, or t
  misc_feature (310)..(310): n is a, c, g, or t
  misc_feature (316)..(317): n is a, c, g, or t
  misc_feature (348)..(349): n is a, c, g, or t
  misc_feature (374)..(374): n is a, c, g, or t
  misc_feature (376)..(376): n is a, c, g, or t
gagagccgcgcgccgggcgggaatgtaagatggcggagtagcaacgcaaagcgctggtatgagtctgtggccgacttcggttccggtctctgcagcagccgtgatcgcttagtggagtgcttagggtagttggccaggatgccgaatatcaaaatcttcagcggcagttcccaccaggacttatctcagaaaatgtgctgaccgcctgggcctggagctangncaggtggtgactacaantcagcaaccaggagacctgtgtgnnanantngtganagtgtacgtngngaggatgtctacatgtncnnantgtttnnggcgaaatcaatgacaatttaatggagcttnngatcatgattaatgcctgcaagatngnttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgtgggccttgcagctttaactatagctcagctgctgcaagatttcagacttttgaggatgttgtggaagaggccagaaaatggaagagacgcccctgtaacgggaatgctaatgaggaacatggggagcaggaggctgacaatgaggtagacgacgcagaggaagaaggtgcggcggcaagacggacgcggaaggaaacgaacggtgcctggtgaccccacgaaggctggaccgatggacgatgacggaagcctgagtctagctaccgggcaagccggcgcctgcagaatgattgaggctcacgacgtcgctccagaagctgagaccgacagcgctgctcaccgccaacacggctctgttctcttaacaacaaggcgcgtgactcatagcctcatccgtctagcactacggtccttgagtacaggccccgccacggactgccccgtagcggtctcccacctcccacctgcgtggaacacaccgggtcacagcaaacgcgcgccctaccgtttgtcaacgaaccgccctattgtacccacccccccttttt

SEQ ID NO: 643558 - DNA, 270 bp, Homo sapiens
  misc_feature (9)..(9): n is a, c, g, or t
  misc_feature (23)..(23): n is a, c, g, or t
  misc_feature (108)..(108): n is a, c, g, or t
  misc_feature (137)..(137): n is a, c, g, or t
  misc_feature (157)..(157): n is a, c, g, or t
ccttccctncccgagggtccggnatccaccgtcttgccttcctgctcttcaagcagggccagccgattgacttctctgaggaggcacgcccctcaccctgctatcagntggcccagcgggccttccggacttttganttctacaagaaacaccaagnaaccatgactccagccggcttgtccttcttccagtgccgctgggtatgctccgtcacctacatcttccaccattcttctggatcatgcgggagccggtgtttggagttgcgtg

SEQ ID NO: 643559 - DNA, 148 bp, Homo sapiens
ctctgatggtcccacagcacagaggaggtggacagctggacggccagcagagggagaacctgctgctagtcgacctcccaaagaataatgcccttcagagacttagtggcctgcgtgtgggcctcctctgtgctgcccctcctctgtg

SEQ ID NO: 643560 - DNA, 718 bp, Homo sapiens
  misc_feature (363)..(363): n is a, c, g, or t
attgaaagttccaattaatgcgtgacctgaacgaggtaaagtatttatctggaaagggaggtttctgggtttggaggagagtaatgaatgtgatcccaagttggaccatgggtttaccaagttgtgtggatgcctttgtggaaccatgtgttccctgtatgtcttaaaattgtggtttccagccaggatggtaaatttgcccccttgttgtggtatgtttaaaaacatgagtgcactcactactgggccctcttgtgaagattggagatttcaactgggtagattttcttggtaacggcttgttcctgagagcctgttcttctggaggagcccaccaccactgtttaaataccacgaccacgncttttcctcgagatcactttgagatttagttgtgcaccctgatttttggtcttaaacggaacttatgtgcccccatatatctttatttattctcttaagatttttagccctgtatagttaaaagtggctttacactgaatgaatgtcgcaaaagccgtttgtccccctttactgggttttgggggttgtttaaagaattaggggatgaacgatgccaaatggtttatcgttcaaactgtccactctgatcccaccccgtactgatagtacttccccgtatgatattgtgatgtttcataccatgccagtgaacataacccacttgttacctaaattaagaattgataaaaaccca

SEQ ID NO: 643561 - DNA, 363 bp, Homo sapiens
ccccaagtccccgctgctctactgtgacgctgactagctgaggtggagaaaggtgtgctcccctggtgatgtgactggactggtgttccagtcaaatcactccacctatgagccagtgctgctggcctagacgcgctcgtctgagtccatcccgcacctgggcgcagacgccggcctgcatgctgcactgcacgccactgtggtccaggaccatggtgcctgcactgacggcatccagcgcgtgctgttttggcaacaacctgaactactggctgcacaagcttgtcttcgtggatgccgtggccttcctcacggggaagctgcctctccctgccattggaccgctacatccttggtggacat

SEQ ID NO: 643562 - DNA, 779 bp, Homo sapiens
gctctcaagcttggcgttgtttggtggggttacacgcggtttcaacatgcgtatcgaaaagtgtatttctgttcggggtcccatctatcctggtacacggtcactgatgttcgtccgcgaagcgattgcaaggtgttcagattttgcaacatctaaatgtcataaaaactttaccacagagaagcgcaatcctcgcaaagttaggtggaccaaagcattccggaaagcagctggtaaagagcttacagtggataatacatttgaattcgaaaaacgtagataggtgaacctatcaaataccagcgaggagctatgtgaaataagactattgatgcgatgaagacgagttgacagtaaatcaacacagaagcgccaagctaaatttataatgaacagattgcagaataatagagagctacagaaagttcaggatatcaaacgaagtcaagcaaaacattcatcttatccgagcccctcttgcggcaaagggaaacacgtggacagcgaaaatggtacagcagttaacgatgaggctgtggaccttggaagatgctccttaaaatctctgtaacccatgcttttatgttcctttgaaaaatgcctgttgatgtcttggaactgtgaaatcattttatttttttacctcaggtcccttaactgaaaagcgcataacagacatcttgctgcattgccctctacgtatatcgatatcacggagttgcaatggacctccaagcacaccttcctgaaagagtgatgaaacctgaaaccctctggtc

SEQ ID NO: 643563 - DNA, 398 bp, Homo sapiens
caccaggggagaggcgaccagtgcagtctccgtgcaacgcagccggggcaggtacagggagtgctacaaatcagacgaagggagtgctgggacgcaaacggtgaacgcagtgagaatagattctaggaagaaactgggcatatggtacctcaatatgaaaagttcacatttagagaagagctttgcgtgagtgtgagagcacacacttgctcgttagaaagagagacgactgatttccttagatgtctcaagtagctttaaacacatatcataatttttttaaatgcaaaaaacaaacaaacaaacaaacagtccagttccacaagcccctactacttttcctctcttggtatttaccccagggcagggtctataaagtacggttccacaaagtcaaa

SEQ ID NO: 643564 - DNA, 187 bp, Homo sapiens
cccggggaattttttgggggaaaaggagggatgggtttaaggagttggaaattcgggaaggaaggttgggggccagggtccggggttgggtgttccggagccaaggaaaactgggaaagctgcccccctttgccaattatttattttttttttttgagagaggggaagggaaaggccgattctttga

SEQ ID NO: 643565 - DNA, 812 bp, Homo sapiens
  misc_feature (26)..(27): n is a, c, g, or t
  misc_feature (113)..(113): n is a, c, g, or t
  misc_feature (115)..(115): n is a, c, g, or t
  misc_feature (121)..(121): n is a, c, g, or t
  misc_feature (131)..(131): n is a, c, g, or t
  misc_feature (146)..(147): n is a, c, g, or t
  misc_feature (151)..(152): n is a, c, g, or t
  misc_feature (156)..(157): n is a, c, g, or t
  misc_feature (162)..(163): n is a, c, g, or t
  misc_feature (166)..(166): n is a, c, g, or t
  misc_feature (267)..(267): n is a, c, g, or t
  misc_feature (271)..(271): n is a, c, g, or t
  misc_feature (284)..(284): n is a, c, g, or t
  misc_feature (302)..(302): n is a, c, g, or t
  misc_feature (305)..(305): n is a, c, g, or t
  misc_feature (314)..(314): n is a, c, g, or t
  misc_feature (341)..(341): n is a, c, g, or t
  misc_feature (360)..(361): n is a, c, g, or t
  misc_feature (430)..(431): n is a, c, g, or t
  misc_feature (437)..(437): n is a, c, g, or t
  misc_feature (458)..(458): n is a, c, g, or t
  misc_feature (470)..(470): n is a, c, g, or t
  misc_feature (490)..(490): n is a, c, g, or t
  misc_feature (529)..(529): n is a, c, g, or t
  misc_feature (549)..(549): n is a, c, g, or t
  misc_feature (592)..(592): n is a, c, g, or t
  misc_feature (673)..(673): n is a, c, g, or t
  misc_feature (779)..(779): n is a, c, g, or t
cgggggggacggcgcccgccaggagnncccccactcccaggccagcccaccccggcggaccgggccccgcgcgcccaggcgaggtgaggcccgcgccgtcagggctgcgtggngncccgcncccctgcccngcccgcgaggaccgnngccnncccnngcganngcncccacccccgcgccccaggtgagccccggagtccaggtaaggctccgcgttgcaggtaagagcccctgagcgtagaggaggccttggcgcccgaaggtganagcncctcccctcctangggaccctcaactttcanggngaggcctcngacctcctccaggtgggggaccatctncccgatgaaccccctaaannaccagttaaccccactgctctccagatgaggtcgcaaggaccaaccagtgcttactcgctcatgctccnncgaaantgggaattgaaagctcagctnctccaaagctcntttttccagcttcagctgcnaggtcagcaagggtgaggccggaagcaggcgggtgattnaccctgggcatctccgagcntaagtttctccatggatgcaacctgaggcctcctcactgagtnaaaaccgagacgcctctggtccccggagaggctgctggctctggggaaaggagagagcagcccagtgtgacagagcgagtncccacggctctgggagtgcctcgcatgtgtgtggcccaggtcctgacagcacacctactccctccccggcaggcactgggctccctctgctccccgtgggccgctncccgcgttgggccacttcccccggcccccgcat

SEQ ID NO: 643566 - DNA, 262 bp, Homo sapiens
tcgatacgacttttttttacttctttctctctttctttgtagagacagggtttcaccgcattgcccaggttggtcttgaactcctggcttcaagtgatcctcctgtcttggccttccgagtgttgggattacaggcgtgatccaccgcacctggcccagaatttttcttatacttgaatacttcctatggattactttattttccttgaattaactccggaatgtattttatccccttctgtcgtcttctcgcaaaagtata

SEQ ID NO: 643567 - DNA, 110 bp, Homo sapiens
  misc_feature (14)..(14): n is a, c, g, or t
  misc_feature (43)..(43): n is a, c, g, or t
cacactggctcacntctgaagcctagcgctttgggaaactaangaaagtaaatcaactgaggtcagaagttaagagaccagcctggccaacatggtgaaaccccatctct

SEQ ID NO: 643568 - DNA, 574 bp, Homo sapiens
  misc_feature (494)..(494): n is a, c, g, or t
gcgtgcgctactactaccttcctgcaagaacttagacatataggatggcaaaagtaaaactaaaagaagccatgggctttctggtacggtggtgcctctccttgatgaacacatcttggatgaatccttccatttcccagcggagaatacccaataaaaaatatgtttaggcggggcgcggcggctcatgccggtaatcccagcacttggggagaccgaggcggggggatcacctgaggtcgggagttcgagaccagcctgaccaaggtggagaaaccccgtctctactaaaaatacaaaattagccaggcaggggggcgcatgccggtaatcccagctactcgggaggctgaggcaagaaaatcactggaacccaggagggggaggtggtggtgagccgagatcgtgccatggcactccagccggggcaccatggagcacggagtgaaccagactccgtctgcaatcccggcacctcgggagtgcaaggctgncggatcactcgcggttaggagctggagaccagcccggccaacacagggaaacccggtctccaccaaaaaaatacgaaaac

SEQ ID NO: 643569 - DNA, 210 bp, Homo sapiens
  misc_feature (82)..(82): n is a, c, g, or t
  misc_feature (89)..(89): n is a, c, g, or t
  misc_feature (103)..(103): n is a, c, g, or t
tctagaggacgggtctagccgcgcagtgtacaggccccggtgtgacaggtaggtcatgctgtgacaggcaccggtgtgacangccccgntgtgacaggtcggngtgacaggcaccggtgtgacaggtcggtcacgttggctccctggcacgcggcagagtggggaccgtgcccccgtgagtgtcacactggggtccacaccaggctgatc

SEQ ID NO: 643570 - DNA, 123 bp, Homo sapiens
  misc_feature (97)..(97): n is a, c, g, or t
cactctagaggatctgtatagcaaagaaaactcacatgtatatgagcgcactttatacttatattctgtacacgtataactaggtctaactatccanggatgcctccggcctcatttgaaagg

SEQ ID NO: 643571 - DNA, 352 bp, Homo sapiens
  misc_feature (347)..(347): n is a, c, g, or t
tacagaaaataattataattcattatagttactgtaaacatgtatacagcttaacaatatttaggtcacaagcgagacagtctttgagcgtcagaatagccttttaaaaatgggctaacactttatgaagtaaaaaggcaaataatcaaataatcattttgctggaagatgagtaccaatgtcatgataccaaaagtaacaagtaaactggaccttaaacttgttatatcatttgttcattgttattaaaatacatttagttctcctgcatcatatagaaaattccaatggggtaaagggatccatttaattatccataggggcccccttaaattctggatttggcncccgc

SEQ ID NO: 643572 - DNA, 260 bp, Homo sapiens
ggttactgcactgaccaacatggacaaaccccgtctctgctaaaaatcaaaaaaaattagctgggtatggtggtgcatgcctgtatcccagctactcggaagcctgaggcaggagaattgcttgaacctgggaggcggaggttgcagtgagccaagattgcgccactgcactccagcctgggcaacaagagcgaaactccatcccaaaaaaaacacaaaaaccatatacgtgtgtgtgcaacacacaaacacacatacac

SEQ ID NO: 643573 - DNA, 465 bp, Homo sapiens
  misc_feature (18)..(18): n is a, c, g, or t
tccccacctgtcaaatgngcattaagaattccattgtggtttgatacatggaggttctcactgtgttgcccaggctggagtgcagtagcatgatgatagcttcactacagcctcaagcaatcctcctgccacacctcccgagtacctggaactacaggtgtgtgccaccatgcctggctaatttttttattttattttattttattttttgtagagatggagtctcactatgttgcccaggctggcctcaaactcctggcctcaagtgatcctcctgcctcggtctctcaaattgttgggatgacaggtatgagccactgcacatggcccaagagtttttgtctgttagttttgttttttgagatggattttcactcatctcccaggttgcagtgagctgaggtcacgtcatcgcactccagcctggtcaacaagagggaaactccttccccgcctcccccacca

SEQ ID NO: 643574 - DNA, 304 bp, Homo sapiens
tcataatataatagagacattatatcgacctggtctgtcataatacagaagagacagtagatctagctggtctgtcataatataatagagacagtagatctagctggtctgtcataatacaatagagacagtagatttagctgctctgtcataccataatagagacatagagacagtagatttagctgctctgtcataccataatagagacatagagacagtagatttagctggtctgtcataacataatagagacagtatatctacctggtctgtcattttataatagagacagtgtcgacgc

SEQ ID NO: 643575 - DNA, 399 bp, Homo sapiens
ctctagagtatcccctagctgcataggtggataagcttatacactacgatcaagttggcttcatcccttggtatgcaatgctggtacaacatacgcaatcaataaacatatctatcacatagacagaaccaattacaataaccacattattatctcaacagatgctgaaaaggtctttgacaaaattcaataactcttcatgcttaaaactctatgtattgaaacatatctcaaaataattagagctatttattacaaacccacagccaatatactgaatgggctaaaactggaagctttccctttgaaaagtggcacgagacaaggattccctctctcaccactcctatttcacatagtattgcaatcatgctatcaggctggataacgaaatcaagg

SEQ ID NO: 643576 - DNA, 410 bp, Homo sapiens
agggaacacctgtatgctggagcacatgacagttactaatgcctgccttcacatattttgatctgttgatagacagatattgtcacagggtccttcctggttgtgatgtgcttggagacacattgaaggaacccttcccagaggataatgaatgctgtgtcatagcagggcctggattaaagaggagaagacagcacctgcaggagatgtaggaggctgtaaaaggagttaagagagcaaaggtttgggggactcccagggagccttatgtggtgagtcatcaatggagtacagcaggaggtgaccagagccgttcctgagggaactaaggttcacagagaaggttgctgtttaaggtcacaggtctaggagctgacaaagctggagtttgagccaagtctttggactcc

SEQ ID NO: 643577 - DNA, 161 bp, Homo sapiens
tctgtgtatcacagtgggcatggtggtgggtgctagtaaccccacgctgcttgtggacggctgttgcaggtgaatcgcttgaacacgggaggcggaggttgctgtgagccgacattgcgccactgcactccagcctgggcaacagagtgagactccatctc

SEQ ID NO: 643578 - DNA, 309 bp, Homo sapiens
ccccccccccccccccggggttttgggtttcggcccccccagggggcttttttttcccccaaaggcccccttttgaacccccttttttcccccaggttttgggtttcccttagggcccccccttggggttttccccgggggggggccaattttttttttttggggggcccccttttaaaaagggtaggttttcgcgcccccccccccccccccccaaggccccttttttttgggggcccccaaagggaaaggtttttttggggtttttttttttaaaaacgggggtttttttttttttttttaggccca

SEQ ID NO: 643579 - DNA, 161 bp, Homo sapiens
tagtagtgctcggtccctcgtacgcggccgcggccatcgcacacctggaagcgcgccgcgctcggcgacgtattgcgggatcttgccgctatccaggaagtgctggtacttctgcggcgtcatctgcggccgccaggtgccttcataggtttgcgtcaata

SEQ ID NO: 643580 - DNA, 117 bp, Homo sapiens
gatatggacatatcacactgatcactttgagttcaagtatgcagaaccaaggagaaaatgaaagtttcagagataaaaataggcttaaaaattaaaatgtgacaatgtaaaatctta

SEQ ID NO: 643581 - DNA, 168 bp, Homo sapiens
ggaccaaacatcacttatcgtgcagaagatcacttatcgtgcagaagatcaccgatagtgcagaagatcacctcgtgcagaagatcacctatcgtgcagaagatccaccttattgtgcagaagatcacctcgtgcagaagatcacctatcgtgcagaagatcaacctt

SEQ ID NO: 643582 - DNA, 274 bp, Homo sapiens
ttacaaggtacgcctggccttgaactttctaaggaaattcaagacagtctatcagaagtaaagtggaaaatagctttacaaggtatgtttggccttgaactttctctagtgttagaagcccttttgttccttttcacatgttatcaagtggttaaggcagggcggattctagatgaaattcaggacaatctatcagaagtaaagcggggagagagagtaggagcaaagagaaaatatggtacacaaaataagtcgtatcgatgtcgagcgatcg

SEQ ID NO: 643583 - DNA, 479 bp, Homo sapiens
  misc_feature (32)..(32): n is a, c, g, or t
  misc_feature (69)..(69): n is a, c, g, or t
  misc_feature (474)..(474): n is a, c, g, or t
cgcccccccattttattccctaaattaggccngcccaccaagggttaaaatttggctcacaggggaatncccttatggaccaaaggaacttcaaaagtctttcacatgaaaccaaatgcataaatgattgctttctctgtttcatgtttcacttaagccgagattaaggtataactgactattcctctactctcctctcacatgtaaattgtatattcagtgaaaggctaatcagaaactcaaaaaaatgcaaccctttctctcttacctgcctatgcttgaagcccctgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctanactga

SEQ ID NO: 643584 - DNA, 182 bp, Homo sapiens
gcggcccctactactatctactgctcgaattcaagcttctaacgatgtacggggacatgcctgtaatctcagcactttgggaggctgaggtgggaggattgcttgaggccaggagtttgagaccagcctgggcaacgtagagagaccccatctctacaaaataacaaaaaattagcaaaaaa

SEQ ID NO: 643585 - DNA, 454 bp, Homo sapiens
caatagataaaatggcagcaaaggtaaaataactgcttggaatcaatcacttctggggccaagaaaaattgtacctgagcttaatacagctcatgagttgcacttcttgaacagtgcagtttatgtggccccagaagatggatcttcttggtcatcttggtggatcttcaaagatgatgaaatacagttttcaaaaagatacagaaacacacacacacacacacacagatataaaaacatgactcacatagaatgactacatgtcaaagatttatttgactcattaatgagggacctagcaagattgtaaatctgattttgtgcaagtattgttttcttagttatggtactaggttgtaggtattaaggagattgtcattatagaatacttgctgatgtgtttagggatgagggcttataacatctaacttcagtttcatgtagttctgcaaaa

SEQ ID NO: 643586 - DNA, 237 bp, Homo sapiens
gctccttggagcaaaagcccactgactgctccatcgaatgagtcactggatctggaggacctgtcttctggtgctgggtgttgaccagctgtatctgggccctgtccccatgttagagcatcagatgcggtcttcgacatcctgccaggcccacacagctgcagtctttcttgctcccttcagcccgcatcccctcccctatctcccaccctgtacctcatactatgataccctctt

SEQ ID NO: 643587 - DNA, 1030 bp, Homo sapiens
tcacacgtgggtcacgaatactggcgaaaggtcccaccttatgcgtttgtccccactacagggagggggtcccatccttcaggggccgggaacggaattcggcgtaggacgaatgaatctcctcgtccttccaaagtctcgcccgtcccgggccccaacagatacgcaccagggaaagagttcacaccagggctaagaggacttaagagggatcaaacccaaaaggcaacacatcccgggcaattggactctcggaacaaattttggcagagagtacaacgaagaatcttaggcgggctgcacccagtttccaccacgataagggtcttttacggaataaaggaagatgtccgtgtcctgtagtgttcctgcattttcgggacagaatggaatctcagaccttgtgcaggcggactctgacttctgaggaagaggcccgtttgaagaagagtgcagatacactatgggggatccaaaaggagccgcaatctttaagtcttctgatgtcatatcatttcactgtctaggctaccacaggattctaggtggaggttgtgcatgttgtcctctttttatctgatctgtgattaaacgcagtaatacttttaagatggactggggaacaaacattcaactcctgaagccttagaacaataagaatggtttgctaaaatccacagctatatcctgactgctggatggtattaatcttgtgtagtcttcaactggttagtgtgaaatagttctgccacctctgacgcaccactgccacatgctgtacgtactgcatttgccccctgagccaggtggatgctttaaccgtgctcgcttatataacttcctggctccttcacgtgaacatgcctacgtccaacattctttcccagtgagtcacatcctgggatccaagtgtataaatccaatccatcaatgtctttgtgcattaattcttcccaaggatcttattttgtgaactatatcagtagtgtacattaccatataatgtaaaaagatcaaatatccacacatg

SEQ ID NO: 643588 - DNA, 897 bp, Homo sapiens
gcccatccaagacctggtaggccctgcgcgtcgctcacggtcgtctctatcaagagagcgacgcggaaccgagaaacagcacccaggactatcttctcaaaggagttctggatattcctacaatgacaagtctctctcagcgctgttgagcattggcctgacagagactccatcccaagtggtaaaacctggcttccagttctgcagtataataacagaatgcttcacggtgtcttcgcaatgcttgcatcgcagtgtcctagtgaacctagcaattcatatccagcggaactttggcatgacgattcggctcgttgcttgtccgaatcttagcattacttactggcttgtacgtcgagactgacgcagttgggaaccccggaatctcctgtagacagctgttgacgcctagatggcctgcacgtttgctacgcgcaacattgggctacacggagaatgaacgattctccagtactatatgtattgggtagcatgctttacccagaaactgtgagccacgtcttgcttacaatcatccggacaaaaaacattgttgcctactcttcaatgattaggtttacatcccttaatcatgaccacgaatgaaagaacctggaggagaaacctcaatattgcaattgatgtcatagatgctttaccacaaacatcctgaatcaggaatggcccgttcttgattcatcacagacctctttctgaaaagcccggacatggtacaagccatgtatcccaaaactgaacaattccacgaaagagttacaatggtaagacttatgataggcaagataacgagtgatgagcccactcaccaagggactgacatacctgttgttaaaggcggcatgcctgcacgttgcttgcaagcacctttgaggaatc

SEQ ID NO: 643589 - DNA, 683 bp, Homo sapiens
ggacgcgtgggtcgacccacgcgtcgcggacgcgttgggaaaaaaacaaaaaaaaaaaaaaaaaaaaaaaaaaaaaaagcgggccacacaatagactatatacctatagaaggggcgcaaaagagaatacgcgacaccagatttttttgacccagaagaggccgctagcaattgatagaagctagattagaaatgaaaagagctaagacctgagttataaagagtagtcaagatggaatatatcgcgggacgctggggaaaaatttggagctaaccgcacccgcttgattaccgcgtgagtctcacacatctcatggtgtgcacgacggagagcacaagaaaagatatattaaagagttaaccagagccaaaactatatacactgtctaaacccggggttaagacatgtgtgtattcacacaccaaaagcgcaattaattccagctgaaacgtataggcaagaatgatgaggaatatctacaaccaccaaagcctactgaccgcccccccccctctttgttctagtcccccggggcctagaactcctccgaagtaaccaacccccacggcatcagacttctgcacaaccaatacacaaccacccacaaacactgcatcatcatccccccgaccccaccatcccacccacccgcccggccctagcaaacgacccagcccccacc

SEQ ID NO: 643590 - DNA, 598 bp, Homo sapiens
ttgactcattatcagtaattttcccagaggaacggcattactggtatccacagtaaaggtgcacagtggttactgatcctatacaggatctttctaattaatagaacaatgtatcattaaacaatttggtaagcctattaccatgtagtacatatcgagcatggataagttattctcaaatcaacgtactttatatatcataaatcttaattcaagaacctaaaccaaatattacagacagattttattgcacttcacgtcaatgcacttcacagatactgcctataatatatggagacagagtcttgctctgtcacccaggctggagtgcaatggcacgatcttggatcactgcaacctctgcctcccgggttcaagtgattctcctgcctacagcctcccaagtagctaggactacaggtgtgtgccaccacgccaggctgatatattgaatttttagagagactgggtataaccatgttggctgggctcatctcaaactcctgacctcaggtgatccacccgcctaggcctcccaaagcatagggattataggcgtaagccaccatgcctggcctatttacacactttaaagcca

SEQ ID NO: 643591 - DNA, 241 bp, Homo sapiens
actatagactggatgaagtgttagcatgtactgctcggaggttgggttctgcatccgaggtcgcacccaagcgaaatttagaatgcaggtctggtgagtttaggacctgtgggtttgttaggtactgttgcattaataaattaaagccccatagggtcatctcgtctcttctctatgtacatctcgtctcttccttgtacatctcgtctcttctcttgtacatctcgtctcttctcttgta

SEQ ID NO: 643592 - DNA, 309 bp, Homo sapiens
tacttctctgcacacttgtactgggatttgtagccaggacaattagaccagaaaaagaaataaaaggcgagatttcagtgggaaagaatagacttttccaccaatgatgctgggacaactggatatccacaggagaaaccatgaagttgagccccctactcccaccatataccaaaattaactccaatgaatccattaaatgtaagagctagaatcatagacgtcttagaagaaagcctaggcctagatcttcattggcttggattaggttatgatctcttacttataacaccaagagcgactgacagt

SEQ ID NO: 643593 - DNA, 846 bp, Homo sapiens
tatatcaggtgtatcctgacacctaatctttaggctccggcatctcacgttacaatcttgttctcagctagtactcgcatgagggcttatctacttggctagttgcaagatccttatagtggcagcctactggctcatgcactgacacttgcctgtcaaccaatcatgtctctacgcaactggtatctgtcgaagctcttgcctgaagtttgtatccctatccagctattatttggattagtttttggtgcaacaccgggcgaattagtcgctcctggacttatggttacaaacagtacaggacttagcccttcttctccgagaggtgtggcactcgagagaagtcacgctcttgcgcttcctgaccgtatgccctaggatagcagacgctcgtggttccccgtgtctcttattcctctgtagatcctctcactacctctaaatgtacacagctctttcccagtggtatgttgctctaggcgtatatactagtgcgaacgagaatgaaaccaccatgtattcgatgtttttgagcaatgtagcattcacaaataaatttcactgcacgtattattccttaattcggatattcgtggatgatataaggagcgagatcgatcctcttgtgatgggtattctaatggcacgtttttattaatttaaactggtccgtaagaacgagaaggaagttggactcgcgtggggattacacctgtctgtagaatgtgtggtcccggagggaagcacctgacgcatttgaccacagggtcatgctccacttatccctccaaattacttacggccgcaacagcgctgcgcactggtctgaacctggagcaaacggat

SEQ ID NO: 643594 - DNA, 208 bp, Homo sapiens
aataccaaatactgccctcctcctactaatagggtcaacactttactatcttcctttaaaaatatatttaaaattagtttacatatcttcccatacatataaccattttaataatgtattaagtgtacagtgaagtggcattaagtacagtagagacaaaacatttgtgtaataatggatcccctatccacccgaggcacgaacttcg

SEQ ID NO: 643595 - DNA, 423 bp, Homo sapiens
  misc_feature (7)..(7): n is a, c, g, or t
  misc_feature (58)..(58): n is a, c, g, or t
  misc_feature (410)..(410): n is a, c, g, or t
ggatagnaaaaaaaaacatgctgggcattacaaaacccctgtttccatggctcctcanattgtaaagtgcctatgtatgggagacctagtacaatcctcctccccatgaaatgtaatggtgtcccattattcccggtgctggctggatgcagtggccccacgccctataatccccagcactttgggaggccaaggagggtgaatcactgaggtcaggagttcaagaccagcctggccaacatagtgaagccctgtctgcactaaaaatgcaaaaattagccaagtgtggtggtgcacgcttgtaatcccagctacttcggaggctgaggtgggagaattgcttgaacctgggaagcagaagttgccgtgagccaagatcacttcactgcactgcagtctgggcaacaganaaaggccctgtct

SEQ ID NO: 643596 - DNA, 239 bp, Homo sapiens
gacctaggtctgagaaggttgctgggttcctctgcagacattcacccaagcatcaaggggctgtcaaggccgtagcatggtgtccctggcagtccaatgtcctggcaaggcggagggggcaccagtgtatcgacacattcgcatcttggaatgtgtgctctagggcgcctgtctgagtgccgtggcatgcccgattcccagtgtgtgctccgatccgtctggttcatccccattacaag

SEQ ID NO: 643597 - DNA, 108 bp, Homo sapiens
  misc_feature (6)..(6): n is a, c, g, or t
  misc_feature (31)..(31): n is a, c, g, or t
  misc_feature (64)..(64): n is a, c, g, or t
tcgaanttcaagcttctaacgcatgtacggnggacatgataaaaagaaaatgtgatgttgtctntcccttctcttgcacttttgaaataaagtatttatctcctgcca

SEQ ID NO: 643598 - DNA, 448 bp, Homo sapiens
atggggggttgtccatcaaaggaccaaaatctcagatggacaggaggaggaggttttgacatcccgtgcacagcagggtgaccagagtcaatgggaatgtactgcattgcaaaacacctgagagagtccatgtcaaatgtctttttgcatttacattagagaggatgaaggccctgaggtccaagaacattgaaacctgacaggtcagtcatgcgtgtactccaacagctgcgggtaggggccaggcaagatgtccacactgccgtggcttcaaaggcatcctatcccaaggggtgaactgaaggacagcctggagcttcctggagaccagagggcccctccaccctacctggagcaacgccagagcctggactatttcctgcagcacttctcccctgccctgctctattttatcttttttaataaagatgactcctgaaaaaaaaaa

SEQ ID NO: 643599 - DNA, 299 bp, Homo sapiens
  misc_feature (249)..(249): n is a, c, g, or t
gagaggtgtgtctccctacacatgtgtacaacatatcctcatatttcttgggagtactttttgtatttaatatgtaatgtctttgaaatgatacactgccacgctttctactactgtgctctggacatgccacctcacacagctgtgcatatggccagcctggtggagtgaaataggaattcaactttcattttgttccagatggatagccaatcatggttgattgaactggaaatctaagttcctaanatacctacaacctctttctgaattctgttgtgtaagtaagcattcttttt

SEQ ID NO: 643600 - DNA, 1108 bp, Homo sapiens
aggatgatgaaaataactggtctttgacgatgagggtaatgtcctgctatgtgcgttgtctgcagaggatctaggacaaaagctggaagcgaggtgactcgttcgatcgcatgtgcagcgtgccacttaaatgcctgcatcgcgtatcgctctgccctctctggcacagtatcatgtcatcttactatgaaccacagacttgcgtaagctctatgggcgtgttgaacgatttcaggggaaccttggtagcgccatcgcataggcacgcggtcgtatgttgtggaaaagccagccatattgtgcctcgctttctacgcctttggacgttggggtggtgctcggattatgcggagctctggattgggcgcatgtgcttggttggagtgccctcgtcctcgttctttgtggcatctggcttggccttggcactctgtttggtccgatgcatagcgagcacgtctttggggtggcggaccctcctcgtgcttatgccatgtgtcgtcagatcattagggttaactgggtcctctgctgctccgtggtacctctggaccacagtctgcatgaggctgctggttgggaggcagggccactccgttccttcctggtgtgggagatgggcatctgaaaagtgggaagtcaggtgtgctcgaacagggggtgcgtctgtagcggcaggcgtgtacctcgcgctgaggttgctatgatgccgtgtccttgattctgcggctgaccgccctggtttgtatgggggccatttgctcgggtggaagtcaggataccagcgccttgaatggaagatgttctcttttgtgacattatggcttcgaacagagtattaactttggggtgcacagttgggagaattgcctgtgcccgaaggggggccagccccggtgcccctacgtataggtcgggtatggggattcctctgtggggtgcgggagcccggggggcttcccccccatcaggtggcacaaagtcacgtgcaagtggtggtcttgaaccgcaattaccacctatatcagaccccaccaacggggggattccccgacaatgggcctccggcgacgtgtatccaccttgtgtgtgtacagagggtgtcacc

SEQ ID NO: 643601 - DNA, 186 bp, Homo sapiens
  misc_feature (8)..(8): n is a, c, g, or t
ctacaggnagagagaactgtagggcaggataaggggatggagaaaaagtggggatgggaaggagggactctctcttgtaagccggctccaggacttcaccagattatttatttatgtgttttgtgtgtgtggctagtatttttttttttttttttaaaacggagtttctctctggtggcccgggtg

SEQ ID NO: 643602 - DNA, 1079 bp, Homo sapiens
ttcccctgttccgcatctgcgttgttggtgtgttcagactttggttgccgcttgtgggcggggctccccatatcggcccgcgttgggttttcgtttgcctcgtgcgcgcaactggttgcctgggccgcttcacttagcgtgtcagtcctcgttcctttgcgtggcccgttgtggtcgtttcgttccttatgcgctcgtctgtggtcgcttgcgtacgccgtatttgtgcatgccgtgcctttctccaatctctggtgcgatggcacactgttgtgcccgcttcccaccgtagggtgaaggtgttcttgacggttggcttgtcccctttgcggttgactcccatgtttcccgcttcaagtctctcgtgtgcctaaccatgtagtagtgtattagatgcatgtggacgaaagtgatgatgaaggactttgttcgtggctagcggacgcactccgatccgcggattacctcccatgtatctagtttctgtgttcccttggacctatcagcgggggacccagctttctagcgcttcgtattgcacaagtcacctgtgaactgcacccgactacagaatctggtagaatcggtctggccttgcgctcagtccctcaatgcaaaggtaacttgttcgtcgcaaccctttcaaggagaaaagtagatgaggccagttaatgtatcacgttcatatcccaccctcgacgaatccgcttacaggggtcaacatagaacatggatatgcccaggaacatcacctaccaatcatctcctagaattgcagagggtggtacaacgcaccggactgagtgaggccaggattcttatccagtccacctgagggactggcggcaggactcctgtttcctctgggcctctatttccacagcctggtaatatgggggcaatagtcactatagccagctcaacagggaggatctaagcatcagaagagctcacatcaaatagacgtaaaagtgactaaatagttccataaggcacgctggccgggcgccaggtagactcacacactgtaatcccagcactttgggagccgaggcggaaagatcacgagtcaagtagat

SEQ ID NO: 643603 - DNA, 1069 bp, Homo sapiens
gccggcgcgcccaccccgagccccctccccagctgtggcgccctccacgacgaaggcctgtcgtccttcgtaacgtgtcagagtgaagacccccacggcggacccccatcatgcccactggacaacatcaatgctcccaccaggccgtgcccgtcccaccatgcctcgctgggcaccgggtgccctgggaggcggctgccccagtgcggcgccgggagccacctgcaccgcacgccaggaccaagatacattcacagtgtacatcacagcccggtggcagaacatgccagttgcagggcgccacatggagcccctagaagaggatggacagccacctggggccaaagcaggaggtactcggatcaccaccaacgtactgaactgccccccgcactcgggccagaacacattggctgagaagaccacgaggtgacaaagtctgcatgtccgaggcacggacccctgcacttgggagcctggcgcgaccagacgctgcaagaagctaagtgatacagggacctcaagatgaaggactcccggaagtcaagacagctcaaagacgtgaacgatgcaggttgggccacccggaccacaaagtgccgaggtcaagggcagtggaggacggcccgcagctatggaagcccacagagcccaccatcagcaacttgaacgcccacaccatgagtcagtgggagctgaaccctttgtggtccggaagcaccaaacagttctacaacacttacagaggcctcaaccagtcgttcacaaactacccctttcataaggaacgggttacaaagaggtgccacaaggcacagtgggacaaagttaaatttataacacttgtaaaaaggcgtaaaatggaaatagcacaaaaatgggtaaagaataattggtgtgatgtcaaaaagggttatataataaaagcgtgacaggtagtcagtttataacacatagaataataagctggttacgaaacaaagcaaagtagtgacattagcatgaatagaaggataaactcatgaagtatgagaataggagagcacataggggagagacaccacaagag

SEQ ID NO: 643604 - DNA, 511 bp, Homo sapiens
  misc_feature (11)..(11): n is a, c, g, or t
  misc_feature (38)..(38): n is a, c, g, or t
  misc_feature (41)..(41): n is a, c, g, or t
  misc_feature (77)..(77): n is a, c, g, or t
  misc_feature (96)..(96): n is a, c, g, or t
  misc_feature (123)..(123): n is a, c, g, or t
  misc_feature (149)..(149): n is a, c, g, or t
gggttgggccnaattaaggaaggaaaccaggctgcctnaancaacaaggggcaaacccggttgggtccctttccacnactggggaagcttttggtnctttcggtctttgcaattaattcttgntgctggtcacttctttgggtccacantgcctttatgaagctgtaacacttcaccgcgaaggttgcagcttcactcctgaagccagcgagccacgaacccaccaggaggaacaaacaactccagatgcgctgccttaagagctgtaacaccgcgaaggtctgcagcttcactcctgagccagcaagaccacaaacccaccagaaggaagaaactcaggaaaacagccgaacatcagaaggaataaactctggacacaccacctttaagaactgtgacactcgctgcgagcgtctgtggcttcattcttgaagtcagtgagaccaagaacccaccaattctggacacaattgcactctagcctgggcaacaagagtgaaactccatctcg

SEQ ID NO: 643605 - DNA, 122 bp, Homo sapiens
ccagaaataactgtttgagaactagctttgaataataatttttcccttgtacatgacctgctgaactttcgggtacagtgttttgggtagtaacttatttgtcatgcacataatgtatattt

SEQ ID NO: 643606 - DNA, 297 bp, Homo sapiens
  misc_feature (20)..(20): n is a, c, g, or t
  misc_feature (65)..(65): n is a, c, g, or t
  misc_feature (156)..(156): n is a, c, g, or t
  misc_feature (251)..(251): n is a, c, g, or t
aaaagcaaaacaagaagatncatcactttttcaattgaaaagaaaagtgtagagcatgactgaantgctcatcatcctgggagttccccatgtagtggctatgcagtgtggaaagtgagaaaaacccccattgtggtgaggagaatacttcaatgncccttgtccttgtcctcattaattcagctaaaggtggatttgaccaaaataatgcatggttaaatttgtagaaatgttgaaattggctgtgtttntaattttgcttgaatttttataaaatgtttaaccaaaaaaaaaaaa

SEQ ID NO: 643607 - DNA, 116 bp, Homo sapiens
catggatttgctggtgcagtacaactaggcttaataggattcaagcttctaacgttagaagccttgaattcgagggctcgaattcgagctcgaattcgaggtgttttccaaaaaaa

SEQ ID NO: 643608 - DNA, 194 bp, Homo sapiens
ccgcgctgtccccagtgacccaagctcagtgttacatgtactcccgtggtctctggtctgatctgatccgaaaatagcgatcatgagatctggatacggaggctggggtctgtcgcaggctgtagaaccggcgtggtgctgcctgtctttgcgtgctggtggcttgttccgttgccaggccttctgtgcccatc

SEQ ID NO: 643609 - DNA, 624 bp, Homo sapiens
  misc_feature (171)..(171): n is a, c, g, or t
  misc_feature (188)..(188): n is a, c, g, or t
  misc_feature (350)..(350): n is a, c, g, or t
gaaccaacaacacacaagcaaccaattggtgccagtttcccccagggttttgttaattatagcaaaagccttggccacccccaaacctagtctggttaggtgagcccctgtaaggcaggaacaggcagctcagcttaacaaccattggttgggggtggggggtggtttagnggggaccaccccaaatncagccaatgttttttgggaagaaaaagcctgatccatcaccatctgcttggatatgtaggttggattttcctttggacccatccccttcgatttgggtttaccttcatctattttgatccttttctggccaaaaatccttttggggccaaatgaacattgtnccatagttttttggaaaacaaacatgcttcctgctatgtaattgctaacattcaaattaaatgatgggctggaggttgattttccttagccccctgccccttaggcagtaggttttaggggggatcgtagggccctttgattaatttaaggatttaattttcattttccttttttgggtttatttggcctttcaaatgaactgaaattcctgttaaaaaaaattgatgttatttttttttgtaaaggaaactaataaagtgtgtgggcctttta

SEQ ID NO: 643610 - DNA, 394 bp, Homo sapiens
cttgttggagatactagttcataattttaaaatatgcaaaattaaggtgaaatttgcactttatagtaggatgagaatatactattatcaactagctgcaccatttgcatttggaagaaaagaacagataactggttcattcccaaccaacctattcatcccagacaaatgagatagaaattcctatttcagactacaatattgtaacaaacatgctttaaagttgcagagaattccattcttgatgtggtgatcaaaagtaccgtatacgtggcacatttatggaagcctaggtaaaatactgaattcttaacacacttctatataaaatgtttgattgtgtcatccacgcaataaatggtaaaatgttagagattcctgcaggtaaaataaa

SEQ ID NO: 643611 - DNA, 1507 bp, Homo sapiens
ggggtattcttttggtgctagatcacacaccaactggtgttgtcgcgtgccacacatcagcggcgtgtctccgcataagtgctccccccccctctgttttccgcgggttgtgagatgaccggggggcgcctgggtggtctttttgggggggcgccccgcctgtcttgcggcgactacgggggccccttatttatgagcggcgcccttttctacaccgggggcctccctctttgctggggatattcctacggggccccctgctgtagccgcgcgtttgttccccccgtggcgatgatgtagccccctcccggtgttcccccggggggcccccctccacacctcgggggggatatccccgcggggggtttgtgggaaccaccagcgattataagagttggtaagggtcccaacgagtgtaataaaggtacccccgcgggttataaaggtggcccccccacaccccgcccactagaagagggtgtcactctcacatctgtgaagggggacaacaacggagagggaccaacacgtgtgtcccacaaaaggtgagaacaccaaaacatggggggagagggatgaagcccacgccccctatagccgccccctcggaatggggagacacaaagcacattggggcccccacgcaaaaaagggagggcgcccctcttttggggaagtatttttccccgccgagatctcgtcgggaaattgggagataaagagagaacagcttttgaagttttgaagaaattcctccccggggaaaaatttttggtgagaaacccccccctgatgtttctccgcggagagggcggccgcgacccgcggtgaacacaaaccccggggagagacgtgtctacacaagggttgagagatttttccgcaccagggagcgcttttcgcacaatctggcgtcggtgacaccctcgggagacactctcatttggggtgtgcgcctctcatagagacttttccccaccagttattgccccaccctgttgtgtcgctctatgtctctctctgtgtgtgataccacacagccccacacagtttttctctgagagtgcacccacattccccctctgtctcgtcgtgggcctcatactctaacacaggggacacatagctgggtgcccacactttctattacagcacaacgtatagcactataatttccacacaccttataaatccaccgcacgagattcccactgtctccatcgccaccacagtgtatatttgcgctctgcgcacacttgaggcggtataacacaatttggcgcccacttgagaaggaggccattttcctcggtgctttgttcgggagaaaatatttttctttcacactgtttctgaagagcgctttcacgaggtctaccccactttctctcttctcgccactgtcctcccaaaaaaacgggtcccctggatggtgtggtcacgcccattttcccaataccagtttagaccgggtttaaataaaaaaaaacaatcatagaaaaccaca

SEQ ID NO: 643612 - DNA, 220 bp, Homo sapiens
agcataacactatttaataaccacgagtaatctctataatattggtacctacccttgtatataagataactaacttcaggtgacatcatgtcagccaagtatctggcatagtacctgtcatgtcaatgtccagttgaacagatatcgtcaaattttctggactcatgagcaatcaacattgattagggagcaataataagccacaggcttgccagctctg

SEQ ID NO: 643613 - DNA, 105 bp, Homo sapiens
cttctctggctccattctcaggcacctctctcttccctgatcatgcccctctggacactagatctttgcaatttcctccctcaaaacccgaccctagtcttcccc

SEQ ID NO: 643614 - DNA, 372 bp, Homo sapiens
gtgagcgttctagagggtcacaggtgcatgcgagagcagaattgagtgcaggaaaagggcggggtgtgggtaacatttgttctcgttaaacacaagtacacatattacaggctacacatgacacaagatttagcaaaataaaggttcatgatatgattgaaatacagaagtgtctcagctacataaatgattttaaattatacagtaagtgaacgggtgaaataaacaaagctatagcttatagaaagctcaaaaccgccctctgacatcgcttcgcgaaagacctttctttgcccagggcctcctcaccaaggcctaacagatggggatgtggttctgctaatttatcgactccgcaggtgaaatggaact

SEQ ID NO: 643615 - DNA, 310 bp, Homo sapiens
ctcgactgtctgtaccaagatatctcttcaactttttcttcactgtactgaattggtgactaaaaatcatatttttgtttttgctcaaaaagtcttgacttgtaaatttttcagtttctcctttatccacaggtaactctttcctcataaggcgaattgcttgcttccttgagttctgctctcaaagatacccttcattttctacctaatattaataactttaatcattcattattccattactatgctctatagtgtatacaatttctgttctttgtcatgttattaactaaattatttatttgttcca

SEQ ID NO: 643616 - DNA, 102 bp, Homo sapiens
gcatgtatatgagtgccgcctgtcaaacaattggtccttcatatataaacccattaaatacatttttatggtaacctatgttttacagtggaggtggtatag

SEQ ID NO: 643617 - DNA, 655 bp, Homo sapiens
  misc_feature (353)..(353): n is a, c, g, or t
  misc_feature (356)..(356): n is a, c, g, or t
  misc_feature (464)..(464): n is a, c, g, or t
  misc_feature (547)..(547): n is a, c, g, or t
agacgctacttccccgtatcatagaagagcttatcacctttcactgatcacgccctcataatcattttctcttatctgcttcctaggtcctgtatgcccttttcctaacactcacagatcatagaacgtacactatatatctaacatcttcagacgctcaggaaaatgagaaaccgtcgtgaactatcactgcccggccatcagtcctagctccgtcatcgcccatccctatcccttacgtcatccgtgtttacagtaagcagcacggagcgtcgacgtatcccctccctgtatcgcattcgaatacttcgaatgtgagccacgcgaagtgtgtgactgtgagacgctagcgngantgacaccgcagctacggcgggcgactgaatctgtcatatgtccttacgatactgtccgcccgattattccttaggagagcctagcgcgacccctggcgcatcgttccntttgtagcggtgtgtatccaaatctggaggtgaggtaactgcccggatgtgcaagaccgcgcgcacttcgggtagtaactaantgtgacgatccaccaagcacggtccttggcatcttcatgaagcctggtcacccgagcagttgagagtgcgttcaagaagagcagtaatggcataatatccccgggaac

SEQ ID NO: 643618 - DNA, 271 bp, Homo sapiens
gaattttgaaataaactctttatttaaactttcctttccacatttatagtttttggttataacgactgttgaaaatcatcttccatcacccaattttcttgcactgtttgatgtgcccttcaaatataatgtattgggttctaagatcgatcaaggcgcttctctttctaaattggatcccagaccctttttagtgctcttactgcatcctcccagccattatgtgatatcttcactgttatttcttcatcgtgaacctggggttctaagt

SEQ ID NO: 643619 - DNA, 256 bp, Homo sapiens
gggttttgggggggggccccatccctaagggagaaattcccccaccccaaggatttttttctttggtttaaaacgggccccccccttccccccccccccggccaggggggtttttggcagggccttttgttttgggggaaaaacaggggcccccggggtgccctttaaaaacaggtggggtagccttttggggtttgggttttttaagggtttttttgggccaaaaaaaaaaaagggaaactttggttttttttta

SEQ ID NO: 643620 - DNA, 185 bp, Homo sapiens
  misc_feature (79)..(79): n is a, c, g, or t
  misc_feature (180)..(180): n is a, c, g, or t
gtcgagaagccccagttgtccctgaagcctcccctcagtcgggccctcctcccgccagccgtcccgaacggggccgttntcaacttttaaagggagcggcccacgctccaagcgtggggagcgcccgaggtcctctcgccacgagctggacgctcttcaggacgtttcaccgccccctcnccccg

SEQ ID NO: 643621 - DNA, 110 bp, Homo sapiens
tcccagaggtagccgtgatggagggcaaggacagctaacttcactttacacccttgtggtactgcttgactttttgataaaagtctcttattttcataatttaaaacatg

SEQ ID NO: 643622 - DNA, 211 bp, Homo sapiens
atgagtaatcttggtcaatttggtttaagtctcttctatgccatcccagggaggaggatgaatctgggtatccagggctaagtgcgagctgcagtgcaggatgctgagtagtttggggcagcagaggagagggaaggagggagagtgaaacaataattcgtaagtgttcagtttctacacaactttatcatccgccaagatttactcatcg

SEQ ID NO: 643623 - DNA, 1706 bp, Homo sapiens
acccaagccaaagggtatccagctttataaaaaatacttccgcaataaacaactcatgggttattttcagggcaagggacatggggcagagacaactcggctaccaggctattaacaaacaacttttacaaactctccctttcttctcaaggtggactatcaccaaaaatctcaagaaacgccacataataaacacccaatggaatgtctctcaactcgtggagtgcctcgtgaacacagagggcaaaagagttatagaaggtggagggttgtgcacatattctccacatattgataggccagtgtgtgggttatcacacaaactttttctccacaagagcccgacaccccgtgaaacttatctcgagcgacagagcgtgcacacagtgaacacagaggtggacagagaacttaacctctgagaagagatctcgcacacaacctcataagaacatgtgagacacccacgggggcctctttgtggaaacaggggtgccacctctctcagcgggggacatctcacggggagaacagggtctccaagattgtggtcctgtgagcaccacgcggggtgtaacacccaagagtgccaccatagggggggcctagagggtgtctctcacaaacgagacagtgtctctgtgggggctcttatagagcgggggagattaaacagtctccatagtgcctgtggcacacagcaagttgggcaagagtggcgagaaaagagagggacaacatttataacacaccaaacattgggcgtggtttgttccattatataacaccaacgacagggggcctcttggggggtcgcccacaaggggtgcggcccacagtgtgggtgtgctccaaaagggctccagcggggaaaaatcgccccccttccctctaccgcggtgggggcaccgccccaacaggaaagggaaagagtgttcctccctcccaaaaacacctacagcaccggggacacacccgggcgggatataacctcccacacatttcaaatctccccaagctctctggggggagcggaccccttgtgcaataacagagggggacactattagtggcccccctgttctccccccccaaaaaaaataaccacaacaagctgggcagagggtggctcccgtggtggtgtgcctatacacaacaacacataatagcttttttctctaacacagacaaccaacgaacacagtggtctaccacacacaagcccatcgcgcgcattctttgtcataactaaccgactggtgagactaaaagaaatcgtattgagtagtatccacacacgttggtgttcagctgccccgacaaaaatatctacccaagggcgtatcatcaaaaagcggtcgacacaaccttgcacacgtgtggcaatcatccgaacaggccacttagacaaacttctggtgcccagagaccagtatggtagaacacactccaccatcacggaggagcgagaatatacccccgcctgctgcagacaatagaagtaccaccattaacccagtggggaaacgacgcacccatacagggagggcagcaaagcagtggcacgcctggtgagagcaacagcaaacaaaacggaatatatggtgcgacacacacagggaaacgacaccacaccaacaagcgagagacgggaagcacagacgtaggacgacgacgacgtaggggagcgtacatagacaacacca

SEQ ID NO: 643624 - DNA, 912 bp, Homo sapiens
  misc_feature (16)..(16): n is a, c, g, or t
  misc_feature (54)..(54): n is a, c, g, or t
ggagacctaggtaccngcgtccggagattcttcgggactgtgaagaacaccaantggagtctggctgctagaaaacgatggcacttcgttcagtgtggcgtgtgataggtgcttggcatggctgtggagggctacacacacatgtacccaggaaaccatggatctggtgttgtgtgtctcataggcaagctctagatatcaaagccttgtgaacaggacagcatgtatcctagagatggcacagtaaggcctagatgtacttgacatgtctggagagtgtggtcaagatgtccctcaaggtcgagtagatgatggtgcctacatcttgattggatgtcgaaagtgccgtaccgttctctattgccttgaacttccctggaagccaaacaggtattgcagatgggcaggtatagtctcgtggtcatacaagtacacaatcactcaagtggtgagccatggttgtgggggaaggacatgccatgtgtatcctcgcaggaaacttgatcgactgccatgtcatcttcgcctgatgtgttggaccttgctccatctggctctaggtctcagaagagaagcttgtttatgtctgcaagacctggtggccaagtactggcaagttctagggggcccagtgtctgggctgagcattgggacaggcagggcaatgctgggcacacgacaccatggaagtgactgtctaccatcgccggggatcccggagctatgtgcctcttgctcattccagctcaggcttcaccattactgaccaggtgcctttctccgtgagcgtgtcccagttgcggggccttggatggagggaacaagcacttcctgagaaatcaggctctgagctttgcgctccagctccatgacccagtggtatctggctgaagctgactctcctacacctgg

SEQ ID NO: 643625 - DNA, 386 bp, Homo sapiens
caccccaaaaaaaaagaggggaatggccaagtttttgtatgtataaagtcaggctcgatttcaggagagcagctgatcccaatttgcttcatgaatcaagggggggaaagggttataaatggattgatttagaaaatggttccccggccagtcaaaaaaaagaaaatgaaaaaaatcccccttaaagggagaaaccccacttcaaagatttttcagggatgagaatccccctttgtatttcaagataagggggtttaaaaaaaaaaaaaagaaaaaaacttgatgtaaattcccccttttccttggggttaatgaaaatcatttattcaggaaaaaatttttatatgttccccatgttaagaaaaaatggccattaaattttgtta

SEQ ID NO: 643626 - DNA, 200 bp, Homo sapiens
gcatattctaggtattatttggagttaggtcctcacttgggggacaacaaaaaagaaaagccaagcaaaccaatggtgatcctctatttggtgatgatgctgtgacaataagtttggaaccgtttttttttggaaacagccagtcccagtatattctcagaagcatgttgtcagagtgtggtcccggttaacctttctgg

SEQ ID NO: 643627 - DNA, 238 bp, Homo sapiens
atttcaggtgcagctcctccttgtccccccgtggtggctccgtagagactggaaacgaggacatgaagagctctgacagagacgcagcagaaactctgaaactgtttccagagggcctgcactgcttggaccagggccaccaccttctccttcacccaggcctagaacccgcgtgccaccgaggtctgcagccgctgaagcatggcctggaaccatctcatgacctttgtacacaaaa

SEQ ID NO: 643628 - DNA, 170 bp, Homo sapiens
  misc_feature (83)..(83): n is a, c, g, or t
agtaaataagtgggtatttggttttatgaagaataatgttgaggattagagatatagtatattagagataatatatagtatanaggttgatttaaatattttggtttggattaggtaattaaaatttttttggtaataggatatatgtttttatgtgttgttaagattta

SEQ ID NO: 643629 - DNA, 109 bp, Homo sapiens
cactcacttgactgtcacttgtctcctgccattggtccatcgcagtcatccctagccctctgctgggtcatctgcagtaggttccattgcagctgctgcgctgactgga

SEQ ID NO: 643630 - DNA, 107 bp, Homo sapiens
gatacgtccgcatcagtgggcacatgcgttcagccggtgagtccctgttgacttctagccgcagaacctgtcaggtccgatactggagtttatagccacttgctttg

SEQ ID NO: 643631 - DNA, 548 bp, Homo sapiens
ggagaaatcaccgttacggccactgtccaaatccccgcgtcgctgcacgccgcccgcccgctcccacgccacagccaccggcggcgaatagagactagagcggcagcgccggcagcgcggggccgttgcccagtgtttgcagttagagccccatctctctggcgtggttgttaatagactggaaagtctgtgtctgtgtcgctcactagtaaccgtgagtttttaccacttcgtcacctgtcggcggcggccgggagcaggttcccgcaggcggcgcggggggtcttccccgcgccccgccgccgccggcctcgcagacctgccctccagccccgccccgttcttgaccaaacatgacagactctgaacatgcagggcacgacaggtcgggaacccttcttgtctgtctttctgtcggatgagaggaggggtctggggcggcgggagcgggccggggccgggcgcctcctgcatgacctagacgtctctgtgtggctccgtcagttccatgacgcgcactcttatgtaaactgctggatcgcggccgc

SEQ ID NO: 643632 - DNA, 618 bp, Homo sapiens
  misc_feature (536)..(536): n is a, c, g, or t
  misc_feature (538)..(538): n is a, c, g, or t
  misc_feature (606)..(607): n is a, c, g, or t
ctgcaggtgtaggacagtgtttgctggtaacaactccaatgtgtattaataacttgaaaaggagcatttcactataaaagataatgaagtaggtaatgaaatcagtccttgaatgaaagcagtgcccttgagaagggatttttttttaaatatacagtaaaatatttcgtgggaacctaacactcacatagcatatggtttattaataatgcatatcctttctaatcacttcttcaattctttttgctgcagttctgtgctaaaatggggttgtggttaagtgaacgagaactctgcctacctaagaagttcattgtgttctaagtggaaggagagttactgaagggaatgtgaatttttaccgtttgtacttaagatacatttgttgtctaaaatggctctggataacatttttgggttaaaaaatgtaatttaaagccaccatagaaagtattttctgatttactgtccaaatgaattttgttgttaattgagaagtcaataaaatggattaaactgacagaaaaaaaacatananatatatcccaaggtgtaatttactcttttgtcaggataaaatcagaaaaatggctgattttagtaaannaaatttttagc

SEQ ID NO: 643633 - DNA, 938 bp, Homo sapiens
  misc_feature (546)..(546): n is a, c, g, or t
  misc_feature (726)..(726): n is a, c, g, or t
ggagaaatcaccgttacggccactgtccaaatccccgcgtcgctgcacgccgcccgcccgctcccacgccacagccaccggcggcgaatagagactagagcggcagcgccggcagcgcggggccgttgcccagtgtttgcagttagagccccatctctctggcgtggttgttaatagactggaaagtctgtgtctgtgtcgctcactagtaaccgtgagtttttaccacttcgtcacctgtcggcggcggccgggagcaggttcccgcaggcggcgcggggggtcttccccgcgccccgccgccgccggcctcgcagacctgccctccagccccgccccgttcttgaccaaacatgacagactctgaacatgcagggcacgacagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatccaaaaggngaaaacgtgagaaacataagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaatccaaaaggngaaaacgtgagaaacataagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatcgcaaaaggcgaaaacgtgagaaacataagagaagatggc

SEQ ID NO: 643634 - DNA, 161 bp, Homo sapiens
gcaacacaggtggggctgctgctagcttaattattttagcagcttccctgtgtccaaaaactggtgaagacaaaatgaaatgctgatatgaacgtgtctttgggatgagtttgtcatcctctagagaaggcactttcttggaaaataatgccttgcttgtg

SEQ ID NO: 643635 - DNA, 896 bp, Homo sapiens
  misc_feature (504)..(504): n is a, c, g, or t
  misc_feature (684)..(684): n is a, c, g, or t
ggtcgacaactattggagtactttgggatagcactgtatttattcatgcattcattttgtgagaatcagcgattttaatctaagaggtttgcaaacttcggctgctgataatggttcttacattcttaaaggaatgttaaatgaagacgaattcgcaacagaaaccatatatggcctgcaaatgtaaaatatttactatctgggcctttatagaaaaatttttcaagtgcttgtctaaatgaatataacataaatccttggcatatgctttttttcttttgaaaatctttctgtaagatttgttttagaatgatatttgaaaattaaaattttccttctatagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatccaaaaggngaaaacgtgagaaacataagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaatccaaaaggngaaaacgtgagaaacataagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatcgcaaaaggcgaaaacgtgagaaacataagagaagatggc

SEQ ID NO: 643636 - DNA, 107 bp, Homo sapiens
  misc_feature (10)..(10): n is a, c, g, or t
attgactcgnacccatggcggactccacatctgggcaccttcagaaggttatagcccagagttggggaaaccatagtattaaattgatggcatccgccgaagggtaa

SEQ ID NO: 643637 - DNA, 2095 bp, Homo sapiens
  misc_feature (1871)..(1871): n is a, c, g, or t
ggaaattgagagggaatggaagtggtcacataggctcttctgttggtggagcaaagtttgatttgcatcatgcaaatgctggcactaatgtcaaacacaaaagaggcgatgatgatgatgaagatacagaaagagaactgagagaaaaagctttcttaatacctttggatgcctcacctggcataatgctccaggatccaaggtcacaattgagacagttcagtcacattaaaatggacattactctaaccaaacccaactttgcaaaacacatcgtgtgggctcccgaagacttacttccagtacctttacctaaacctgatccagtgtcttcaatcaatttacctctgcccccacttatagctgaccagaggctaaatagattatggaatacaaaaagtgatcttcatcaaaacacagtgtccattgatccaaaattagcagccaaagccaaaattaacacaacaaacagagaaggctacctagaacaatttggagactcacacggttcaggagctaaattaggagatcctagactacaaaaaaattttgatcctaggcttcacagactgcccaatacagagtctcatcaagtggttatgaaggattcacatgcatcaaagggtgcccctcacttacccagatcaaaccctggttcatcacagccctcaggggcaggaactagcaattctggttccggggctctgcctccatatgcccctaaactctcttcctcagctggccttccactgggaacttccacttcagttcttagtggtattagtttgtatgaccctagggatcacggttcatcatccacatcagagctagcaacagcttcttcaggagaaaactcaaagaaccagaaaaaaagtggtggcttaaaaagtagtgacaaaactgaaccttctcctggagaagccatccttccacaaaaacccagtccaaacgtgggagtcactcttgaggggccagctgacccacaggcggacgttcccaggagttctggtaaggttcaggtcccagcagtgcacagccttcctgttcaggcattaacaggcttaattaggccacagtacagtgatccaaggcaggcaaggcagccaggacaggggagcccgaccccagataatgatcccggtagagaaacagatgacaaatctctgaaagaggtttttaaaacttttgatccaaccgcttcaccattttgttagctattgtgtaactgagcaattcttttcactcttgtgactatctcagtcctctgctgttttgtaactggtttacctctatagtttatttatttttaaattataaacacttttcagctgctagtatcagaaccacatgaagttatagcctctaaagcctgtggtattttatataatatttttataactttaagagactgtagtaattgacctaaaaacttatgttagcttcagtaaaagtacttttattgtaaataaacaatcatgaactcaacactctgcctgaatatatgccagttgtctttcataatcaatgtttagataaatgattgccactttttatatggttgtttagtttcaagcaatatgatgtacattacttttgagaaacagtattttgactaggacctctcttatttgtcagcacagaactgattaatatgtaatgctacctgctaattaaaatgtaaaatcaagtaaagaaaacattttaaaattacaattagcagagcagttcatgtttaagggcatcacttttattagtattggcaatattgtttgtgtaaatgtagcatttgaatgtcatatctttttaaagtattttattgtatactgtatcatagaagttggaggtatataaatagaacattttgctaaagngaaaaatttccaagttctctagcataactttttacatttaatttttcatatgaaatagcaattagttactgctgtgttacattgtgatgtttatgtatgtcaatgtttttgtctttaacagcataatttatattgctttttcaaatgatgtagctgcattaattgtgttcatcatgactttggcgatttttaacaaaatttttaaagacccagtgtggagagag

SEQ ID NO: 643638 - DNA, 321 bp, Homo sapiens
  misc_feature (59)..(59): n is a, c, g, or t
  misc_feature (83)..(83): n is a, c, g, or t
  misc_feature (107)..(107): n is a, c, g, or t
  misc_feature (132)..(132): n is a, c, g, or t
cccccaggacaacagctataccttcaaaaaaaaattaactcttccttcctagcaagcanacaagaaggtctgatagtgctganaccaccttatgttgtatagttgtncaccatttagaaaggactttatggnaccgcttcctttttggcttcaaaataaaattaactcttccttcctagcaagcaaacaagaaggtctgatagtgctgagaccaccttatgttgtatagttgttcaccatttagaaaggactttattggaaccgcttcctttttgcttcaagcatcagtatctaacaagcccctgtcatagctgcgtcctg

SEQ ID NO: 643639 - DNA, 1561 bp, Homo sapiens
  misc_feature (1169)..(1169): n is a, c, g, or t
  misc_feature (1349)..(1349): n is a, c, g, or t
ggaaattgagagggaatggaagtggtcacataggctcttctgttggtggagcaaagtttgatttgcatcatgcaaatgctggcactaatgtcaaacacaaaagaggcgatgatgatgatgaagatacagaaagagaactgagagaaaaagctttcttaatacctttggatgcctcacctggcataatgctccaggatccaaggtcacaattgagacagttcagtcacattaaaatggacattactctaaccaaacccaactttgcaaaacacatcgtgtgggctcccgaagacttacttccagtacctttacctaaacctgatccagtgtcttcaatcaatttacctctgcccccacttatagctgaccagaggctaaatagattatggaatacaaaaagtgatcttcatcaaaacacagtgtccattgatccaaaattagcagccaaagccaaaattaacacaacaaacagagaaggctacctagaacaatttggagactcacacggttcaggagctaaattaggagatcctagactacaaaaaaattttgatcctaggcttcacagactgcccaatacagagtctcatcaagtggttatgaaggattcacatgcatcaaagggtgcccctcacttacccagatcaaaccctggttcatcacagccctcaggggcaggaactagcaattctggttccggggctctgcctccatatgcccctaaactctcttcctcagctggccttccactgggaacttccacttcagttcttagtggtattagtttgtatgaccctagggatcacggttcatcatccacatcagagctagcaacagcttcttcaggagaaaactcaaagaaccagaaaaaaagtggtggcttaaaaagtagtgacaaaactgaaccttctcctggagaagccatccttccacaaaaacccagtccaaacgtgggagtcactcttgaggggccagctgacccacaggcggacgttcccaggagttctgagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatccaaaaggngaaaacgtgagaaacataagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaatccaaaaggngaaaacgtgagaaacataagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatcgcaaaaggcgaaaacgtgagaaacataagagaagatggc

SEQ ID NO: 643640 - DNA, 333 bp, Homo sapiens
  misc_feature (122)..(122): n is a, c, g, or t
tcgagtcggcccctgtgttagcacaataaggaagggtccccaggttggtgaagccccaagttgagaacaataatgaacaattattgaatgaacaattgttagagacagctaatcacaaacanacctgcgggcacaatgacctcattccacacgtagcaccctacagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 643641 - DNA, 1375 bp, Homo sapiens
  misc_feature (1293)..(1293): n is a, c, g, or t
  misc_feature (1295)..(1295): n is a, c, g, or t
  misc_feature (1363)..(1364): n is a, c, g, or t
ggaaattgagagggaatggaagtggtcacataggctcttctgttggtggagcaaagtttgatttgcatcatgcaaatgctggcactaatgtcaaacacaaaagaggcgatgatgatgatgaagatacagaaagagaactgagagaaaaagctttcttaatacctttggatgcctcacctggcataatgctccaggatccaaggtcacaattgagacagttcagtcacattaaaatggacattactctaaccaaacccaactttgcaaaacacatcgtgtgggctcccgaagacttacttccagtacctttacctaaacctgatccagtgtcttcaatcaatttacctctgcccccacttatagctgaccagaggctaaatagattatggaatacaaaaagtgatcttcatcaaaacacagtgtccattgatccaaaattagcagccaaagccaaaattaacacaacaaacagagaaggctacctagaacaatttggagactcacacggttcaggagctaaattaggagatcctagactacaaaaaaattttgatcctaggcttcacagactgcccaatacagagtctcatcaagtggttatgaaggattcacatgcatcaaagggtgcccctcacttacccagatcaaaccctggttcatcacagccctcaggggcaggaactagcaattctggttccggggctctgcctccatatgcccctaaactctcttcctcagctggccttccactgggaacttccacttcagttcttagtggtattagtttgtatgaccctagggatcacggttcatcatccacatcagagctagcaacagcttcttcaggagaaaactcaaagaaccagaaaaaaagtggtggcttaaaaagtagtgacaaaactgaaccttctcctggagaagccatccttccacaaaaacccagtccaaacgtgggagtcactcttgaggggccagctgacccacaggcggacgttcccaggagttctggttctgtgctaaaatggggttgtggttaagtgaacgagaactctgcctacctaagaagttcattgtgttctaagtggaaggagagttactgaagggaatgtgaatttttaccgtttgtacttaagatacatttgttgtctaaaatggctctggataacatttttgggttaaaaaatgtaatttaaagccaccatagaaagtattttctgatttactgtccaaatgaattttgttgttaattgagaagtcaataaaatggattaaactgacagaaaaaaaacatananatatatcccaaggtgtaatttactcttttgtcaggataaaatcagaaaaatggctgattttagtaaannaaatttttagc

SEQ ID NO: 643642 - DNA, 351 bp, Homo sapiens
gaaggggaaaaggcccccatttgcaaacccccttttcccggggggtggggggtttttttaaacaagggggcccccaggtttttcccttggaaaaggggcggggggggcccccccatttatggggggtgggtccccctttggggccccccgggttttccctttttgttttcgggttgttttttgggggggatttttagggggtaaccatttttcccagggaacaccttttcccctgttttcccccaggttgaaatttcccccccctaaaggggaaaaaaagtgggggtccccccggggggggggcgcttttaaaaaagggggtccccccgggggcgggaatttgggccggga

SEQ ID NO: 643643 - DNA, 177 bp, Homo sapiens
  misc_feature (31)..(31): n is a, c, g, or t
agaggcaggaggagctcttcaggccaggagntgaaggtgcagtgagccatgatggaccaatgcacttcagccgggacaactaaagtgagaccctgtctctttaaaaagaaacaaacaaaaaactctatattctaattagctaaccaatccaattatcaaagtaacctctaacatttc

SEQ ID NO: 643644 - DNA, 288 bp, Homo sapiens
  misc_feature (9)..(10): n is a, c, g, or t
tggaacttnncggggtttctagcagcggaagggcccaatgcgagggcgtttttgtcgccgttataccgcacctttaatgtccattccacaaggttgattcgggatggttctggaattgcctctgaattttattcgaactatgtattcgctgggttagaataccagaatagacaattgctatggaatgcactattagaactcttttccaatacactacttacgaaaagaggactcttgacctttgttaaaaaaccaccaagccccggaagttccagggtaccgagctcg

SEQ ID NO: 643645 - DNA, 432 bp, Homo sapiens
aaaaccaatgctagacttagggaataaaatgataaattaaaaacagaaaggttttgcagttcaattatgagatgaaagacataaattacgtgttattcctctaacaatggcacaaaaagaacagtaagaaattaactaccagggaggctctcatgccagcatattgtatatgtacttatttctccagtctgggtgacttctggaaccataaaatttttatgctgaaaggttttcaccccttagaatagagttcaactttctcgtttcacagatgagatccagcaacattagctgacttgcttaaaatgatactgcatctccgtatctttactgtttactactaataaataatgctgtatcattaaggatgattctgatttttcacaatgaattctggacacttttttttttcatcgttatccttgaggacta

SEQ ID NO: 643646 - DNA, 134 bp, Homo sapiens
ggcaggctgacctggctacatccagcctgtggttcagatgcagacggcatgtgagccaccgctgcagcacagagcgtcttccccctgtagacgagggccgtagggagtacctgctgccccagctgactgtggcc

SEQ ID NO: 643647 - DNA, 168 bp, Homo sapiens
tatatgctaaccccttcccagtctctcatcagtgacagtacgtcgcagctgggacgtcagatgttgcgtcgagagaatccagaatgaaggccccattcttaatagatactctgagcttgaggttggaccagtaaatgccaggataacgcggggatccgtctagtagtc

SEQ ID NO: 643648 - DNA, 349 bp, Homo sapiens
  misc_feature (18)..(18): n is a, c, g, or t
  misc_feature (110)..(110): n is a, c, g, or t
ccgcgcgaggagatagangcatcacggcccaggccttaacagaggctgaagcccagggggtgcaaaggcaaggccatcacgcccttccagctggcccgcatcagggcccngacgggcggtcgcagcctggccaccaatatcgccctcgtgaagcacaacgccgtagtcggtgcgcgaatggcccgcgcgatgcagcgttagcgcgccgcaggtgtttcaccgtgccagcaatatgcgagcaaaacagtgcggataagctggcatgtttttctcgtcaatccccattacttttggcaggcccagcgtcatgcgcgtgacctttcccctgaacctctgtggcctcctcgtg

SEQ ID NO: 643649 - DNA, 268 bp, Homo sapiens
tgtttaatcgccaaaaacacactggccagtgtaccatacatatgtaccagaagagtcattatctatcttgttctccctttccagaaaacttattgtaaagggactgttttcatcccataaagacagggactacaattgtcagctttctattaccctggatatggaaggaaactattattactctgcatgttctgtgctatgcgtgatatttagcgcttggcattataatcagattcctcacccttgcttaggagtaaaacaaatatac

SEQ ID NO: 643650 - DNA, 115 bp, Homo sapiens
cctcttatatccccaaggtccttagctgatttttttatttttttgaacaggtctcactctgtcactcaggctggagtacagtggtataaatatggctcactacaccctcaactta

SEQ ID NO: 643651 - DNA, 113 bp, Homo sapiens
tacggaacaacttatgctggatatcgacgcaaacaactgctggaccatttggagacagggtcatctccagaaagcaatctgttccagtcgacttcagtgtgtaggcctctatt

SEQ ID NO: 643652 - DNA, 958 bp, Homo sapiens
ataccaggactgccgcatctgtcgcgctgtgtgttttcctcttgatcgggaactcctgattctccttgcctcgaaatggacccccaatgctccttgctcgcctgtggctcctgtgccttgtgccggtcctgcaaaatttgaaagagtgcaaattgcacacttccgtgcaaggaagagttgttgtcctgggtggccactttgtggggatggtggccaatggtgttgcccagggggtgcatctggcaaaaagggggagggtaaggaacaaaggtgaaggttgttgtgactggagtggccagggaccaaggtggtgcaatcagaatgttaaattaggaagaaaagtactaattcagcccgtggattcctggcgcactgaatgccacatctaggttgtccaacccccctatgaaccccggatgcggcaaaactctgactgcgccccacaattgcagcacagcgttgccgacacgggcgcaaaacaccttcccgccgacaacacctcgaagcacacaaccaacacaaccactccacgtgcgacagccgacctacacatcgtgcgacgccacacccgagcgcacccgcagacgaacagccgaccatcgcacacacacaccagctcagtaggcgcaccgagcaaaccggccacccaaaaagacaagaaaacaaaagcagctgcacaccccgcggcgtacgcatacacaggaaacagaaacgtggagaccaccagcagcgagagagagggaccgtcagtcaacggagaaaaaacagcaggcgcgaggggcaacgaccagagagcgagacaggaacaaaaacgcagcgaggtgagatcaatgaagaaaaaactgtgctcacgcgcaaagatgagaaacagagcacggaggcaacagcaacgacgccgccgcggggaaaacaacaaagacgaaaccagaaggcaagcaagcccgcaccacagacgcag

SEQ ID NO: 643653 - DNA, 317 bp, Homo sapiens
ggatcccctcatcttccgtgccccctctgcggatgtttcactgcatttatcagtgtctgctttttctccgtgcgtatccaattccaactcagtggtgaacacctggtgagagactgcatcccattgctacccttgtctcctccgtcccatgatcctgccatcgccagccttacctcctttttcccgtaatctctttactcgcggcttctcctacgcacttcaatctgttataggccgcgagttagatcattcggcaggcggtactttgtgttgcctgatccctttctttcggacgtccagacaccttccttccaggt

SEQ ID NO: 643654 - DNA, 139 bp, Homo sapiens
ggtcgacacttgcaagagtgccagatggagccacggaacacttcccagcgcagatttcaggcaagtgtgtaagtaagtcctacgtatgtgaatatctcatgccaatcctgatctagtcaaatcctaaacatagtcgacg

SEQ ID NO: 643655 - DNA, 900 bp, Homo sapiens
  misc_feature (819)..(819): n is a, c, g, or t
aatggtggtcttccgaagaatcccgagttgcgccgggtcctgtcaaggtgcagttcttgccattactgcaatagccacgagtctgtggtgtcgacggcccgaccctgtcagccagcgttcaatcatgtccctccatggcctcatggggaagggtggacgttcctcagtcggtcgggattgtggccactgtgtctctggagcacgctaggcattcctggcggccgatcatgttgtcaaaccatcgcttggcatgcgctggtgggtcagccggtcctcagtaccgctatcggtgtgatatacatctcgacatctatagcaccttcgttcccatgggtgacctgggccagcctctgtttctgggcaatgcgcgacgcgcacagataacgcgattctactccggagcgcaggattgtcccataaccacacggccactgtggtccatcagggctttctctgggcccgacgacttgggaatagcctgacaaaccctctccgatcgtcgtgcaggatcgttcatttgtgacagaattccccccacaggccaatggctccaatcgtgtaccccacggtaacaggcttgcgcccgtctggacccctaaggtccacttctccgctttgtttctacaccgaagttcctgcacagtgtgcgagtctcattttacaagaaccggcctccttcctacgcaatgattcgcgcagaaaccacttaaaggggccttgtcctgggcacgagaaaacgttgacgtgaccacgactgcccttgcccggggacaggcccatctactccgtaagacaggccgcgcgtctgcgacactcctntatgggacaaacagcacggactaacgacatacccgaaacgaccgtgtggcacagactgcaacgcgattgggcctattaccc

SEQ ID NO: 643656 - DNA, 150 bp, Homo sapiens
gtatacaggcgtcacacgcgactggcctttcctggctgcgtatactcactcaccctgcagaaaacacagagaccaggcagcgtgcgctgctgggttctgaagagagttcgatggagggtgggtgaaggaaccaggagcgaaggccaaacg

SEQ ID NO: 643657 - DNA, 448 bp, Homo sapiens
aaatcagtcggtacccccgctggcctatggcacccagtcctgcagaactatcagacggcaaagggaagctggctcgacacaggcttcttccagcgctgaacaggggaaggcaggtggccatgcgtggagccagctctacacagaggcgctggccaagtcatgctggctcattctgtgttctcaagtgctgtcctctcgtactctgtacagattccttgtcttcaaggagtaagtgccaaggcttccagactcaggtttgaagtcaggtcctgttgaaggtcgtcatgctgtagtgatagcgtataggtccttcattagtccttccaggtgggccatctctttggtcagctcatctggttcatagctactctcggagtcttccaatatccttgtggtctcctgcactatcaggggcactgggaacaaccactgccattgcgccagcgcg

SEQ ID NO: 643658 - DNA, 308 bp, Homo sapiens
ataagctgttatctcatgactgctcattacttacctagggaaaactagcttattgttctgtttccaagtataccagcagagaatataaaactggtttttgagcctatgcactaagtatagtgtgatgtcttttccgttctgtagtcctcctgggagaaataataataatgacaacaatagagaataagtcggctgggagccgtggcttatgcctgtgatcccagcactttgggaggctgaggcgggtggatcacgaggtcaagagatccagaacatcctggctaacatggtgaaaccctgtctctact

SEQ ID NO: 643659 - DNA, 156 bp, Homo sapiens
tacctcttgacggactccacttatgactccctaaagcccatgtctaatccctcatcgttgggtctatagtacttgccgcagtactcttaaaactagcgcggctatggtataatacgcctcatactcatttctcaaccccctgcaagattgcttgtt

SEQ ID NO: 643660 - DNA, 452 bp, Homo sapiens
  misc_feature (84)..(84): n is a, c, g, or t
ttgaggacccccgcccattcatcatcctgctattcatatcctgctcatccgtgacgcttttcaggacttccacccagacagggngaaggcacgtgggcttggattggagaagacaggtcccgcccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgcc

SEQ ID NO: 643661 - DNA, 105 bp, Homo sapiens
atgatgaaggaaagaagcatctcacagctcctattctacgtcctgtctacacctacatatggaacgacaaacacctagaccatacacacagtcacctacgaatct

SEQ ID NO: 643662 - DNA, 844 bp, Homo sapiens
  misc_feature (349)..(349): n is a, c, g, or t
  misc_feature (351)..(351): n is a, c, g, or t
  misc_feature (370)..(370): n is a, c, g, or t
  misc_feature (380)..(380): n is a, c, g, or t
  misc_feature (404)..(404): n is a, c, g, or t
gcctgcccgacgtgtcttccggtggcggagcggggattagccttcgcgggcaaaatggagctcgaggccatgagcagatataccagcccagtgaacccagtgtcttcccccatctgaccgtggtgctttgggccattggcatgttcttcaccgcctgttcttcgtttacgagggtcacctctaccaagtacacctcgtgatatctataaagagctcctcatctccttagtggcctcactcttcatgggcttggagtcctcttcctgctgctctgggtgggcatctacgtgtgagcacccaagggttaacaaccagatggcttcacgttgaaacccgtgctttgtgtaanantacttttttttcactgtgngctggaaggngtcccacctggtgctcattaatanaagtgcagatgtataagacaacaaaaaaaaaaaacaaggaacaaatgaacacacaacacacacgcgacagtacaaaacagaacacacaacaaaacaacacaaaaggttgggggggggcgtcgggggcccgagcaagaagcgagatcgattgagaccacacaacaagctgatgaggggagcgggacgcgacacaactagtgaggaacgaaaggaccgacgagtcagcacacgagtgtgcacgaacaagaaggaaacgccgagcgcacagagcacacagagggcggagggaggtatccaccaaacaaagaaaaagaacgcgccggggggcaccgacagcgtgttgaggaaaacaacaccaagagagcgacattgggtcgcacaagcgcgtcactacaaaagacgagacgagcggtaataaaaccgcgccgcggtaggggagc

SEQ ID NO: 643663 - DNA, 203 bp, Homo sapiens
  misc_feature (45)..(45): n is a, c, g, or t
  misc_feature (78)..(78): n is a, c, g, or t
  misc_feature (84)..(84): n is a, c, g, or t
  misc_feature (141)..(141): n is a, c, g, or t
atcctggtcggcgtgggactggaggcgaccccctctccaggtgtntccagcgccatcttcttcgtgccgggcttcctnttgttngtgcctggagtctatcacgtgatcttaatctactgcgcggtcaagggccaccggggnttccagttcttctacctgccctacttcgagaagtgatcgcggcgcacgtgggaccccttacg

SEQ ID NO: 643664 - DNA, 103 bp, Homo sapiens
ggtcgggtcccatccggcccatcgtgcgctgccccacggttcggtaccacaaggaggtgcgcgccggccgggctttcaacctgtggaggagctcaaggtggcc

SEQ ID NO: 643665 - DNA, 301 bp, Homo sapiens
  misc_feature (48)..(48): n is a, c, g, or t
  misc_feature (147)..(147): n is a, c, g, or t
ttagagtatcccccccggcttatgtcttacgcttcattgtgtaatacncttcatattttatagccagtctccctggtcattcctcaaagacctcctgtgcaatgtgaaacaaaagcattggctggcacttatggtggattgtctgcnataagcagaaaagagagcaaacaaaaaagattctctaacttctgtcttaagcactgcatgagtagaggtgccctgtattcagtggttaaaaatcacttcccacactgtggatgggaaagcagcaacatggataatccgtaagacataaccgcgg

SEQ ID NO: 643666 - DNA, 158 bp, Homo sapiens
gtcggtaccatgcgcacgcgttcatcgatactggtctactgagagttcgagcatgaaggggtgtcgaataatatggaaggccttatctgcgctcatatggagataataatgtggtctttgctcatcgggtctgtttagtgtgattcgcttatgtcgag

SEQ ID NO: 643667 - DNA, 102 bp, Homo sapiens
tgatccagattttcctctgctcataggtccactgctgcccttagctgtcttccacatcgttgatccagcggtcatcccagtccactcggaggcccaacaggt

SEQ ID NO: 643668 - DNA, 905 bp, Homo sapiens
  misc_feature (531)..(531): n is a, c, g, or t
  misc_feature (667)..(667): n is a, c, g, or t
tccaggctcccgggtcttaaatgggggcgggggctggggggcagttcatccaaaggtggttccaaagctgaggtcaaccttgggggtgggctctgcagggcaaaggggatggtaagcgggcccgtcaggctgggggggactcttgaaacgggggaaggaagagccccagtgggtggcacgccacagcttcaacagttgaggagaggagctccctgtggcccatgtccccgaagagcttacaaccacagcgcaggggccgtggtggcccatggcaagaagccttgacttggccctcgtggtgtggcctccttgtggcagggacgcgggtttccccaagtgttggccgtgtggacgcccatggacgcttgtgctggtggccgcacctgtggaattccctgtgccacagcccctgtgtgccgtgggcctctggagaccaccgtgggtaccgacaccgccttatctccaggggcctttcaccagagggcctctgtgaggccttcgatctcgggatctggagatctcttgcccggngtgggcctctgtcagtttgtccccaccaagtctccgccttggggcctttctcccaatgttggcctttgtgttgggcccccgtgtgtccaactattgtccacgcgtcaggcgcctctttggcgccacacaattgtgnaccgaaaaagtcggagtacactggcgatggaacccgttgctcacacaagtattgtgcaggtggtgccagcctctgaatgccccaggaccatgccccgtgccgagaacctgaaagtggtgggcacttgggccgccagaatgccaaaggctccgggtcagtgtgggcacttccactgccgaatttggcccgttgaaagaccccttggtgggacacggcacgtggaaggacatctggttag

SEQ ID NO: 643669 - DNA, 282 bp, Homo sapiens
gatcagctcggtaccaggacacagctatacaacaagagtcattgctagtgaactagcgatatgccacaactgcaagaaatacatgaagaatgtcatgccattttgtagccatgattaaggaaaatctggagaagatggggcctcgtattctggatttgcaattagaatttgatgaacaggctgtgcttatggagaatatattctatctgacttattcgcttgagctagagacacttatgagtcatgtttgcctccgaagcataagatcatatcagggaagag

SEQ ID NO: 643670 - DNA, 170 bp, Homo sapiens
atgatacaatcacatgtattgcagtccagaatgtgcctcgtatgacatggtcagttgatgcagacatcttctgtccatgagattgatactgaaagcgatcctcaaagatatgggcgtctagcagttagcattgctcagaaagatgacaaatccagtagggctatcagcac

SEQ ID NO: 643671 - DNA, 507 bp, Homo sapiens
acagtttcgtctctggccaatcaagagctcttctagtacccttcataaaaacaataataaatcccattttcttaaaggatagaaaaaaccttattaaccaggaaatactgaagcggactttcacaacgactggtgacagaggcagaaatttgtctaaaatgagaaactttcttgggaagtaaggctagtggcacccttctctctctctctcttaccctcaagagtgaagaataccaagggaaaaaaaccctcagaactttcggaggaaaccagctaagggatcaaatgtgagggggtaaagaagtcttcagaaacggtggagaacaagcttgctctgcggtgaaatgtcccatttatccagggaagaagcagctggcacgcgctgtatccccggagtaaatgaaaagtagaacggtgagagccacttagaagggaacaaattggttaaaagttaaaggttgacacattgaggtagatatattagattgatacattaatggggatcct

SEQ ID NO: 643672 - DNA, 784 bp, Homo sapiens
  misc_feature (280)..(280): n is a, c, g, or t
  misc_feature (357)..(357): n is a, c, g, or t
  misc_feature (441)..(441): n is a, c, g, or t
ctgccttcttgctctacagcatcagaatgagggcctgctgacatttggccggatcatggccgagggatgcgtgtcggagtctatcagtgtcgtataaatcagtgccaggggatcttaagatggagtgaagatttgatagttgaaggttcaaaagactcgtggcttggcttagttgagtgaggcctagaagctaatgatgagtctacttgtgaatttcgcttgacactatcatatgaagtagcaccctcaacagccaagtatcaatatggacctttagagnagtcatagataatcctcgaatatggtgtagcccatctcatcacttaggtctcatccgatggcacgctgttgaatagnacttgtcttgcttcagactatatgtgcccagctagtcgctggtaggacatgacacgagatagtccccccttctatcgaacctgncttagatgtggactcgttgaaggttataatgagaagtagtcgttttctgttttcgtgatcgttcggggtccccatgtcttaaggaagcttccgaagaactgtatcttagctcccttgactccgagcatatgaagtgcaccctggactatctcatcattcgagtctgaatagaatatttcgattaggcggttgagcgaatgggaacgagacggataagaggggcaaaactgtatagtgatgggcgcaagaagattggaagcaagggaagacatcgacaggtcaaatcagggtgtgcattggcttgggagagatgtgggcaatgggattattctaaatgggaaca

SEQ ID NO: 643673 - DNA, 139 bp, Homo sapiens
gttagatttgatcagttcttgaggccagtgcagcagtgcagtagtagacatgtttcagtgcagcctagggtgttgtgcagtgtccacattcagtgcgatgcagtaggggcacagggagcctactagggtgtagaatagg

SEQ ID NO: 643674 - DNA, 154 bp, Homo sapiens
ttcccaggctgttcgaactcctgggctcagcaatacacctgcctcagcctcccaaaattctgagattacaggtgtgagccgctgcacctggccaaagtgttcttatttttgcttatttcaagcgccacatcatacctggtagcatcctcgtttc

SEQ ID NO: 643675 - DNA, 180 bp, Homo sapiens
cggcatggggtctgtagaccagatcctcagacccagaggcgccgtacgcgctcctcagagcctccgcagccatggccgcagtggcccactcccacatctgccgccctgtgttagtagtgaggaagactccatgggcattgacaggccggacagtcacagagaaggccacaggatgtctgt

SEQ ID NO: 643676 - DNA, 103 bp, Homo sapiens
acgcatgatgaaccgcgatccctgggaacccagctgcctaacaaccgcccacaaactcactctcactactttcagcgcatcctcaggcccctagcgccacccg

SEQ ID NO: 643677 - DNA, 200 bp, Homo sapiens
tctagcaggatcccagaacggtcgaccaggttggaatgcatctggcgtgattctcatgctgcattgtaaaacctacattcccagtgttcatagcgacttctctctgcctcagcgctcctaggtatctggagattacagtgtctgtgacaccatggcccggcgtcatttctatttgtactttttatgtagactacggggtt

SEQ ID NO: 643678 - DNA, 126 bp, Homo sapiens
gctgacgccatgggcacatgctgaggcaggacccatgagccgttgttgtgcaggacgcagcagctgggagatgggggtgagggtcatccccaacaacgaagcaccctccagaagtgcgcctgggtg

SEQ ID NO: 643679 - DNA, 245 bp, Homo sapiens
  misc_feature (5)..(5): n is a, c, g, or t
  misc_feature (50)..(50): n is a, c, g, or t
  misc_feature (109)..(109): n is a, c, g, or t
cgggnggcggggtgggcagatcattgaagccccggagttcaaaaccagcntgggcaacacggtaagaccttatccctacattaattagttaataagccaggcgtggtgncatgtgcctgtatgtaatcccagctactcagaaggctgaggtgggaggttcacttgagcctggatagaggctgcagtgagctatgatcactccattgcatttcagcctgctcagtagagtgagaccccgtctctat

SEQ ID NO: 643680 - DNA, 240 bp, Homo sapiens
ggggtttttttttttcccccccttggcccccccatgaaggggtacccgttttatggggttttgccccccaacaaaccctctcggggggaaggtcccccggtttttttttccccccggcccggggctttgggtaattgggctacccccctgggaaaggtggacccaagaatttttttttttctgccccctgttgtttttttttttttcctttttttttaaagggggggggcccagggggga

SEQ ID NO: 643681 - DNA, 755 bp, Homo sapiens
tggacatgaaaaaaagtctttaatttggttcttgaaccccgcacgggggcaaaacagggtaagactggaggccgactgaggagggtgggggctctgtaagcacactttccccttcagtacgttgaggctgctccgtgcacattggttcctccaggcccctcgagtgaccttcgagtgccattgtggtggcctagggtcccagcactcccgcgaggtttcaccaggtttcgtgaaaaaccctcgaatctgtgggctcagccggttgtgctacgtgcatatcacgtggaggaaactgttacaggttttggatgaagccgacataccagggtctctgaaagatattagaaaaattttgggtatattacccccaaaaacacacaaacttctcacagggtgggtttaagggggttcgaataatttatcacgatatgcaccggcatggcggttaagaatctcccgagcatcataggacactctgtgtaagtagcagtgtataagatgggcataaaagttctccctcaaattttaaccaggatatatatattgtggtctgaaccccacaaaaaaaaaaggttattcttcacaggagtacgtgtgttcacaacgtggtgtcaaaaccccctatatcgaagtgtttctcacccaggcaagaatttaacaaggaaaactattcttagagaatctccgagcctcattgtaaagcggcctctccaaatttcatcaagtctttcttgaacccgggggttgcacgaaaa

SEQ ID NO: 643682 - DNA, 115 bp, Homo sapiens
tataactggttatgttagggttgtacggtcaactgctattattcatcctatgtgggtgattcacggagtatgctaggattttgcgcttctcaggttaggtttaatccaccctcat

SEQ ID NO: 643683 - DNA, 297 bp, Homo sapiens
tcccccagacttgaatgcaggggcccaatctcaattcactgtatcctgtgccttctaagatcaagctattctcctgcctaaaccttctgaattgctgggattacaggcgcctgacaccaaacccggttaatttttgtatttttagtacaaatggggtttaaccatgttaggcaggctggtattgaacttctgacctcatgtgatctgtccatctcgacctgccaaaggggtgggattacatgcatgagccaccgcatccggccagatgtcaggtgcttttaaaaagtaacctgaaat

SEQ ID NO: 643684 - DNA, 943 bp, Homo sapiens
  misc_feature (181)..(181): n is a, c, g, or t
tttttttttttgcgtggcgggagaggcgcagtccgacgacgagggccgtgctgtggagctgtatcggagccccagtgcgccatgcttttcgcgtacttcatatgaagggtccctgctggcaccgagggcgcgctgccgcaccgaggtggtgccgcccgaggaagccttcttctcaattggnacgtgggaacccttgggcccccgccgagcacccgcatgctttaattagtccttttaaaaagggaggactccttatttcaagggctgattaaggactcaaggacgtaccaggcccggtgaccaactgtgtgaccttggcaattttaccagcggcacttagcctcagggttccttagctgtgaaatgaggatagtaagaactacctcgtagtgatattgcgaaggttagaagaaacggcctggcataattacttggtagactattgttagatctgggaggtgtgaaaatggtagcctgtttggtccctgttcttcaccacctatcaatatgggaggaatccaaagaggcttaccaatataaacactgctttggtgaatttttgtgtagaaagagaaaaaatgtagaggggcgccatataagcactggaagaaaattcccccgccctatgtagccagttaaggaaattacgccaaacacggagtttctgctcctcttgagtgggtctcattgggaacaccacaggtgcactttctccacaacgtgtcgccccaaggtgaactaggttcaagagacactttgcttttggtggccccaccaacatgttccttttgagggcccctagatgaatattaaaattttctggaccatggtggctcaagcctgtgaatccccagccactttcagaggctgagcgtgggccagattgcttgaactgaggagtttgagacccacctgggccaacatagccagatccccttcccct

SEQ ID NO: 643685 - DNA, 918 bp, Homo sapiens
  misc_feature (121)..(121): n is a, c, g, or t
  misc_feature (128)..(128): n is a, c, g, or t
  misc_feature (149)..(149): n is a, c, g, or t
  misc_feature (167)..(167): n is a, c, g, or t
  misc_feature (177)..(177): n is a, c, g, or t
  misc_feature (215)..(215): n is a, c, g, or t
  misc_feature (237)..(237): n is a, c, g, or t
  misc_feature (253)..(253): n is a, c, g, or t
  misc_feature (259)..(259): n is a, c, g, or t
  misc_feature (270)..(270): n is a, c, g, or t
  misc_feature (280)..(280): n is a, c, g, or t
  misc_feature (291)..(291): n is a, c, g, or t
  misc_feature (298)..(298): n is a, c, g, or t
  misc_feature (300)..(300): n is a, c, g, or t
  misc_feature (307)..(307): n is a, c, g, or t
  misc_feature (314)..(314): n is a, c, g, or t
  misc_feature (316)..(316): n is a, c, g, or t
  misc_feature (320)..(321): n is a, c, g, or t
  misc_feature (328)..(328): n is a, c, g, or t
  misc_feature (336)..(336): n is a, c, g, or t
  misc_feature (341)..(344): n is a, c, g, or t
  misc_feature (360)..(360): n is a, c, g, or t
  misc_feature (401)..(401): n is a, c, g, or t
  misc_feature (407)..(407): n is a, c, g, or t
  misc_feature (414)..(414): n is a, c, g, or t
  misc_feature (420)..(420): n is a, c, g, or t
  misc_feature (425)..(425): n is a, c, g, or t
  misc_feature (430)..(430): n is a, c, g, or t
  misc_feature (443)..(443): n is a, c, g, or t
  misc_feature (464)..(464): n is a, c, g, or t
  misc_feature (475)..(475): n is a, c, g, or t
  misc_feature (481)..(481): n is a, c, g, or t
  misc_feature (489)..(489): n is a, c, g, or t
  misc_feature (496)..(496): n is a, c, g, or t
  misc_feature (500)..(501): n is a, c, g, or t
  misc_feature (511)..(511): n is a, c, g, or t
  misc_feature (516)..(516): n is a, c, g, or t
  misc_feature (525)..(525): n is a, c, g, or t
  misc_feature (531)..(531): n is a, c, g, or t
  misc_feature (760)..(760): n is a, c, g, or t
  misc_feature (848)..(848): n is a, c, g, or t
  misc_feature (898)..(898): n is a, c, g, or t
tgaggcggttaaggtctgagggtcttgtggggccacgggctgatcaccaggtgttggcttggtcggttcttatttctcgcctggcaatggcgacgtacacctgcataacttgccgggtggngttccgngacgcgacatgcagcgggccnactataagatggactggnaccgctacancctgcggcggaaggtggccagcatggcccagtgaccgncgagggcttccaggagcgagtncgggcgcatgggccgntgcggnggaggagagcnagggctcggncacctactgcnccgtttncngttagangtttgcntntttnnacgcctnctataacnacctnnnnttccggcgttacgttnagctggagaagaaggccgttcaggcagttaattggaaagtngagatnatgaatnataatnacttngaganaggactgggcgtngacagtgtggacaaggatgcnatgaacgcggncatccngcaggccntcaaggnccanncgtccatgtntccangaaggcgcncccagngcctgcaaaggaggccaggaatgtcgtggccgtgggtactggtggccgtgggacccacgaccgagacccgagtgagataccaccccggctccagtggtttgaacagcaggcgaagaagttggcaaagcagcaggaggaggacagcgaggaggaggaagaggacctggatggagacgattgggaagatattgattctgatgaagaattggaatgtgaggatactgaagcnatggacgatgtggtggagcaggatgcagaggaggaagaggctgaggaaggcccaccccttggtgccatccctatcacggactgcttgnttttgttcccatcattccagctcgctgatgaagatgtggctcaatgaacnaagacacagtgtctttattc

SEQ ID NO: 643686 - DNA, 423 bp, Homo sapiens
gaggatcagaaaacatacctgctgtggtgctatgggtagtacctcaggcacaaaataatctgcacaccaaacccccgtgagcacaattttagcttgtattagcaaacccacatgtagtaccccgataacataaattaaagctaaaatgaagaaaaaaaaatcccatggtgggatagtgcattgtaggtcaaaggactgatttttgctacagatagtggtcccagtgtggctgtactgatttattcctgtgtgcttgcttgcagattcacgattctgaacaggtggtccagaaccctagtttggtagagaaaacaggttgctgcagcagatttacagtctgaggggatgtaccaggagacttgttttttggcagaaaacacttcgatcacaaacgccatggtgaagttcctgaggggggtgcct

SEQ ID NO: 643687 - DNA, 940 bp, Homo sapiens
  misc_feature (121)..(121): n is a, c, g, or t
  misc_feature (128)..(128): n is a, c, g, or t
  misc_feature (149)..(149): n is a, c, g, or t
  misc_feature (167)..(167): n is a, c, g, or t
  misc_feature (177)..(177): n is a, c, g, or t
  misc_feature (215)..(215): n is a, c, g, or t
  misc_feature (237)..(237): n is a, c, g, or t
  misc_feature (253)..(253): n is a, c, g, or t
  misc_feature (259)..(259): n is a, c, g, or t
  misc_feature (270)..(270): n is a, c, g, or t
  misc_feature (280)..(280): n is a, c, g, or t
  misc_feature (465)..(465): n is a, c, g, or t
  misc_feature (486)..(486): n is a, c, g, or t
  misc_feature (497)..(497): n is a, c, g, or t
  misc_feature (503)..(503): n is a, c, g, or t
  misc_feature (511)..(511): n is a, c, g, or t
  misc_feature (518)..(518): n is a, c, g, or t
  misc_feature (522)..(523): n is a, c, g, or t
  misc_feature (533)..(533): n is a, c, g, or t
  misc_feature (538)..(538): n is a, c, g, or t
  misc_feature (547)..(547): n is a, c, g, or t
  misc_feature (553)..(553): n is a, c, g, or t
  misc_feature (782)..(782): n is a, c, g, or t
  misc_feature (870)..(870): n is a, c, g, or t
  misc_feature (920)..(920): n is a, c, g, or t
tgaggcggttaaggtctgagggtcttgtggggccacgggctgatcaccaggtgttggcttggtcggttcttatttctcgcctggcaatggcgacgtacacctgcataacttgccgggtggngttccgngacgcgacatgcagcgggccnactataagatggactggnaccgctacancctgcggcggaaggtggccagcatggcccagtgaccgncgagggcttccaggagcgagtncgggcgcatgggccgntgcggnggaggagagcnagggctcggncacagtgctacgtgcaccggtgttgcagttaagaagtttgcctctttcatgcgcctacgagaaccgcctcaagtacccggtgtcacgtggagctggagaacgaacggccgggcagggctgttgagatcggctaacgtgcagatgatgaactgggatagaactgggaggaagatggactgggcgtngacagtgtggacaaggatgcnatgaacgcggncatccngcaggccntcaaggnccanncgtccatgtntccangaaggcgcncccagngcctgcaaaggaggccaggaatgtcgtggccgtgggtactggtggccgtgggacccacgaccgagacccgagtgagataccaccccggctccagtggtttgaacagcaggcgaagaagttggcaaagcagcaggaggaggacagcgaggaggaggaagaggacctggatggagacgattgggaagatattgattctgatgaagaattggaatgtgaggatactgaagcnatggacgatgtggtggagcaggatgcagaggaggaagaggctgaggaaggcccaccccttggtgccatccctatcacggactgcttgnttttgttcccatcattccagctcgctgatgaagatgtggctcaatgaacnaagacacagtgtctttattc

SEQ ID NO: 643688 - DNA, 229 bp, Homo sapiens
aacagtacctactactaatcaccgcccctaatcatacaaagcccccggacaataggatcctcccgcatcaaaccctgacccctctccaatcataaattatacagcttcctacactattaacgtttaacaccaccaccaacccatcatactctttcacccacagcaccaatcctacctccatcgctaaccccactaaaacactcaccaagacctcgacccctgaccccca

SEQ ID NO: 643689 - DNA, 778 bp, Homo sapiens
gggcggacgcgtgggttctggctccaggaactggaagtggccccaagccaatgctcaggcaggcccaggtcagccccaggccccagccccagcaaaccaggaaggcaaagggtgaaccaggcggcttgcgtctagggatctggcagcttgctgagtgtgagacaggcccagaccacaacatatcgttgtgaaacttccctcttcaacacctgcttatcaggtgggcaaagaataattacttaacaccaaagaatgtgtcaggctaatttggggtaaagattcgcacgtttgatttgccaacgccaaggcgggctcaatcgatgctctcttgggctggccccattttccggtcccttagattgctccaacagggcttcctgtgcaaggccaaaccaaggattctggttacaattttcaaatttattaagaagcccattggctccataactttgtcaagccctttgtaagctttacttttcgtctaacattcagacttgggaacaataaacgcagtgaaactggcttcatattttataaaagccggcaaacggcattccaaggaataaatttctgacatgggcctacccccattacagcaggcaacatacataaggttccagtgcttgaacaccttttgcacaacaaactttcttaagaacccgttcgcattccttacaaagttcttccaacaagcgccgcacatacaccccaagagtgccaaaagttctttgaaccaaaaaccctttgattggctttggacagacgctctggaagggaa

SEQ ID NO: 643690 - DNA, 1097 bp, Homo sapiens
  misc_feature (537)..(537): n is a, c, g, or t
acaggtgtcgtgaaaactacccctaaaagccaaaactgggaaaggaaatagactcatatcaacattgtcgtcattggacacgattgaattcgggcaagctccaccacatagctggccatctgcatctattaaatgccggtggtcactcgatcgaatagaaccagttgacataaacattttgagaaaggagcgctgcttgatgtctgggaaacgggctccgttcaagttatagcctgaggtccttggactaacatctgaagagcgtgagcggtgtaacactggtattcaccagttgattatctccgttgatggaaattttcgaagaccaagcgaagtagctatgtcgacttatcattagactgtccccaggcacagcagtacgtactttatcagaaaaacatgacttcacatgggcacagtctctagggtctgaactgtagctgtcctgcattagtatgctgctggtgttgtgtgaatcttgaaggcttggtagtctccaatgaactgggcagacccgaacatggcatgcccttctgngcttacacactgtggtgtgtagagacaactaattagtcggtgttagacaaagagtgtgattcctagcatgagacctaccctactacgtccatgaagagattatgaggaacagttgtcaaggaatgtcaggcacttaacattagagatcaattggttacaaccccgacatgagtagcatttgtgccaacttgtctggttggacatggtgacgactatgctggagccaagtgctaacatgaccttgggttcacggatggaaagtcacccgtaaaggatgggcactgccggtggaagcacgctgctttgaggctctgggactggatcctatccacatattcgtccaacttgacaagcccttgggctggcgatctccagggatgttcacaaaaaatgtggggggatgtgtcctcgtcccggattggacaaaatgacagaaggtcggtttcaaaaacccggaatgtaggtcacctatgttcaaaacaacagttaaccggagaataacctttaaaagaccaaaaagattgaggtaacccctctggaaagagtggtacacacaaact

SEQ ID NO: 643691 - DNA, 87 bp, Homo sapiens
ttgctctcactggcttccaggtgtgttgttcggggacagccaccggcttgagtctggccaaggaggtgattaaacagctcagcttct

SEQ ID NO: 643692 - DNA, 431 bp, Homo sapiens
  misc_feature (39)..(39): n is a, c, g, or t
ctgctgccagggcctgcagggagcctactctttgcccgntgcccaaagcagccggccagatcctgcacttgttcacccacgcgttcctcgcaagaagagcttgagcatggcgggccgagtgaacagggcacgcctatcgcaagtctgatgaaggggtggagaaaaactcctgcatcaaagagccattatatatgtaacttaaatagttgagaaaaaagttgtctctgtgtgtgtgtgtgtgtatgtgtgtgtgtgtgtgtttcaagagagggagagagagagagaggagagaggagaaatgataaagcaaatgagatgaacatattaacaacaggtgagtctaggtaaaggatgtactggtacactatttttattcttgcaacttttctgtaagtttgaaactatttccaaataaaaaggtattttttttt

SEQ ID NO: 643693 - DNA, 747 bp, Homo sapiens
  misc_feature (614)..(614): n is a, c, g, or t
  misc_feature (678)..(678): n is a, c, g, or t
cagatctatgagcttgttgagctccttgaagggatgtctacaaagctgcagcttattcacatcccaacgtgtaggtgcactgagccatatagcccagagtatgcatgtgtgagtgtgttgatgcacacacacactctctctcttgaccatctgtctctctctcactctttcttactactctcttcaggacactagacactgggtgttctagtagaagctcactcgccatctctcaggggggttccggattacatacatcacactcccactactggagtcgcggggaactggagggagcagaacactgatttgtcactggtcaagatagattgagactagttcacctctagctagatctctgagaaccaatacactgaaaacttgtgtgcttagagcgatgactcaatgactaatatgccaaaagctcaacacctatattggagtacttatatccatatagacgtgctataatatatggtcatgctctggatatttcaaggatctgtatctattcatccaagagtactcctgagctcttatcagcgacactaatttatcaaatttgcagcactttgaaaagatgagatcgcttcctaccactatagatgtgtgtntctatgtgatataccatacaaaaactcttttagtgtaaagattctagcactaaatacaattggnacacacattataaggatgatgtttttatgtgcctgataccagaattcctttacgtagtgccgcgtctgt

SEQ ID NO: 643694 - DNA, 165 bp, Homo sapiens
gcccacgtttattagaaaaaaaagtgtagtatactaggcaaaaggacccagagatgagcttttcccagtacttattttagaggtgaggacatcgcatcgcttatttgtaacaaaaccaggactagaacccagagatcctgactgccagtgaagcttggctatttt

SEQ ID NO: 643695 - DNA, 255 bp, Homo sapiens
  misc_feature (69)..(69): n is a, c, g, or t
  misc_feature (81)..(81): n is a, c, g, or t
  misc_feature (140)..(140): n is a, c, g, or t
  misc_feature (208)..(208): n is a, c, g, or t
  misc_feature (243)..(243): n is a, c, g, or t
gcagagacgagactcagtgagtgagcaggtgttttggacaatggactggttgagcccatccctattatnaaaatgtctccngacctgtgatacaaaagatcttccgggggctgcacctgcctgcctttgcctaaggcggntttgaatctctttctctcccttcaaccgctggttcctgacgggcatgactgtggccggcgtggttctnctgggctcactcttcagtcggaaatgaccagacantgaccattcact

SEQ ID NO: 643696 - DNA, 148 bp, Homo sapiens
  misc_feature (69)..(69): n is a, c, g, or t
gcagagacgagactcagtgagtgagcaggtgttttggacaatggactggttgagcccatccctattatnaaaacggtctcaggagcaagcaggcagcatggtggttgacatttctctcctacaaagctttcccagaataggatacagg

SEQ ID NO: 643697 - DNA, 254 bp, Homo sapiens
tgggaaacagagcctggttttgccgcccagcctggagggcaggggcccaatctaagttaattgaaggtttggcctccggggttaacgcaattttcttgcttaagcctccggagaggcgggaactacgggcccccgccaccatgccgggaaaatttttggtattttaagaaacacggggtttaaccgggtaagccacaagggtctgaatttccggacctaatgacccgcccgcctaagcctccaaaagttatggg

SEQ ID NO: 643698 - DNA, 848 bp, Homo sapiens
gactggaaggagtcatggcggatggtcaggtggcggaactgctgctccggcggtggaggcgtctgatggcggctggacagcgccgagttggcggtgagctgggcatggagcaccaggcggtgtgtgggcgccgtgaagagccttcaggcgctgggcgaggtcatcgaggctgaacttcgggtccaccaatggactatgtccagcgggtcaagcggacccactctcagggcggctacggctcacaggggtacaagtataactggaagctggacgaggcccggaaaaaaacctattggaaccccaaccaaatcagccagcgcccgtgcgcctctacctgctgtgcccagaaagaagcccttcactccgggtcaagtactttctccatcgaccggtattccggaatgagacccctggacgccaacgcacctggctgagtccaccagatcgaggggcgtggtggcggatcatggtctcacctgtggccaacctcatgggcgtctgcggggagttcttcacaagctgggtatcacggcaactccgttcaaggccagctagaaaccataaaagaggccagcatggagggtgttcagtaaccaccaggggcctgaaaaagtggggtggggtcggaaaactcgggggtcttcagtcagaagatgctgctgccatggggttccgagaaagtgttggtcatgctgggctctcctgggagcccacggtgactatttggttaccattccggctggggcccaagtgctgcgtgtgttgagccctggcgcgttggacggccctcaagggggtgtgcccataagagatccagctttgctttcccgctttttgtgtgccctttc

SEQ ID NO: 643699 - DNA, 310 bp, Homo sapiens
aatcactctaggattcttgctttatcttaccagaatatcccattatcaataacccagaaagtattatatgaaatatttgaatctcagattcaatttaacaaatgtgatcaccaagacttgcagaggcagagaactaaaaacaaaccttttctttttttttttttgggtgggcaaccaaaataacataatattccgggctctctctgattgagaaaggcggggcttctattatattttctgaaagccaggacagctccaagacaggtttacattacgggaccgcctttgcactccggccggataccgagct

SEQ ID NO: 643700 - DNA, 204 bp, Homo sapiens
gtgtggatggatcagactctcagcccccctacccatcgatgccttggtgagccgttacctcaccaactaactaatggaacgcatgcctatctcttagcaataaatctttccttaataactcatgcgagaaattaagaatatgcggtattagtccggatttctccgggttatcccccactaagaggcaagttgcatacgcgttac

SEQ ID NO: 643701 - DNA, 243 bp, Homo sapiens
  misc_feature (83)..(83): n is a, c, g, or t
aggcagaagggacgctactgacttaagccaaaccctgattggtggataaagtattcagttgttccattcatgcctatcctttntacagctctcgcgactataacaaacaactgataaaatagcatcagtccctccaccaggttgccctcaaggaagccatgtttgtgacgatccgaccagtccctgacgatctctctagaccaccctgacctcgccgagagtgctgaaggagctatctaacca

SEQ ID NO: 643702 - DNA, 297 bp, Homo sapiens
cccccccccccagcttttttgggtttgcatcccagggggcctcaaacacggccctcccccctgtcagatttgggtgagcaaacccagtggggctgttaggtcctccagttccaaaccagtttagggacccccctcccctgtttttgggaattcccaccccaaagaagcaaaaagggaaaaagtttcccccaatttttcccatgagcaagaccccctttaaagggggcaaatatttttccagattttttctaggcataagaatatttgtttaaaaacttataaaggggattatcccca

SEQ ID NO: 643703 - DNA, 399 bp, Homo sapiens
  misc_feature (13)..(13): n is a, c, g, or t
tccgggggccctnagggggttgggaagctcttttactctgatcccctccctggggcgggccccgtagaagtttcccggaaaaacccttaatttttgggggccgtggcggggaaagccctgccgggattcccccaaaagcccccgggggggttaaatgtggatgtttcttttgcccccccgggggggttttggtcccgcccccccccagattaggtgccgcccccccaagagggctttggccgtcccccaggaaaccgggccccgcctcccgggccccaaattcggccagcctctccccggtttgggtcccgcccttttacccccggctttgctggtcctggggagaaccaaattggtcccgcccgcccctaattccataaaactgttttgtgggccgga

SEQ ID NO: 643704 - DNA, 99 bp, Homo sapiens
tatgaatgatggtgtttatggttcttttgcaagtaaactgtctgaggacttaaataccattccagaggttcacaagaaatataaggaagatgagcctct

SEQ ID NO: 643705 - DNA, 135 bp, Homo sapiens
  misc_feature (88)..(88): n is a, c, g, or t
  misc_feature (91)..(91): n is a, c, g, or t
gagtcagtggccaactcctggctcagtggggattgtgctcgtcccctccgttcccctccagtcttcctcccgataccggaacgcgtcntgngcttgtttggctgaggaggagcaaagaatgcaggattatttaga

SEQ ID NO: 643706 - DNA, 137 bp, Homo sapiens
gccttgaattgtgaaaaataatttattaatgatcagatatttaaaagaaataaaatgatagaatataataaatatgttgaaataatttagaaaaataaaatattttaagaaataaaattaaagatatattaaagaaa

SEQ ID NO: 643707 - DNA, 146 bp, Homo sapiens
attggttccaagacgcgtaggcgagattgtctgaaagcccccggtatcattcctcgaatttcagtgcgggaaccaatgcagacttgcattaaggcctgtggatagcttggtgcccaatttgtcgttgtcaccgtaacctattattt

SEQ ID NO: 643708 - DNA, 165 bp, Homo sapiens
  misc_feature (17)..(17): n is a, c, g, or t
  misc_feature (58)..(58): n is a, c, g, or t
  misc_feature (62)..(62): n is a, c, g, or t
ggccaacttggacgctntccctgtacgaaggctggatgaacttcaggccggacactanctcncggtaaacccggaaagagaccctaatccggtactccacaccccccttcagcacaaacgactgcttctggaagctctccaggtcgcccgtcaggtccagcttcc

SEQ ID NO: 643709 - DNA, 991 bp, Homo sapiens
  misc_feature (120)..(120): n is a, c, g, or t
  misc_feature (344)..(344): n is a, c, g, or t
ctgatgctcgcttgtagtgcctcgttgcggagcgtacctgattacctacttttgtgcaagcgagtggctgtaggtagtacatcacgttcgcttcggcgcaatggcctgagtgtaaatatngccacaaatggaaagaggacgtcgaaagtactggtatgcaacacatcgtagtacattacttacactataaggagatgggttgcgccggggagtcaagggcagtggtgtatctcgctcgtgattgccatgatctctatcgaatttcacagtacgcgtcagtaaactgcctcagttgagcttatgaccttaaatggcccagtccttagtgttgtgaaagcgtagtnggagtagtatgtcaacccgatgcgacttggatcatgtacttcaccgtattggcggacagagggacaatagcaacaattccagattcgaaaacaaccgaagtaccaacaaacgcatggccaatcattgctttcgcgaggagatggagcaggggattagaagcgcactcatcgaagattggaataagttgtttgccaaagacaaaggcacgcatctgagcgagagggttcgttcccttatcggggggaggaccgggtggggaacctctagaggctttccttgtgtttaaccttcacaagtacaccatgctggctaactttttggaatgggcatcgccaatagaaatcttatcccagttggcttcgatacttttaggaaaagagagcctcgtcagagtatatcgggttttcgcacccaatatttcccttggaatctgaacgtaacccggtggtaaggttctaaggcatcattaatttctattgcaatttttccccccacgcatttctccaccattagccgccgttctattggtttagccagttaaaaacgtggaaccgttgggtgtaattcctgtggtgccccacaagagaccattattgcgctgcatgtcacacccattcttgggcaggacaatccttacagggaagcc

SEQ ID NO: 643710 - DNA, 107 bp, Homo sapiens
tcatacactcctatgaaaaaattctaccactcaccctagcattacttatatgacatgtctccatacccattacaatctccagcattccccctttggcccttatcgag

SEQ ID NO: 643711 - DNA, 270 bp, Homo sapiens
aatgtaattgttagaatggccgcagcgcggtccagcaaacctctcaggggacgcttcgcaatgtcgtgactggaaaacctctcgggggagaagtcgaggacgtgctgctgtgggtgctgcgagtccccggggcggcaggcgctgcaggaaggtccgcctacaatttgtccaggaaggttgtccagggcaggggtgccttctttcaggcccttgcgcttgcgggtctccgccaccacctggctggggcggctgccgttgttcttcgacgaa

SEQ ID NO: 643712 - DNA, 167 bp, Homo sapiens
gtcctctatcgtgtaacatctaggaccactcttgatagcttcctaagtggtctttctgtagtttccttgctctgtcctgttctccgcagaggaaccacagtaatcctttgaaacatgaatcatgtcactcttcttttcaaaaccctccaatggtttagcatcacact

SEQ ID NO: 643713 - DNA, 102 bp, Homo sapiens
caggcaaggggcagaaggggcatcagctccctgggtgggcccagcctactgcagtctcagtgcctctattagaggtgcatgggctgtcgggctagtcggggg

SEQ ID NO: 643714 - DNA, 646 bp, Homo sapiens
ccccaatcacactaccttactagattatagagatgacatgtggaagattacagggacaattgaagtgtttaactcaggaggaaaacttctcaggagaatatgggaagtttcagtcgaacaacagtctactgtaggtcctataacatcactttggttaggacactactctcctgtcattcacaatgtattggcgaaagatgtcttcgtggtactccggaagacaaaattctgaaatcagccgtgatgacctggtttttttttttctctccgttctgggtgtttacagggagggtgtttgacccgaaaaaaccctgtggagtccaggacccggaaaacaaaaggtcctgcacgcgaatcactcacctgcaaggtgagacacactgaccttttaaactcatttcccattggctacacagcttattctgaccatcagttcgcattactttatttggccttgtgtgctttattttccttgataccagggaaagctacatttgaagtctcatttaaatgtgtttttatggccctctaatgccacttctctttgttattatattgtgtgtgtcccagactcactccctgatccaccgacgggccgtcccaggcaggcagaaagaattaggggcgttaaaaggtaccgagctca

SEQ ID NO: 643715 - DNA, 421 bp, Homo sapiens
gttgtcacgatgtataatggttcaggtgcggacttccaacatccatgcggagtcctgcaacgggacatatcttcatactcttctggtggctgcattcagtgtataccttctctggaggattgcagagacaggccgaggcccttggccagcgccttcctgtccttccccagcaggctgtcgtagggagtcaagtacctgccgcagcccccgctagtttgcgatttccccccagcacggtccgaaaacttgaagggcgacttcaacttgtcctgcttggtgggggagagggccttgtcgagcttgcgttgccaactgctcctggtcgctggccatcttcttcttcttaatctttagctgactgatgaagtcggacgaggcctcatgttcatcccaagtctggttcctccagagaaggtaaaca

SEQ ID NO: 643716 - DNA, 346 bp, Homo sapiens
atattaaaattcgccgggtgtggtggtacacgcctatcatcccagctactcgggaggctgaggcaggagaccggcttgaacccaggaggtggaggttgcggtgagccgagatcgcgccattttactccagcctgggtgacaagaacgaaactccatctcaaagaaaataataataataataataggtagggtccaagcttcttgagtggattagacaaagcagacttcgtgttcatcatatatcatatgatgaacagttcaattgcacccacaggagagaggtcttcttggagaatgcttgtatatagaatcttctgtaaaatagagtaggctacttctaatgata

SEQ ID NO: 643717 - DNA, 415 bp, Homo sapiens
  misc_feature (4)..(4): n is a, c, g, or t
  misc_feature (49)..(49): n is a, c, g, or t
atgnaaactggagacattacaacccaatggcccacagaacgccaatagntccatttgagactacctattaacacccccctatgcatatcaactagaaaaccctcgaggaaatggataaattcccggaaacatacaaccctccctagattaaatccggaagaaatagaaaccctgagcagacccaataacaagcagcaagattaaatccagtaataaaaaaaattgcccaacaaagaaaaagcccagggctagatagattcacagctgaattctaccagatattcaaagatgaactggtatcaatcttactgcaactattgcaaaagattgagaaagagggaattctctctgaatcattctttgaagccggtattaccctgataccaaaactcagaaaggacataacaaaaaaaaa

SEQ ID NO: 643718 - DNA, 117 bp, Homo sapiens
gctttggatggaaagtcctagggtgattctatttctggcggtgattaatctagctgaaagctcagctgggggtggtgcaagctagggacccattcctgtgtaatacaaggtctgcac

SEQ ID NO: 643719 - DNA, 136 bp, Homo sapiens
ctcggcgagtgttatcagttctacaaatattgtcagtagaatgtagacatctgcacaccagaaaaaaagggtacttacattaaatggacaaattcctagaagcatacaatctgccaaaaatgaaccattaagaaat

SEQ ID NO: 643720 - DNA, 295 bp, Homo sapiens
  misc_feature (70)..(70): n is a, c, g, or t
ggatgtacgacaaggctgtggccaaggtcatccctgagctgaagggaaagctcactgggcatggcctttntgtgtccccaactgccaaggtgtcagtgttggacctgacctggcggtctagaaaaaacctgccaaattatgatgacatcaagaagggtgttagaagcaaggcgtcgggagggcccccttcaggggcattccggggcatacacgtgaccaccaggttggtctccttcgtgatttcaacagcgaacacccacttcttcaaccgtgccttatctgcggggtacggagc

SEQ ID NO: 643721 - DNA, 444 bp, Homo sapiens
  misc_feature (168)..(168): n is a, c, g, or t
agaaagtgagcacaagaagcattcttcacagatgtgaaacaacaggaattgcttgagaaatgtcagttctgaatcatcagggaagggggagaataattttaaaatgctaaaatggctttcagatgcctgttccactgtttgtgtgtttgcatcctgtgtcaataatancttggctctaacagaaacacctgggccccagccatcgtcaacacacattggggcccttctccaaaacacaggaggctgagtcctctcctgccctggtgagaggcgcctgccacagaggggtgggagacagggaaggggaagttctttcctgaggctgaagctctcgagcttggaattgcgctgtttgcaacatggccagggaatgacagtgaccctagaaggcttttctccttgtcaccacccggctgcttacagctcccctggcggccggcctgc

SEQ ID NO: 643722 - DNA, 642 bp, Homo sapiens
ccattttcttcttttgtccttctcccaggcttttgacacctgctagaggcagctacacacccactttggcatagccttcatttcttacggcacttttgctgaatccttctgttcatcccctaatgttactcatgttgacattccttctggtggctaagtctagtttctactcagtagccagagtcttttttaaactttaattggattatgtcaccacctgagtaagcccaccatgaatactgcattggaattagcattaataccagcctctacactgcggtctccccactcctgatctagccctggccttatttcaaacaccgccttcccacgacggtgctccagccatgccagccttccttaaagtgccatgccctttcctggtgcagggcccaggcctatgctgttcctcctcttcccatggtggtttccttttcaaacttaaaggctcaacttaatagtccctcttcccagaggccttctctcactaccctttataaagtaggtctcttctgttagttagtttctccaccctgtatattttcttcagtaacaaaacaccatttgtaattatttaataattacagtttattatctgtctttgtcaccaggctgtacatgtcatgaggtcaaggaccttgt

SEQ ID NO: 643723 - DNA, 414 bp, Homo sapiens
tttcctctccctactgtatcctacaaagcacttattcattttacagtctcatatgaagattgcattctagtcaagggaccaagtctatcatcaagctgtggggccaaagtcagtaactatctcaaccacacaaatattcatagaatgcccagacattcaaataagaagagaggaagtcaaactatccctgtttgaagatgacatgatcctatatctagaaaaccccatcatctcagcccaaaagcttcttaagctcattagcaacttcagcaaagtctcaggatacaaaatcaacgtgcaaaaatcgctagcattcctatataccaacaacaggcaagcagagagccaattcatgaacgaactcccattcactattgccacaaaaagaataaactacctaggatacagtaggga

SEQ ID NO: 643724 - DNA, 1114 bp, Homo sapiens
caatctttctggatgagctatggaaaggagccgctgtacagggcaactgatcctcgtcgtgaaggtgctgaaggttcgagacatggagtacaaggaagagacagtggacttcaattgaaagagtgtccccggctcaggattttcatcgcactccaaatgtgctcccagttgctagtgtgcctgccatgtctccacctgctcctcatcctactctcatcacacactggatgccatatggaatccctctacaatgtactacatgaaggcaccaatattcgtcgtggaccagagccaggctgtagaagttatgctatcaggacacatggacaaggggacataggaccttcctacacacactcacagcccctcatcccactgacatgctctcaatagccgtagctgtcaatgattgatgacggacatgactgcccgaattagcatggctgatgctcacgttctctttccaatgtcctgggtcgcatgtatgcacccgtgcctgaggtagacccccgaacgcatctgcaccacacgacgcctgcaccacacaaaccagacgctacagcagactatgtggcaggttctgcaggcagcttcagtacggaaactggtgacaaggtcgagtgaacgcatttggctctgaccctctccaatcatagcagcattggaaattgcactgctggcacatgaacatggccattccggccctaacaacccacacacgttctctccctcatgtgagaacacgctcaatgcactcttctggcctgtcaaccacactccccacgtacaatacacccccaccatatacactatacttctaccataaccttatcacacacttcagtcacaaactagactcaacgcccatgtcgacactcaccatatttctcaactgccccgcgatcttcccctccactcccaccctcttctactcacccaccccccctctccaccccccttccccctcactccctcctcacgatccatcacccactcacccacaccccccccaccccgcctaccgccccatcatctatccaccaccaacaccatcaccacccaccacccaccgcacacccacaccacaacctaccaccacctctccccaccctcc

SEQ ID NO: 643725 - DNA, 89 bp, Homo sapiens
gatcacctttgaccaccacctcggtccctccgccgaaaggattatcaccataagcactacattgacaatagtaagtggcagcatcggca

SEQ ID NO: 643726 - DNA, 82 bp, Homo sapiens
gctgagcgggccacccgggccgagtgcttcttcatgatgagtcggccgcctgcaggagcttccgccgatcgcctacatcttg

SEQ ID NO: 643727 - DNA, 129 bp, Homo sapiens
cagagttcttcacccccgaaacccatgaagcccttctgagcgcttgccggtttaagtggacgcgtatcagcgtctcgatcttgggcagcatgttccagttggtgaaatccaaagaggccagacgggcgg

SEQ ID NO: 643728 - DNA, 1061 bp, Homo sapiens
  misc_feature (128)..(128): n is a, c, g, or t
  misc_feature (131)..(131): n is a, c, g, or t
ctacctatgaagggtagtggtccgcaagagtgcattgtatacccgctagaatcccctaatgaagtattcaatccatagtcatatccgtactgacgtgccgcatctatgacgtgtcaacatcgagcctngantcgtcacgctataggtcatagatatgaaaagggaagtctgaaagaatctaaagtaatatcataagcaatcgtgcctttattaaccatatttattactggagagtcgtcatatttctcaaccacatcgcttacgagaggcgaatcaagaagcactttccgaggtcatgccacgtttcgagtcaaattgaccgctgatccgaggtatgcttacagtgctactatatccgattatttttgagtaagacccgtcaagagcatttcacaaccgggatctatacatcagtccaatctgaatgtaagggctttactaggcatatttaccataccatcattatgccattgctgtactagtacacgtgagcaaatctgtaaactgtatttatccaactatttgacaatgccgcacaaaacagattccaactttttttgcatgtcatatcggaaacacgaccgccaagtgccggacccgtagaataaacttagagcgatgtctaacgtagaacaatgggttgcgatgttgagtacatttcaatattccattggtttattaggttcctactccaacttctttacttattgcatttgaaatgcggggtaccgtctcacaccataccatattgaccaaaggggcccaaaaacagggggacaaaacaacgcaaaggttctcgaggacgaacagaacggacgacgagcactttgggtttaaccaaaccgcccaactggtattaaacccaaaactgacatcgccggacattcggataggagaaccctattcttcggggacaaaggaaatttgggcttccgccctttttgacacacaccaacacttcccttgcgtttgggttaacaatgccccaagtatatttgcggtgtgtacaacacttaggttaccccgagtttcttcagaacccaaacaagttggcacacacg

SEQ ID NO: 643729 - DNA, 429 bp, Homo sapiens
  misc_feature (230)..(230): n is a, c, g, or t
  misc_feature (237)..(237): n is a, c, g, or t
  misc_feature (298)..(298): n is a, c, g, or t
  misc_feature (331)..(331): n is a, c, g, or t
  misc_feature (373)..(373): n is a, c, g, or t
  misc_feature (403)..(403): n is a, c, g, or t
aaacaaacttggtgctgttgtggggtgcatggtgggagtgacagtggccttttgggttgtgtggaagctgggtgatgcctgtaattgctggctttcccccacttccctgaccaacctgcatgacacagcagaggcagccataatcttcctgggaacataactccattggcctgggaaccacacccccatcccccatagcagctgcagcaactcctgccaaggagagtcanagctcanacgtgcctagccttgcccaacctgatggtccttctggctcactctagtagctgaagacaanaggcatatactcttgggagttctaggccccatncactgctgatgctcctatattaccacagctgatgctctcttnaaagcgccacctctggaggaggccatcagnactagttcattcacccaacttggcct

SEQ ID NO: 643730 - DNA, 157 bp, Homo sapiens; identical to SEQ ID NO: 480870

SEQ ID NO: 643731 - DNA, 1041 bp, Homo sapiens
gagactatcaggatccggagacggaaatgtccgaacggccgcacgtacttgaccctgtacttttgggacgtcgaacggacgaatggaacacctgcacacgtggaacatcttggaacaacggtaatggacgaagaaacgcactgaaacacgacacaccacgaagttgacaaaaacagaaacggtcacgcagttcaaacaggtgcttgcaggtatggctcaagcacgtggactatctggttctggcggcatgccaatcttcacacaggaatagatttcttatcgagcaacagcatcaacaaaatctagcagatggaatatgttagatatatcactcacttgtgtcttcatcaaccaccactgaaacacaattgacctcactgatggcgaaagtcactctagcccagcagccatagagaaagttccagctcagtagcacacagcaagactcctgggacagggcacccagaaaatcccgggaagcgacaacaccaccccatcatgaggaggacacaacaacccaacaggagatagacgagactagacaccggcacacgaagatcatgataggaaagtaacatatcccaacagacactagtccacccaccaagagcataggaattagcaacagaaacaaatagaaggaacaaactagaagcagacacaaagaacgaatacatataacagtaatacaccagcacataaaaacgggaagactcggaagactccaaacagcaaatatacgcaaccaaggcgacatcaggaacgcaccagcaaccagagccagcaaaccaacaaaagagcaactaaaaaaccaacaccaccccagcaaaacaggccccaacgcaacaccaggacaatctccataaccaccagcgaacaataacccaggtcccacgccccaaacgcagcggcacgaccacacaaaaaaacacgacgacaacgggagagccagaaaacgcggatggagagaacaaaaccaacaacaacagaaaggcggaacgacacccagaataacaacaaacaaagaacaccaaaaagagg

SEQ ID NO: 643732 - DNA, 125 bp, Homo sapiens
actttactctgtgggggcgcagtcttgatctgtactgtgcagagccccaccacaaggtcagcaatagaatgtgtcctcagtctccccagagacggtggctcaccatcacacccccagccattaga

SEQ ID NO: 643733 - DNA, 518 bp, Homo sapiens
cccccccccccccccccaaaataatttttttttgggggcccgccgggaaaaaaaaaaaaaaaatttttctttggggggggggtggggggggggataacattttcttttttggggggccaattttttttggggggggggggtttttgttttccgccccccacaacttctgggggaggaaattttttggggggggggggagcccaacacaccttgtttggttttataaagggcggcccccccccccaaaaaaaaaaggttttttttcgcgcgctttaaaaaacacacaccccctctttgaaaaaaaggggggttttccccgggtttttcccccccccgaagaaaatcccgtgggtgtcccccaagaggcccccccccctttttttaaacaaaaaatcggggggaaaaaaaacccggggggggtggggtttttcccggaaaaagggggcttgaaagcccgtgggtgggaatccctgagcaaggccgcctccttccaaaagcaccacattcttcttgtatga

SEQ ID NO: 643734 - DNA, 257 bp, Homo sapiens
  misc_feature (49)..(49): n is a, c, g, or t
  misc_feature (167)..(167): n is a, c, g, or t
tggctcttcatcttcctctactcagtttctattatagccggcgctccancatgtctgtggcagtacagacagtagagatcttcggctactccttactcactggttatgttttcttcctcatgctgggcaccatctcctttttttcttcccctaaagttcatccgcgnatatctatgttaacctcacagatggactgagttcttgtatgtgcagaactattttcagtatctcttgtagctgtcgaggctagtccgcgg

SEQ ID NO: 643735 - DNA, 1366 bp, Homo sapiens
acaggatgtcgtgaagagactacccctaaaagccaaaatgggaactggaaaagactcatatcaacattgtcgtcattggacactgtagattcgggccaagtccaccgactactggccatctgatctataaatgcggtggcatcgcaccacaaagaaccattagcaacacaatttgagcaaggcaggctgcatgagaatgggcaaagaggctccttcaaagctatgcctgtggtcattgcgcatcacaactgcacacagctgcagcgtgcaacgtggtatcaccacttgatactctccttgctggaacatttgagaccagcaagctactatgatgacctagtcattgatgaccccaggaccacagacgacttttatcaaaaaccatgactcacacgtggaacatatctaccagggctggacctgcctgctgctaccatgaactttgatatcgcctcggcctcgggatgatacgcgttgacacttccggacacgcctgggcttactacttccacacgacactggggtgtccacgatcaccccggacgtaagcccaattggccccccattttccctcgggccactttcaaccaccacacatggagcagcactggattgcacaaacaaccacaaccacataaacgctattgctccggagctgggatatatcaacgaaatcaacactggcgaacatttacccaacattgaagagcaccaaacacccaacttaacaaagcccccaacggcaaaacggaaagacacatcaacctagcaccgcggacaacaacagctcgggatcacacacgagcgcacacaggctcacacgggaccacacatgagtaacccacctttcgacaccggcacacaacaacctctgccgaccctataaccaaacaccccacccacggcaacgacaccacagcctaacgaccacaaatgcgtagcgtcaggacacaacacatcacacatccctggcgccaccacacggcaaaccctgcgtcgctagaaaccaaacaaccaaattcggccattgagaacgaaccccaaaacgcatgagcacacacaaacccagtgaaccccactactagagaaacacacaaaacgggaggaacttggtcaagcaacatggactaaccacccccggataaacagtcgaacatttgtgcataaaaccatgacaccaagataaggacacacaccccataagcgacataccttatatgcaaccggcctcatggagcacaacgacgacattctcattacacccacacaaaaactactctcgctcccaaccttgaacacaatcgtcaccaatagtacaccagaacatatctataccaagagcagcatctaaatacaactaaatatg

SEQ ID NO: 643736 - DNA, 405 bp, Homo sapiens
aaagactctccttttcccattgcgtgttattgatgcctttgtcaaagataaggtggctgtaaatgcgtggatttatacctgagttctctcatctgtttcactgatccatgtgtctgtttttatgccagtaccatgctgttttgattactatagctttgtcataaattctgaagtcaggtagtgtgatgcctccagctacattctttttgctcaggattgctttggctattcatagtcttgcggttccatgtaaattttaggttattctttgtttattttgtttacctatttctgtgaagaatgttattggtatttggatacagtattgttaggaatctgaaaattgctttgggtagtcttgtcatttaaaatctctggaattagtcttctaatccatgaacattt

SEQ ID NO: 643737 - DNA, 890 bp, Homo sapiens
gtgagaacggatccgccatgagtaacggcgactccatgactcaagcactggaagacaaaagtagtgttacatgcactgccgagttttgtggatactctgggtatagcttccacccttcgctagggacgaagtttgtagctggcagagtgctgctcgtacattgatgaggcagtgtgaacagatgccgcgagataacctgccctatgagtcgcaacattgttgaccactagtgttgatacgcaggaagttgacgagattgacgagtgagtggagttggcaatgtaccaggagaagagagactcacgtacaagcggggctcgtgtgaaggtggtgagtgacggatcgtaattatgcgggtgatacataggctgatgggtgaatcgttagacgactggagaccgtgtggcgtgtgttgacatcgtgagacacatggccacgaaaaggaacacttcaagcagaagcatggagatgctggagaagatagcttgggtagcgaatctcatacatttacttgcggctggggaacgtggtggacttgtggatgacatggtgaacgtgacacttaatacgctgaatgtgagagtgatgatcgtggcaaatgttgttattcctcaggtttgaacaggcagagcacttcatgggagaactgttgggagtgagacacattggaaatcgagaccgggatgggagattaaatggtgcgttgggtagaaagattgcctaatttgtcaattttacccaaactttcaaaccaatttaccaagagttggtaggactgatctttaaataaaataaactttgggtttgaaacggttagtaagtggccttgtaggggtttaagccaagaatatgaggtgtaaggccaattatctgacttcagggaggaatgt

SEQ ID NO: 643738 - DNA, 433 bp, Homo sapiens
cgtacatatgtgtaccatcattttacacaagtctcggatgggaagtctcttatccagcacctgggtcctcgataatctctaggacactgcctaccccaaatgcaggcgcctccctccgggaaattctcgttatgaacaagtatccaattccaaccccaaatcctgtctcttctgttacctcatttctctccttatccccttagccccaagtcccagggtgccctcttttcagaaaaactccacaaactctggacgccagaatcccttctacttactccttaacctttccagtccccccatttcccagtcctactagaaagctgccctgaggcctggtgcagtgattcacgcctgtaatcccagcacttcaggaggccgaggtgagatcacctgaacccaggagttcaagaccaccctgggcaacattatggag

SEQ ID NO: 643739 - DNA, 308 bp, Homo sapiens
ttttttttgttttgttttgtttttgggggggggggggggtggccccgggaaaagtggaacccaacctgtttttaaatccctattggaaataaaaatggtttgagggccagggatattctccccgaatggacttattttcccccggcagggccgggggtccccccggttttggatatgttgctagaatttagattggaaaaaagggaaattttaatgggttcctttgtttttaagggaaatatgtcttgccccgattttttggtttaaataaaccccccctgggggttggggcttttcctttttcttta

SEQ ID NO: 643740 - DNA, 660 bp, Homo sapiens
  misc_feature (67)..(67): n is a, c, g, or t
tggggctctaaagggggtaaagggggtgctaaggggtaaataggggccctatttacaaaaattttanggggaaattaattctgaggacgaagtgggctatgaaagcgtggtggttggcctccacgagaatttcagaagcatgtgaccgtagttataccccgcggtcggtgtagcgggtgaaaggtggttgggttaaaacggtctccggggaattgtgcatctctgtggttttataagcctataatgtggtggggaccaagctctcagtgaagtgtgcaaaagcgttcttgggtgagtgttaatttattataatacgaaaggggggctttcaactggggagttacatacctcgaagtggtgtcaccggttcagaggagatctcgacagggtctcgccgtgggtctcttaggaaatataaaggggggaaagtatagtgtttaggcagtttgaaagacatttagctccgcccgtataactcgggggttcaccccaagagggtctcacgacacccatgtgtgggggcgccaagtggagttgagggggggaaagcggggaggggggactcgatgagaacccatcggccgggtacactgctaaaaggggaatcgcaaacggggaattgcgaaaggcccgaaagacgcgccttacaaaaataaaatg

SEQ ID NO: 643741 - DNA, 218 bp, Homo sapiens
cctctagagtatcccctgctcatccctccttggtcagacattttatttgaattcttttattttttatttttttgaaatggagtctctgtcacccaggctggggtgcagtggcgcgatctcagctcactctaacctccgccttctgggatcaatcaattctcctgcctcagtctcctgagtagcagggactacaggtgtgcgccaaggagggatgagca

SEQ ID NO: 643742 - DNA, 554 bp, Homo sapiens
  misc_feature (35)..(35): n is a, c, g, or t
  misc_feature (120)..(120): n is a, c, g, or t
  misc_feature (188)..(188): n is a, c, g, or t
  misc_feature (280)..(280): n is a, c, g, or t
  misc_feature (310)..(310): n is a, c, g, or t
  misc_feature (339)..(339): n is a, c, g, or t
  misc_feature (396)..(396): n is a, c, g, or t
  misc_feature (484)..(484): n is a, c, g, or t
  misc_feature (521)..(521): n is a, c, g, or t
tggagtcgatatttgcagtcaatggagcatccagntaggaaactggattggaccatttgaagagtgagtaaaagtgaggacgaggttaaggttgactgttttgagtagagagcttcaggnaaggattgttctctgggttcagggagccagctgaacctaaaggaaaaggctaaagaagctgaagaganggaggaggacctgtgaaccagagatgctcagtcattattagcgaggaaatacggagagcccctgtgtgcagtggtgactactcatgcaaaantgtcacacagccaatatttaacacagccangtatttcacacagccaatatttattagtnacatagcatataccagttattactctaggtcatgagaatggagtgataaataaaatnaatccagtcgccatcactatatgccatggtaacattttgcaatgactgtggatcaggcctatgaaatttcagtattcaatttcaatantgatcctgttggtatctgtggttatttaaaacatatncatctctggaatctaaaatttgagaggttataa

SEQ ID NO: 643743 - DNA, 448 bp, Homo sapiens
ggcttttcctaccctaagagtttaaaaatatttgtatgtaatttttttgttacatttcttacagtaaaatttttaatccttctggaatttcttttgttttagcgtaagatggagttttattttttatatactaaatttccattcaaaccatctgtttgataacttatctagggcaaatttcctttgattcttcctttttgtttgtttgttttatagagacaaagggtcttactctgtctcccacgctggagtttggtgatgcaatcaccactcactgcagccttgaacctatgggttcaaagattctctcacttcagtctctcaagtagctagaacagacacgtgctgccacacccagcttactcttctttttaatactcttcttggctattattgcatatttattctcctaggaaaactttggaaaatcgttaagtaaaatgtaaaa

SEQ ID NO: 643744 - DNA, 165 bp, Homo sapiens
  misc_feature (1)..(1): n is a, c, g, or t
  misc_feature (70)..(70): n is a, c, g, or t
  misc_feature (106)..(106): n is a, c, g, or t
  misc_feature (117)..(117): n is a, c, g, or t
  misc_feature (149)..(149): n is a, c, g, or t
nattcggcacgacggaacaagctagaagaaatgatcaatgagctagcagtggcgattgacagctgtaaanaccgaacaggaatacatggaagtccgggagagaatncacagagccancaccgacaccccaacagcagagtggtcctttngtccctctttgaagct

SEQ ID NO: 643745 - DNA, 915 bp, Homo sapiens
tgctgttcgctgtgtgaaggttgactgtgtgtgtgaggagtgccccgtcgccggcggatcgtgtccatgcataactgtatcttcttggccgacggtgtgagaaagtatggcaatgaaccctggacggctcgagtttccggtgtcaggctcaataagtcgaagcaagacagtgagtttaccatgtgtgaatcatgggctgtgcgtaaattataaagtcagcgatgcgaatcgcaagtggaggacttttgattattcatgatgtttaagctcagatcctatggatggtgtatattgtcatggcttgtaggagaatatagtacaaaaaaagaaagcctaggagtgatgaacgctaatgtagatgagtcatggattgacatctgccgtgtggactagggaagagaaactggcagcactagaggccaaaattctttaatgcccatagaagctcgatgatgtcctccagggaggtagcagcctgcaaccatgggaccctcggggcaattgggaatctccgagtagtagaccaaattcagaagaaggctagcgggcaccagataggggggcatccaggcgtcagagggtccacaggtcgcccacgctgttaaaccggattgaatggaacgtacgcgaagaatgtagaggcacgcacaggaggaagacaggcgcgggggactctactcaacgctaccgacggagtgcgacccgacggctcgctgtggaaaccacacggaatcaacccggggacgggccaggatataggcgcacggcaagaaagcaccaacgcacggcagcgctgcgctggagagacacaacccccggggagaacagacagaacacccgagcaaaaacagggccgcgcacaacggacacaccatgctaccaccgccacacgggacaacacacaccccacaccag

SEQ ID NO: 643746 - DNA, 262 bp, Homo sapiens
ctctagcaggatccccgattccgaggggagatgaagatatacttacctctcaaggtcagaatgtgtatctcttcattactgccttcaagcactatagttctttaaattgctttcccattgaaggatggaacattttggtggcatattattcattactccagaatgaagagatctcaggcccttattctaggggacagacattagagaaatgtgaactgtgcacattggcctgttattttacagtatccacccacgtggaaat

SEQ ID NO: 643747 - DNA, 507 bp, Homo sapiens
  misc_feature (80)..(80): n is a, c, g, or t
  misc_feature (98)..(98): n is a, c, g, or t
  misc_feature (118)..(118): n is a, c, g, or t
  misc_feature (125)..(126): n is a, c, g, or t
  misc_feature (129)..(129): n is a, c, g, or t
  misc_feature (131)..(132): n is a, c, g, or t
  misc_feature (135)..(135): n is a, c, g, or t
  misc_feature (142)..(142): n is a, c, g, or t
  misc_feature (144)..(145): n is a, c, g, or t
  misc_feature (152)..(152): n is a, c, g, or t
  misc_feature (179)..(179): n is a, c, g, or t
  misc_feature (183)..(183): n is a, c, g, or t
  misc_feature (185)..(185): n is a, c, g, or t
  misc_feature (198)..(198): n is a, c, g, or t
  misc_feature (210)..(210): n is a, c, g, or t
  misc_feature (242)..(242): n is a, c, g, or t
  misc_feature (245)..(245): n is a, c, g, or t
  misc_feature (247)..(247): n is a, c, g, or t
  misc_feature (255)..(256): n is a, c, g, or t
  misc_feature (266)..(266): n is a, c, g, or t
  misc_feature (271)..(271): n is a, c, g, or t
  misc_feature (275)..(275): n is a, c, g, or t
  misc_feature (277)..(277): n is a, c, g, or t
  misc_feature (307)..(307): n is a, c, g, or t
  misc_feature (326)..(326): n is a, c, g, or t
  misc_feature (330)..(330): n is a, c, g, or t
  misc_feature (337)..(337): n is a, c, g, or t
  misc_feature (340)..(340): n is a, c, g, or t
  misc_feature (346)..(346): n is a, c, g, or t
  misc_feature (361)..(361): n is a, c, g, or t
  misc_feature (387)..(387): n is a, c, g, or t
  misc_feature (389)..(389): n is a, c, g, or t
  misc_feature (412)..(412): n is a, c, g, or t
  misc_feature (424)..(424): n is a, c, g, or t
  misc_feature (502)..(502): n is a, c, g, or t
gctgagcgttgggctgtaggtcgctgtgctgtgtgatcccccagagccatgcccgagatagtggatacctgttcgttggnctcttcggcttccgtctnccggaccaagaaacttcacntcccctnnacncnncangggaagncnnccaacantaaacctgaagcagcagattaatcttnactntnacctccaaaagancacaacatctcntttccataaaaaccaaattaaaatacaaaaantantnataatatnnaaatacaacnaaaanatcntnttccacaaacaaaaacttaaaacccatacnaaattcaaatatttatttntatnctttttnccnaaaatnaacaaattcttatanaaatttcttttcacaaatattaaaanantttcctcttaactccctaaatantcaaaacaattntcccaaccaacacccatatctctttactcactcccaccccatccactccacaccaatccttccttctcaccacactcnttctc

SEQ ID NO: 643748 - DNA, 179 bp, Homo sapiens
agtagaaaataagttcaaaattttagaaatactggctttatactcgcccatgtatttacattcacagagatctttatttatttacaagcgctttgagttactgtatagttttttttaacaaaaaagcgtggggggctccctttagcattccccataggataggtaatgaactttttgtt

SEQ ID NO: 643749 - DNA, 385 bp, Homo sapiens
  misc_feature (80)..(80): n is a, c, g, or t
  misc_feature (98)..(98): n is a, c, g, or t
gctgagcgttgggctgtaggtcgctgtgctgtgtgatcccccagagccatgcccgagatagtggatacctgttcgttggnctcttcggcttccgtctnccggaccaagaaacttcaacttcggtgtcagggtcggactttaattggcggacggtgaaccggaaatctgtctctcaaggggcacatctcaaggggggcaaactgcgcaaaccctggtttgagacacaggggccctcacaatagaaagtagttttctcaatacacaagatgaaatatactctctagagaagacacagccacagggtcatcgactagagattctctcctcctatcgtttagcagcaaaaatcaagatattttattaaaatttctttgagactctccaa

SEQ ID NO: 643750 - DNA, 127 bp, Homo sapiens
atagcggtagcttcagtattgtacgtcggtaccgttggagcactatatgtactctcaggactacttaggacagaagtaggtacttgaatgtaacaagataagtcaacttgagttgtactatatttag

SEQ ID NO: 643751 - DNA, 795 bp, Homo sapiens
ttatgcgaggtagatacacaggatacaccatagggcatggaatatagacccttacaaacccctatgataggacataggaattgaatagaatataacataacgagtagaatagacaggggtagtatatagtataactagatatcaacagaggtaaggaggtaactataataatctaatagcaactagacaatccatactatgtaagccatacaccataccactattaatatattaacctacataacggaatgtagtaggtaaaaagaagtagctaggctactagagaagccaagatagacccataggtacaaactataccatactgcaacatgggtaacctgatggctacggaaataaccgtaaatacataggtacataaggctaagaataaccaggaaaaagaaggataagaagaaaaagaaaaagaatagcaaagggaagaaaaaaagagcgtagaacacacgagagaggaggcaaggaagagcaggggagaaagggcacgagaaacgagaggagagcagcaagcaccagaaccgcacagccgaagacggacaagaggcacagcacaggaacaggagaaagggaacaaacacagacaagagcagaatggacccgggcgatggaaggaaacaagacaagaagaagaggtgagggcaaagagacggagagcaaagcagaagaaacacacggacaagaagaccaagagaaaactgaagacagaaaaccagacaaggacgaaagaaaggcagaaagagcctaagccgaaaggaagaaagcgacaacaaaacgtagtaa

SEQ ID NO: 643752 - DNA, 356 bp, Homo sapiens
ttggtagcaagattctctgtgtacggattcatgcatgttataaatccagtatcttaattactatttgccttgggtactccatatgcctgattttaattccatgctgattaactgtcagagaaggaaaggacgggctgaggtgagagtttccaagcctggctgaccaggaagacagcaggcagactcttggagactggacctcatcgattatacagagaaaaatcccctgtaagttacaaaagaaaatagcacaaagaaaacactctggtcggcatctaccattaaagccgtctcctttccacgaaaacgtttcccaccgaaacaggacagacccaggcgtgccccctttaggcacc

SEQ ID NO: 643753 - DNA, 828 bp, Homo sapiens
ttcgtgtacaaagaagagcatccgttcgagaagcgccgatctgagggcgagaagatcctgaaagaaatacccggaccgggtgccggtgcaggggtcgaaacggctcccacaagctcggataggagacctggacaacacgaaatacctggtagacttctgatctcacagttggctcagttctacttcttgatccggaagcgaattcatctccgcagctgaggatgccttggtctaactttgtacaacaatgtcattccacccaccagctgcccataactgggtcagctgtaccaggacacacccatgcaccaacgacttcttatctcctaccttgcctacacgctgacgaacagtgtctacgcccctgatgacgctgactgcccactgacgcctggacgggggacgtctcacttctacaaagagagaaggtggccccaccttacttgaacctcatccatcacttcaagctacaaacacccaacttcccttatacacggcaccgagccactacctacaaatgatctgattggcatcatcatacatacacgaccatcatcatacagaactcggctaaaggcgctggcacatagcgcaatctataggcacccgacctcactatacatcctttaccattcacccgatacctcactggccacccagccaatgaaccacacgaccaagagcaacgatacacacaacagttgaaaccagcaacacatcatagacgacacacaccatcccaacatgcaccggcaaccgggaaatatagtccccccttaccaaggaactaggcccacaggtggctttccaagaaacgccccgaggaaa

SEQ ID NO: 643754 - DNA, 933 bp, Homo sapiens
  misc_feature (1)..(1): n is a, c, g, or t
  misc_feature (278)..(278): n is a, c, g, or t
  misc_feature (524)..(524): n is a, c, g, or t
ntgtaccaaagggtgcgagtgtgatgaaacagggtgtacgctagaccgcaggtgttatgggaagaaatttgcccgccggtgtgcgttaaaagcccgatggttcccaggcagagcgtgacaaccgccgctttcttaaagaattaagggggacacacctccgcttgtgaaagtggttgcctgcgtaacgtcagtatggtgtagtggaatgtgggcgccctgtgaagagccacccccgtgttaggctaataagcgggacaacataacacggcctctcttgnacaagggcaccaacatgtggtggtccgggggccaccacagtgggcgccagacaaaccctaccatggagcccccccacccccttgtgggacacgccacacgcatgggcggagagatccaccttcggccgccacaagtaatgtgtctgggtccctcgccccgggggaccactatatacgtggagaccccttcttcttctagacagaatagagcagttgcgaattgattataaacggagtctgtcattnctgtcaccgcggctgattatttacataaagaggcaccacgtggttaacaaaagagcgaggctccacgcgagattctgtcagagaatatacactagtggcgggtacacaccgttatgaagagtggtaacaagacaggagattgttcacaacgtgtgttgttttgcacacgaggaaatcatcatcctcgtcagctccacaatttggagcgtcagaaaaattgagtgctagcacttgtacatgcagacacttccttctgttcatggtttcttaggtgattctcttcctatcccccgctctttctgaggccagacagggagtagcatgccccacttctatctgatggcgggcgtgattatattcagtagtggctgcagtagagatgttgaatttaaaaaacagcaaacaaaac

SEQ ID NO: 643755 - DNA, 130 bp, Homo sapiens
  misc_feature (6)..(6): n is a, c, g, or t
  misc_feature (79)..(79): n is a, c, g, or t
  misc_feature (81)..(81): n is a, c, g, or t
acatanggaagcatttatttgaggtttaacatgaaatgatacaaataaaatgtgtataaacaaatccacattgcgtcantncacagtttgtaaaggacaaagctcctcaccgaaaactaattggcagcta

SEQ ID NO: 643756 - DNA, 278 bp, Homo sapiens
gagaaagttagccaggtgcggtggctcatgcctgtaatcccagaactttgggaggccgaagtgggtggatcacctcgaggtcgggagtttgagatcagcctgaccgacatggagaaacaccgtctctactaaaattacaaatcagccaggtgtggtggcacatgcctgtaatcccagttactcaggaggctgaggcaggagactcgcttgacccaggaggtggaggtgcgtgagcgagatcgatcgtgcactcagctagcaacagagcaacctccatc

SEQ ID NO: 643757 - DNA, 345 bp, Homo sapiens
tcgtctctgcaggatcccccgtgtatcgaggctacattaatttcttgaaacacagatctatcagctagtaggaggaagcgcgagaggcaggtcggctgttgccgtgtcgcacggtttctggtcctggcccttcctgctcctgaggccccttcctatcggtgccagcggacttctttctagggtggcctttcccactgtggggtggcagagcccagaagtgggggatcacacatagaaatgtgatgccagtgatttggaggggtctttcaaagtgcaggagacgtagctgagcacttgctccaggcgcctggactggatcggccaatccaggcagggcaggataga

SEQ ID NO: 643758 - DNA, 384 bp, Homo sapiens
tagaagaaaacaagtgtagaaataagagaagaataccagatacaatcatctagacatatagctatccagattatcccggcatcatattattgagcagaaaatagtttccccatcgctagtattattacaggtttatcgaagatcagataattgtaggtgtgaggtcttatttactgggtttactatactgttcctttggtctatttgtctgtttttagtagagacagggtttcaccatgttggtcgggctggtctcgggctcctgacctcttgatccgcctgccttggcctcccaaagtgatgggattacagatgtgagccaccgtgcctagccaaggatgagatttttaaagtatgtctcagttctgtgtcatggttgtatcg

SEQ ID NO: 643759 - DNA, 144 bp, Homo sapiens
cgcgcagccggtttcgtccaagggcggcgctccataccagtagtccctatacctatggccatagtcctgaataaggtctgcacacgatcttaacaagagtatttatatcttttgacatgatacaagatggttatacatttaaat

SEQ ID NO: 643760 - DNA, 440 bp, Homo sapiens
ttgtgaactttggacatactgcttccacccctgatgactgctccaagtgcatcattcctgaggtacagtgtctggaaactaagatgaggaggactttggaaagaaattttgaagacagcagcagcacatgtcataaatgcgacaaactcatggcatggccctgtatcctatccatccatccacctatcatcgatcatctatctattttagaattaggatatttgagagttgccaaaagcatgctgagaaatgtcagtctgcaaggaagagccctttctccacattttcattgtttcactaaatgataaagagctaccacttggcaattctccacttttttgtaaacctgagctcaccagtagcctgtgcttcccctctactttgcagttgtctattgaaaagtttgtatcttttcatgggcttatgagttaattagaaaa

SEQ ID NO: 643761 - DNA, 1892 bp, Homo sapiens
  misc_feature (900)..(900): n is a, c, g, or t
ggacgcgtgggtcgagccacgcgtacgctatacgtccctgcaggatgccatgtgcgagactatggagcagcagctactacctcggaaccctgactcggaccctgactagaggatggcagctcttctgctcccccatcagtgactaggtgctgcattccagcagactatccttgtgggtatgcaagcctggggaagccacatcccactggatccaaaaccctgcaccccacttactaccatacttacgaaaccccttactctatgactacccgtactctgttcatagatctgcctactgagtaccagtataactacatcttctaggacctgcaaacgagacttaacataagtagctaagcaactacaggcctcagcccctcggaaatgaccacacacacaccgaaacgatacctctcccaactacgctcatgcgaccacagagagattgttgattccacgacaggtctgactggcccttggagaggccagtggaacctaacttgagcgcaacaccagcaaccacgccattactagaccactgtgacaacgggcgctaacagcgccatgataggcgagatgcacccacacacaccgccacagactacaccatctcatggtcgacattagcgcacccactatgatacgaggcaacccagtatgtgtggttacggcgagctacgtgctaggctatacaactatccacccacatgccaccacacacacccctggcacactatcacaatccttctttcccgcagctataacagcacgatcaaatcagttccaggcaaccacaccacaaaccgcagtacatgacccaaaaggagctagattagataagattagcaaccactagaatccagtcaacctatgtgtaactccgaggttcatttccgagcnctagcaagcagccatagagggccaagggaaggcagcccacgcacactcaacacacccacatgcactactcccgctaggggaccacgttcggtgaatccaggcggtaggtcacacacaccgatgcggataccgcaaatatctcctctatgcatgcgacccagcacgctatcgatccgacatacggcggtctcatgcgtggcgcaaacaaactacaagtgccacaccgcatgtaccacactgtggctactgccgtgaattctaccacgaattaacgcaaccaagaggacaaacacactgggccgcgagatggatggttgtaccgccgcttcacatggatgcctagttaatcccctccaccaatactctcaaactgcttaccccagcaacgccgatcagcgctccccctatcgcacataaacgacagagaccttcgcgtcgcacacccatacacacaaacgagcggatagcctcatctgacagacaacatgcatcacgagggagcactagcatcacagacacgtccacccctgcatttgtccaccatgcttccctcccactcgcagacccatatcatcgcacgattgcacgccccatacacacagccacagctcccacgacgagcccaagccacgacgcgcccagcgcctctcggcgctaagctcgacccgccgctcccagcgcacgcatacacacagccgtagcagccctcgtgccgagctatcgccactcactcaccgtcgaccgtcatcacctctcctgcaccctcatcacatcaccacacaagtagcacacctccgcgcgacgactcagcacgtatcgcgttcaccctactcatcctcgctagccctgctgcgcgctcgtctctcgcacgagctcactccgaactacatccacgctgaggccacgcagtacatcacacatggcttcgtccatcgatcgcttcagctccgctccacgctcacgctgctctcgcgccctcacaagcgctaccc

SEQ ID NO: 643762 - DNA, 92 bp, Homo sapiens
ggcccttcctccccctccttgggggcttaataaattgggttggtgcccccccctcaatgaggaaataatatattggattgatgacaccagca

SEQ ID NO: 643763 - DNA, 282 bp, Homo sapiens
agcgattatcacactgcacacgcgaacgtcatactaaacgaaactggaataagccttcgaaacgaaatgtcctgaagctgtatctgatatcagcactggatgtagaacttgtgctgattttgaccttgtatagaagttaactgttccccatggtataagtataataccctgtacatatcttggagttcaacctttaatacgtgtggctaggtcacttcggggctaaggtaagacacgtgcttgtggaagacaagtctgtggtatgggtactcggcgtgtgca

SEQ ID NO: 643764 - DNA, 204 bp, Homo sapiens
tacgatatattgcttgtgagctcggtctctgggatgcttaagagacagagtctgactgatcctgttggacaggacagctctgctctcaggcggggaggccgaggggatgtagggaggccggcgcatatgatctagccagacctctatagaggcccggaaccaggctgccctgcttctcttccctgcaccattagaagttcgggt

SEQ ID NO: 643765 - DNA, 1059 bp, Homo sapiens
ggacgcgtggggttctagatcgcgagcggcgccctttgtttttttttttcccatggaggtgggcttaattaaggtgactgttgaggcaagggaggttctagggctggtggactgattggggggcaaggggtattctcctgtgctttaggaaattaagtgcatgtggccataaacggtaaagatgtgtagaagaactagcctgcagaattgacgagagagaggaaaacgagacaggtcatagacagggaccatttccctgtgggccagaaccaggatagtggggacttggggttggacagggagggatactctgtcacataggagactccaccagtggttcaccattgtgataccaggtttcccttaaggcccatctgtgcgcactcatccacagttacagtgccccaagatgccagcccgtgtaagctccctcaaactatccactgggagaaaagagggacggagagcgaggagatgagaacaggatgataccgcattttggccacttcaagatttcccttgtcccagaaattggcgtcgcatctggcttgcccgtaaatttccgcaggccaggatcaggagggtcagagaagaccgggggcagcagagcacgggggcaaacaagtggtggtgtccccataacacaccgctcatttcacatattcgtgccctactcttaacgccctcaaaattgagggttgccagatatgtggggatccgaatcctttggatgataatctcgccataaaatatccccccggggatcctgggcaccgatcctgtgaaaaaggtagaccgcggaaaatcgcagagaataacccccagaaggatagagacaagtatcggcgacaaacgtcgcctttgtgggccaagctggacccaatagggagcggccacttggtaaggccacagtgggacgaacaatcccttaaatgttgtgcgctacaagaggaacccggggagaggaagcagcctacatattaggtgaacaacagggcccacaactgtgtattggccacaaataaagttaccgcgtgacccaatgatttaaaggggaga

SEQ ID NO: 643766 - DNA, 261 bp, Homo sapiens
gatgacggcgacgcgcttggtctcaccgggttcgacgcccggggtagtgcgctcaggcttgggagggatgtcaggcgaactccaagccgcggcataactgtcgttccagccgaccaagaaccattcgtgcactgccatacccgaggagctgggcaggctgacatcctggaccgtgacgggagtattgccgttgttggtgatgatctgggtcgagatcatctcgcgtccctccgggccgggacctacgggtccgcacgttct

SEQ ID NO: 643767 - DNA, 636 bp, Homo sapiens
gcccttccctggtacctctgtcccacagccaccccctccccggcgtcggtcctcccggcccgctttctgccccccccgtagtgtgtgggttcttccttccccccctcaagatcgctctctctcccctccccaggtgtcgtttgcccctctcgcacggaccgaccatcattcggccgcgggcagcattatcttccctgggcttgggtgggctcgtggcgacccacctctttcttttttctccgcggcggtctcacgccacgcagaggctctgcccgcgcactgaggggtgagcgcccccacctggctcacctctctgggaacacaggagagcggtgaccgcctcggcggagctcacagcgccccgggcacgacaccgctggggcgtcccccgctcccgcacacgtcctctctgacagcacactagagagaagaaatccgacacggacaggcgcactgacaacagcataaaaacacggatgatgtaccacgacctcactccgaggtttttatcccggatagaaatctttttgtcaatatgagaatattctaattcatcctcgcgcaccccccttgggacaaagtctcgagcgcccatcaatacagtcttattttctgtctaaacaaatagacaaacaa

SEQ ID NO: 643768 - DNA, 252 bp, Homo sapiens
  misc_feature (228)..(228): n is a, c, g, or t
ttctctggtaattttggatttttccgaagatgcaaaagcattcctgcagggccagcacgtggaagtggcaaaagccatgttgagcgtaggtgtgcagatggcagggcgcctggctgagggcgagccggagaaggaagacggcccacggattcttcactgagtccgtttgtcggcttttttgtaagctttattcgtgcagatcggcttctcaagcctgaagaagcctcncgtcatggcggatcctgacagagt

SEQ ID NO: 643769 - DNA, 112 bp, Homo sapiens
gtcagtggtgtgatcttgctcatgcagctcacttcccaggttcaagctgatccttcatcctcagctccccaagtagctgggactgcaggaactgtaccacccacacccagct

SEQ ID NO: 643770 - DNA, 406 bp, Homo sapiens
actagtggatccaaagaattcggcacgaggtttgatttttatccacaagaattgaatctgattcagaatgcttttctcagctgacatacagagcactaaatattttaaggcaagtccatagggcttgaatctcttaaggaattctcgggcctctgtggggatttaggggaggcattataaatgccattaatcccctataggcaattctgtgccctaggattttgccagggaccagttcacttactggggaaggcactccattttaaattcagcattagtgcattgggaagggatctttactgctttgtgcttggcatgtcataatttccattgacatgagggccctctcaaaatgaatgtggggagttgctttcactacaagactctcctctttccactaaactct

SEQ ID NO: 643771 - DNA, 199 bp, Homo sapiens
cattgctacaccaatcataagattatccatgattaaaagcgaaagatatgaacagagaggaaaactaaatgacagaaataaaaattaaaagcacaatatactctatattccaatatccatgtagcactgatcccaataattacagtctgccatatacagtagtgtagacaattgaatcgggtacctgagctctgaattc

SEQ ID NO: 643772 - DNA, 302 bp, Homo sapiens
ctgccttcatgaaactcagtctttaatggaaaagactagtgaagaactgggactacaaacccatgtgagagtaagagtaaagcacatagtattattttaacagaaagctggagcagtaaattaacacttgagggtaaagggtgattctgaaacctaattctcagggcataactgagctgggtcctaaagggagacgaagaagtaatccgacaataaagagggagttgggcaggggaagtgtggtgcaaggcctaaagactgatccaggcacagccggacacacccgtaatcccaggactttg

SEQ ID NO: 643773 - DNA, 771 bp, Homo sapiens
  misc_feature (612)..(612): n is a, c, g, or t
tgccctcatttacataaatatatactagcatttaccatctcacttctaggaatactagtatatcgtcacacctcatatcctccctatatgcctagaaggaataatactatcgtgtcattatagctactctcataaccctcaaacccatccctcttagccaatatgtgtgcctatttgccatactagtcttgtgccgcctgagaagacaggggtgggcctagcccctattagtctcaatctccaacacatatgcgctagactacgtacataacctaaaactactccaagtgctaaaactaatcgtcccaacaattatattactaccactgacatgaatttccaaaaaacacataattgtgaatcaacacaaccacccacagctaattattagcatcatccctctatatttttaaccaaatcaaaacaactattagttgttcccaacttttcctccgaacctaaaaaccccctctaaatataaattacctgatcctacccctcacaatcatggaaagcaaccgcaattatccagtgaccatattcacgaaaaaactctacctctctatataaatcatatttatatcttcttcgaaacacacttatcccacttgntattatcaccgatgaggcaccgccagaagctgacgcggcatatgctatttaacctagagggtccttccctacatgcgggttacaccaaacacttgtcccaacattatacctcccgcgcagaattattcggcacctttttgtcctccccacgttgaaccc

SEQ ID NO: 643774 - DNA, 844 bp, Homo sapiens
  misc_feature (86)..(86): n is a, c, g, or t
  misc_feature (330)..(330): n is a, c, g, or t
cctctcgcggtgggttatacacccccccctccccctcccacggggtgtttctccagtcagatgctgcccccgcaccccgcgcggangggttcgcccctcgtgtgctgttcgtaagacgcaccaccagctgtggggcaaataagtgtgcaccagctagggtggttagtccacaactactcctcttgcgagcgagccgacacaacgtgaggtgggtgacacacacaaaagaagcggttgtctcctcaccgcggtggtagcatccaccgctgaaagtgagagctcatgaaatagagttcgtaaattaaggtcgctcgccatcactctctctgntagagagatagacagactataataagtctgttaatctctctctccgtgagtaggagtcaccccagccacatattcattctctatccccctcacatactatatataatcagtacgagctaagaactctctccttataaaatagagattatctgttctttctctccactacacacaggcgatataatagaataaataaatataatataagagatacaccacacatcttggatctattatgtaaaaattcatgtaataatacacaataaagcgactcacacacaagatgaggtttattaccacataggagacaaattctttcttgtattactcataatttactccgggcgcgccgctcttacaccacgtatttttaagacgtcggataatggtcacccctatctatatatcctttaatcatgtgttgaaagaaaataaaatatttcattgaaatccccacatcgatagtacctcctaataatggattaaagataaactcttccaacaatagatcaga

SEQ ID NO: 643775 - DNA, 423 bp, Homo sapiens
ctctaaggatccttttgctggagaactaccaatctgaagatatacaactctgagactgagaactacgagtgataaacgtctcactagtgaagaggagcgaagtgcactggcgggcttagttgcagaagaaatgcagtccggaaagacctgagcactcgtcagagaaaaaatgctgaggaacatgcgatcgatacaaacaagaaacagagcagctggtatcaaatctgaaggaagaaaatactttgctgaagcaagaaaaagaagccctcaatcaccgcatcgggcagcaggctaaggagatgacagaaactatggagaagaagttagtagaagaaacgaaacaactggaactcgaccttaatgatgaaaggctgagatatcagaaccttctgaatgagttcagtcgcctggaagaaagatatg

SEQ ID NO: 643776 - DNA, 158 bp, Homo sapiens
ggacaacagaaatttattgtctcaaaactctggaggccagaagtttgaaatcaaggtgccaggagggttggtgcctcttgggggctgtgagggaagggtctgttccaggcctcttcttggtctgttgatggtgctcttcccccttctgtcgtcttctc

SEQ ID NO: 643777 - DNA, 883 bp, Homo sapiens
agcggagtaccggtagctcagctccagatggaggaagatgcgaccgtgcagacgtgcattcgctgcggaacgagggatacactggtggcgctgcggcctagcaggtccggcgtcttgagatattcgcctcaggacgcgtgtgtgcatcccgccgggcagtctgcaccaaggtcgtctcaggacatccattgggatggatcataaacagacacaccgatcgcaggagtcactctgcatgttgcggcaaacaacccttgcgaagcaaaagaacgatacggtttctatcgctggtcttggcggtcgtagcgtcgagaatcgagcacattcgcacttgacttcctggtgttccagtggtcctaaccccttcttccagccccctgcagtgcctgtcacgccgagtctagcaatgcttcatgagatgggggacaggaggcgcctcctagccactggggtatcctgtcgaatggccgtatcgatcgaagcactccgtgcgaggcaagactgggtagtcgactggctccatcctacccgaggggttccatggtctcgaaaatacccttcagcccgtctatctactgggccagtggtttattgtacacctagtttaaattcgacgcgtcgagcccctgggaatcgttgttgtacgcatgaactatcgctgcgcgaaggattaacaccaccggcaaaacatcgacctggcgcttgggcttaaggtggcgcgtcaccctcgtcctcgttgcttgtgcccgaagaccccagtcgccaggatgctccccattaaagtgtacgtcatccccatggcttccctgacttgagtgcaaccgcaggcgggctgatgaggaactgggcctgcgtcccgggggtgcgggggcgaaccccagga

SEQ ID NO: 643778 - DNA, 310 bp, Homo sapiens
cgccacagcataatatggtgcttggttaaagggcagcgcaatgaaactaaagtacttatgccggagccaaaactacgtgttagacgtattaagacttcagacaaaccttatttaactttacagcctaaaaataaacagtaccaagcaatacaccgtagttagatagctgctaaaccgaatccgaaagaagatggctttggtgaaggtatttatagtggtaacagtgatggggctgaaccacagaaaattgagctatataaactaaccaataagaaagttctggaatggttagcgtaatagtttatgctgt

SEQ ID NO: 643779 - DNA, 224 bp, Homo sapiens
ctcggtaccgccgctgatgcggcgctgcgcgcggatgagaatcccgctccccggccagcgccgcttcatcgccccggcaacgcgcaaaaccgcctcattcggctgcgcctgctcgcgttcccgtcccatgatttcggcgtaatgggcaatcaacgccccgatcacatcgcacgccacttcgtagcgcacaccggcccggtcaaagagacccgccgaaggcgcgg

SEQ ID NO: 643780 - DNA, 107 bp, Homo sapiens
atttgttttttcccaggctcctttttcttttgttctgccggcccctccgtcccccttccggggagttagccccttgaattgggttccattgttacgccattttccca

SEQ ID NO: 643781 - DNA, 156 bp, Homo sapiens
cccggagagcgatagaatggacagctggtgcgcgcgatgggcttggagcataacgtggtcaaaaagcctggataacgaaaacggttatggacaggcaccagaccatcttgaagccatgggcagagcagagcaagggcaaaacgccagtgagcagtg

SEQ ID NO: 643782 - DNA, 439 bp, Homo sapiens
acatgggcactcctgtgaacagtttttcacttttgatgaaacggggaaccaagaggaacttacttgtgtaactgacaaatttttgcagaaaatcccccttcctctaaattcccttttactccactgaggagctaaatcagaactgcacactcttcccctgatgatagagaaagtgaaagtccctttagaatggtgatactgggggaccgggtagtgctggggagaaatatttttttaatgtttattcggaagaatttggagaaatgattgaaccttttccaggccttgggaaccaattggaccccatattattttccttaaaaaataattttttccaaaatggaaaggaaatgttttatgttgttcaggctaggagtatattggtttgaaatcccagggaccaaaattaaaattaaaaatttaaggaaatattggttaa

SEQ ID NO: 643783 - DNA, 1011 bp, Homo sapiens
  misc_feature (469)..(470): n is a, c, g, or t
  misc_feature (671)..(671): n is a, c, g, or t
  misc_feature (923)..(923): n is a, c, g, or t
  misc_feature (934)..(934): n is a, c, g, or t
  misc_feature (937)..(937): n is a, c, g, or t
  misc_feature (946)..(946): n is a, c, g, or t
  misc_feature (1011)..(1011): n is a, c, g, or t
tccagaagggcttcaactacacggtgtttgactgtaagtgggtgccctgcagcgccaaatttgtgaccatgggcaacttcgcacggggcaccggcgtcattcagctgtacgagatccagcacggggacctgaagctgcttcgggagattgaaaaggccaaacctattaaatgtggaacatttggtgcaatatctctgctgtaaagatgttgcaccaaatgttccacatttaataggtttggccttttcagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatccnnttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacaganaagacataagtatgaataagttagtagccacatctctggaaggaaagttccatgtttttgacgtgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtatgaataccctattcagcggtcaaagaaagattctgagggaatanaaatgggagtngcngttctgtanccttctgcagatgttacgttgtcacccagccatttcaagttggattgagtcagataaaggggttn

SEQ ID NO: 643784 - DNA, 169 bp, Homo sapiens
ctagtttaacacgtgtcaaagctattacttctgtaaagtggataactcccgggtcatagtcaggtgccaaattctatgcttttagtcaaaccattccatatcagaattttccttggttaactatagatatttggcttaaagtggtagtaggtgttttttaatgtacaat

SEQ ID NO: 643785 - DNA, 285 bp, Homo sapiens
tccaaacagtgccttatgttcatattagtttccatacatcgtctgtcccagagtgaggacaagttgatctccttcccacatccaccacatgctgcgtgatggaagccagcctccccacaacttgatccttctgcagccctgcccccctcaattaaaacaatgctttcttttttcttttctttttttttgagacggactcttgctgtgtcacccaagctggactgcagtgccgcgatcttggctcaccatagattcaaatgatcctcccacctgagagacccgagt

SEQ ID NO: 643786 - DNA, 191 bp, Homo sapiens
ctgtattatattagagatccatctttttgtctaatgtgttctggatattccgaatgctcccagtatacatgagtagagttggggtgagtgagtgggccagtgtgatacaaaggaagcagctgtcttatatcactttggattgcactttcatggtttgtttctatctgttggggttgggtggaaagggatat

SEQ ID NO: 643787 - DNA, 640 bp, Homo sapiens
ttgccccaaaacaaaaaaaaaggggggcgggttatgcatgttttttagcgcaagtacgcccttgggtaaaagggaaggcgggggtttaaagcctttagttgaaaaggcagtcttggatgggacccacttcgaacacggttatatgggtgggatggaatcgtgggaattcagcattctcaactctgttaatcagggaggatttcagagactgaacggccacacaggcagtgggtgtacgtgggacccaaatcagtggggcggtctctaatagctatagattacaaagaatccacccagcaagccaatgtgggcaacacgttcacggggtttgtttaagccttgaaggggcccttgtagaacccacggttggggtttcctatgtgccccatgttagcccggcagccagggtaatctttttttgggcggttcctagcatagttggcatgttctgtgcccacggccgtgaattcaatctgtgggtcaagagggtaacaaagatcgtgaggatggatttaacccacaaggcaatcagagactgttcgggaactccactcaggggccaagtggtaaaaatggtttatgtccctgtctttgaaattcaaaaaaggagaatcgggggaagatattccctggggcggaa

SEQ ID NO: 643788 - DNA, 335 bp, Homo sapiens
  misc_feature (15)..(15): n is a, c, g, or t
  misc_feature (67)..(67): n is a, c, g, or t
  misc_feature (191)..(191): n is a, c, g, or t
aaatttatttatttngagacagactcttgctctgttgcccaggctggagtgcagtgacatgatctcngctcactgcaacctccacctctcgggttcaagcgattctcctgtctcagccttccgagtagctgggattacaggtgtctgccaccatgcccagccaatgtatttttagtagagatggcgtttcnccatgttggtcaggctgatcttgaactcctgacctcaagcagtccgcctgccttggcctcccaaagtgctgggattacaggtgtgagccaccatggctggccaaagatattatttttaataaaagcaaaacttttttaaaaact

SEQ ID NO: 643789 - DNA, 898 bp, Homo sapiens
gtcgccgtcaccatcaccgcatagatacactctcatcctacgggccatgcactgggccttgctgcaggaagcttcggccccgacagactcgtgttgctggggtgctcaggtttctttacctccagcaaccgaagaatatgggccccttgaattctggaacgttccgattgaagagtctgaaagttagggacttaatttcaaattttggacagtggcgtagtcgaggcgcaacaagagccaacggcccaaatactggcaaataaaaatatgccagttcaaactagtacttctgggagagtccgctgtctggcaaactcaacgcctagtgcttcgtctgtgaaccggccaattccatgaacttccaagagagtaccattggggctgcttttgctaaacccaaactgtattgtcttgatgacacctacagtcacgaccgtctgcaactagtgggatacagcgtggtcaagaacgattaccatagcctaggcaccaatgtactacagaggagcacaaagcagccatagttgtctatgatatcaccaaatgagggagtccttgtgcaacgcagcacaaaaattgggttaaagaacttcagaggcagcaagtcctaacatgtaatagctttatcgggacaccaggcgacctagccagattaacagaggcagtcggattctcagggacgcacagtcctttgccgatgacactagttattattcctcgggacatcggtagacctcctgactgttctgcaatcttctgccattgtaaaattgcccgatgccccaatcccgggcaatttggcccggcacggttaaccttctgggcccaacccccggatctgggtcgacacccttggtcccggaaagctctgtctccaagtgacccggggggcacaccc

SEQ ID NO: 643790 - DNA, 772 bp, Homo sapiens
  misc_feature (367)..(367): n is a, c, g, or t
  misc_feature (407)..(407): n is a, c, g, or t
gtgggcagttgtactatccagcccgccatcactggactctctcccctatatgtaacctcctaataaaaccccatgtctatctgttggctctgagtgtcttcttcagctcttgaacctggtgcctttcctattgaggttaataggggttcagcatgacagcacctccacctcccatggcacagcatatgtacccaataagcagtccttacaataccaatagtttctatctgttggcactgccaattagccaggcatgtcaaatggaagatctcacttaatcttgccaaaaaaaaatgtttgttcgttgttgttccttctattacagaggaaaaaccaaaggcagatggaggttacattatttgcctanagttacacagctagaaaggagcagagttaagaatcaaacnccggccatccagctccagaaccgagcttgtgaccctggcatgggtatttccggagctctcatttaatatccatacagccccctaaattggagattactactgttacacaaatgaggaaactgatcttggagagggccagtcagctgccaaggtcacagagccagggagtgggggtggcttgcccaaggccaggtctgtccctccaggtgaaggtaatgattaagaacacaggtctggagtgggtttgaatcactgtgtgttcagccgctcactggggacctggcctcagccctctgattactgcagggctttattactttctgagttctctttgctatctcactcgccctttcctcccatttctc

SEQ ID NO: 643791 - DNA, 107 bp, Homo sapiens
  misc_feature (83)..(83): n is a, c, g, or t
gtggaccctactacatgatcacataaagtcgagtcttcaaatccaattctaaagtgaaacattgcatgatttgaatgtacacngcatgattaatagtatcagtgaaa

SEQ ID NO: 643792 - DNA, 833 bp, Homo sapiens
  misc_feature (389)..(390): n is a, c, g, or t
  misc_feature (404)..(404): n is a, c, g, or t
  misc_feature (421)..(421): n is a, c, g, or t
  misc_feature (425)..(425): n is a, c, g, or t
agcggagtctgggcatgtgggtcctgcctgtgacgcgcggcggcggtcggtcctgcctgtaactggctgatcggcggctgctgctccagacacctgcggcgtgcggctggtgaccccgttggctgggcgcggacgatgtggcccctggtagctggctgctgtttgcttggtgctcgtgctgtgcttgcggatcagctcagctactatttaataaaacaaaatctgtagaattcacgttcttgtaagtgacactgtcgtcattccatgctttgttactaatatggaggcacaaaacactactgaagtatacgtaaagtggaaatttaaaggaagagatatttacacctttgatggagctctaaacaagtccactgtccccactgactttnntagtgcaaaattgnagtctcacaattataanaggngatgcctctttgacgatggataagagtgatgctgtctcacacacaggaaactacacttgtgaagtaccagaattaacccagagacaggtgacaccgatcatcgagctaaaatatcgtgttgtccatggttttctccaaatgacaatattcttatcgtattttcccaatttttgctatactcctgttctgcgggacagttttggtattacaacacttacactatagatccggtggtatggcttgcgacacacaattgctttcccttgttgctggactagttgatcactgttcattggccatttgctggaaggccattcttttccgtcccagggtgaaatcttccattcaacgaattgctacctggccctgggttcaacttcgtcacttcctaaccagggatattcatat

SEQ ID NO: 643793 - DNA, 1088 bp, Homo sapiens
gtacatcccgcgcttctggaccttcgaaacaggctgcaccgtgtgtgacgaaggcttgcgcagcctcaagggcattggggatgaagctctgcccacggtcctggtcggctgtgttcatcgaacagcccactgccgttagtagtccctgttcttccagctggctcctgctggtccactacccccagaaacacatgcgacttttcatccacaaccacgatgcagcgaccacaaggctcaggtggacgacgttcctgtgcacagcaatgttccgcgacctaccagctctgtgaacgctgctgggccctgcaggtgcggatgcgcgaatgcagactgccaggaaccatggtgcgcacgacctgtgccggcacggaccgcagctgcacctactaccttcagctgtgcgactgctgacgtggccctgaccgagcccaacagacatgcggcctgctgcatccaacagcaacaagaatgtcattgccccgctgcatgacccgccctgggaggctgtggtcgaacttctgcccgcgctctcagctgcacatgtgctactatgcccagtccagaggacataccgtggaacctttgtcgcagggcgcgcacgatgttgggctgtcctggcacatgtgccctaatctttcaacacaatctacgttggaatcactggcgcatgtgcccttgctgtggctgacgcttgccagaccgtcagcaaccgctcttacccacaccacaacgcaaccctcggcacacccagaaccatggcgcatcccaggtgccaacaaaatccaggccagcaggcacgtgcgccaccgtcacctgaagcaaccggggagcacccgatggcgcatcatggacacccgtagaacaggcaacgcacacaaccaaccggcacaaaccgacccacggcaaaagggagacaaacaaccccccagggacgggccacccagaacaacacaccacagaaacccacgccacggccctgccacgcagcacaggcgccactcccggcccggaggcacccgggccacgatcataacggcggacgcgcaccaccgcagcgaccacgcacacagtccagcgacctgcgcacc

SEQ ID NO: 643794 - DNA, 1237 bp, Homo sapiens
  misc_feature (791)..(791): n is a, c, g, or t
gctggctcataattcacctggtgcaacgcttcaacgcccaccaaggaggacaccaacggtggcgtacacctttgactgctgtgcgtccgcaatgccagtatcttcacccctgcgagcgacgcacctgtgcgctgaggtttgtgtgctgctgtgttggtcccggatttcccgctcgatggtctctaactcgccggatagacaggcgttgatctttgacggggctcgcagggtgacggccaggcccctcctctcatccatgacgctatcactagccttggcagctaggcctacttggaacgccagactccccgggcttgggggctcgaactacagtcgacttcgtcgactcaagggctcggggagcccatcgtaccgtcatcagttcccttgggggagttgagcgccgctgtctgtccgccaaccgtccgctgcgggttcctcgttgcagctggcgcttgtgctgagaagcccagcgttgcccttgagcgttggtgctcgagtccgtggcacgcggcatttgcgctgcgttgtgcctcagcggtggttggccctcgccctgagagctacgggatgccagagagatagttggcttggggccctcgagcctgagaccatccgttggggacattcgtggagtcgttgtagggtgtatccagccttcgggcccacaccatagcggtccgacctatggcgtttgcggctttcctgttggaggcgggccgtcacattgccggactcccgtcgcatggggtcgtcaagcgtcgaagccgtccctcgacggagccctagcntggccaaagttcggcccggctcttgcgttgcgacccatcgttagctattggacggaagatttggcgagttaagcctaggggccgcgtccttggggtgagagcctccgaggcattagagacccatacgggaatcgcaaaaagcaccgggccgttccgaggggttgtgaagcttgcagaaccaaaagcttggttgcgcatgagtagcatcaagttgcgtcccttcccgaggaggaaaaactttcgcatgggaggggacaggattggctttccctaccccaagaacgggggacacgccggggaaaaaggggaggtcccggtcggttggctttggggagagacaaggggatcgcttttgaggagccttccggggaaatgcgccccaatgttttgccacccgtgattaggtgggcttgtgcgaaattgtttctgtccaggaatgagaaacg

SEQ ID NO: 643795 - DNA, 113 bp, Homo sapiens
  misc_feature (69)..(69): n is a, c, g, or t
aatttaaatccactttttattctttcacagattttaacaattatacacaacttttaacataaaggtagngaatttctattgataaggttgcaatatatatggcctcttctatt

SEQ ID NO: 643796 - DNA, 347 bp, Homo sapiens
cacccgcgtccatccccctttgtaggcagagaaaaatgggtattctcagcatgtggttaaaattagagggttaaaatatactatactgtgtgtgtaccctacacatatgggaaggtgtgggatatgtgcgaaaacctgggagataatgacaataatcctctgacatgttaagggtactaacatttcacgtgccagaaccaccaaaagctgttagacaaaaagccctggcttcctatgtcagagggaaccccgagagggaaatttcaacttccgggaacctggagtttgagcccaacactttcaaagctgcagtggctcacccgaggttagcccccctgagtgccagg

SEQ ID NO: 643797 - DNA, 115 bp, Homo sapiens
caggatgtggtggtccacgcctgtagtcccagctacttgggaggctgaggcgggaagatcacttgagcctgggaagtgaagacttcagtggagtcttgatcacaccacttgcact

SEQ ID NO: 643798 - DNA, 176 bp, Homo sapiens
  misc_feature (13)..(13): n is a, c, g, or t
  misc_feature (22)..(22): n is a, c, g, or t
  misc_feature (71)..(71): n is a, c, g, or t
  misc_feature (89)..(89): n is a, c, g, or t
  misc_feature (97)..(97): n is a, c, g, or t
  misc_feature (100)..(100): n is a, c, g, or t
  misc_feature (105)..(105): n is a, c, g, or t
gccagcgccgacncccagagantacagtacttaggggttacacacaacagccgtaactggcggctatctgntcataacaaacaaaccanagcatatntanaccgnatcacatcgagtgattatagaaatccatacacacaccgattgcataaaatctttttttaggaaaaaaacac

SEQ ID NO: 643799 - DNA, 386 bp, Homo sapiens
  misc_feature (386)..(386): n is a, c, g, or t
ccgagtgcactgaatatggcggatgctgtcagacggctgctccgagcgtcggatgcaccgacatgatgagcgccagttcttgcagcattgctgccactgaagccctcagacctgctgcatgtgaacgaacgagcttgacagatctattgagctctgggtacaatcaagcactattattcagcaccagttgcttatgccatgcacctgctgacacccacaatgcaccctattttaaggagactagcgctgtcaatggagagttcaaagacctatgccgtgatgaccttagggggaaatattcgatgcttgtcttctatcctttgaaatgccctttgagaggcctacacttggagatattagtgactgaggtcgattaccacgcgccn
